United States Patent 6,943,241 (FULL-LENGTH CDNA) - sequence listing, part 2

SEQ ID NO: 912 - DNA, 2366 bp, Homo sapiens
acccttcgtagtccgatttgagcactaaaggttgctgactgtgtagtgggcaaaggatcaagtgatgccgtttcgcctgacacgttcacagctactccagcctgcaggagggaccttcccacccccaagacctttgtacttcgttctgtactgaagaaaccctctgttaagatgtgtctagagagcttacaggaacactgtaacaacctctatgatgatgatgggactcatccgagcttaatctcaaatctcccaaactgttgcaaagagaaagaagcagaagatgaagaaaattttgaagcacctgcctttctaaatatgaggaagaggaagagagttacttttggagaggacttaagcccggaagtgtttgatgaatctttgccagcaaatactccattgcgtaaaggaggaacacctgtttgtaaaaaagacttcagtggtctcagttccctgctgcttgagcagtcacctgttcctgagccattacctcaaccagattttgatgacaagggggagaatcttgaaaacatagaaccacttcaagtatcatttgccgttctcagttctcctaataaatcatcaatctctgagaccctttcaggcactgatacctttagttcttcaaataaccatgagaaaatatcctctcctaaagttggtagaataacaaggacttctaacagaagaaatcaattggtcagtgttgtagaagagagtgtttgcaacttattgaatacagaagttcagccttgtaaagaaaagaaaattaataggaggaagtctcaagaaacaaagtgtacaaagagagcacttcctaagaagagtcaggttttaaaaagttgcagaaagaagaaaggaaagggaaagaaaagtgttcagaaatcttttatggggaaagagacattgcttctaagaagcccctcctcagtcctattcccgagctgcctgaagtccctgagatgacaccttccattccgagcatccgaagactgggttcaggttatttcagttcaaatggcaaactggaagaagtgaagactcctaaaaatccagtgaaaagaaaggatcttttgcgtcatgacccagatttgcatatgcatcaaggctatgataaatatgatgtctctgaattctgctcttatataaaaagttcctcatcgcttggcaatgctacttctgatgaagatccaaatacaaatataatgaacattaatgaaaataaaaatattccaaaagcaaaagataagtcagaaagtgaaaatgaaccaaaagctggaactgacagtcctgtttcttgtgcttctataactgaagaacgtgtggcatcagatagtcccaaacctgctctgaccctgcagcagggtcaagaattttctgctggtggtcaaaatgcagaaaacctttgtcagttctttaaaatttcaccagatttaaacataaagtgtgaaagaaaggatgacttcttaggagctgcagaaggaaaactgcaatgcaatcgtttaatgcctaattcacaaaaagactgtcattgtttaggagatgtcttaattgaaaatacgaaagaatctaaaagccagagtgaggatttgggaagaaaacccatggaaagtagcagtgttgtgagttgcagagacaggaaagatagaagacgttccatgtgttattctgatggtcgaagtttacatttggaaaaaaatggaaatcacacaccatcctccagtgtgggcagctctgtagaaattagtttagaaaattctgaactgtttaaagatttgtctgatgccattgagcaaacctttcagaggagaaatagtgaaaccaaagtgcgacgtagcacgaggctacagaaggatttagaaaacgaaggtcttgtatggatttcacttccacttccttccacttcccaaaaagccaaaagaagaacaatatgtacatttgacagcagtggatttgaaagtatgtctcccataaaagaaactgtgtcctccagacaaaaaccgcagatggcacctcccgtctcagatccagaaaacagccagggccctgctgctggttcttccgatgaacctggtaagaggaggaagagcttttgtatatctacacttgcaaatactaaagccacttcccagttcaaaggctaccggagaagatcctctcttaatgggaagggagagagctctctgactgccttggaaaggattgaacataatggagaaagaaagcagtaattgacatttcctgcagagtctgtagcaagagggaaagtaaccatctatgctgaaatgatctgtctagttcccattctctgttcaacctcagtgtttcaaaagttcctaataaataaactcatttgagttgaacct

SEQ ID NO: 913 - DNA, 1794 bp, Homo sapiens
agtttggggaggatggcgggtagggacgcccgacagccccctctgtgccgtgcaaccgccagccaggtgtgcgcgtgggtgagtgtgtccggggcgcgcgccccgccaccgcccccgacgtaccggggattcccccttggaaatgggtcggcgcccggggctcccgagagaagttgagcacggccgctgcacttcagtcacgtcccgaaggacaggcctggcccaccgcgcttccagaagcgtttacggttggagaggggcctgccctcctccggcgtggggctctggctcttcggtggacctcgaccttgattttgatctggatctgaagggtctgcggatcttcagaggcttaactaccgggtggaaaggatgggttttgttcgggggtgatgagattatctaagagacggtgaagaggcatcatctgccgacactgtgtgcatgtggaaggctgctggattccaccacatctgtgtgggttcttcctccagccccccaaaaaagagcccatggaaagccaatctgtgtacttctatttttagaaactagatgatggccatttaaacaactctttgagctctccagttcaagcggacgtgtacttcccacgactggtaaatgattttgctctgtgtctctgcctgtaccttcctcctttctcattgctttttaaaattttattcatttgtttattgcattttccagtgggtcaggccttcagggtctgaggtcttggcttttccctaacaggctgtaaaattcatttttcttctcccacccttttcagatagttccattttgtgggcacattaaaggtggcatgagaccaggcaagaaggtgttagtgatgggcatcgtagacctcaacccagagaggtaaggcagagtctttgtcaggacagaactatcaggctgtggctgagccctgcccacttctgttgtggtttagcactcctcttcctctccttgtggacagtgttgctagttgccagtgccaagaaagtaccatgttcccatgaaacgaatatgtatgaatcccagccatcatttctccagacagctatttatatcagagattataaatataggcccacattttctctttgacccttagggaggccagaggatttttttttttttttaatggttttgaaacatggtgccaggagcaagaactatcaagatgaataagaacccaacttaacattatttcccctggtcaatttctgtggctgtttttgagaattccgaagtggaattctctaattttagtcattttcaacaccaaagttttcaccagagcttgctttaggtaacaaaataagctggtttgacttacttctccataatctaacctctcttgaagagtagtggcctcttaaaaatggacaaacccagaggaggaagaagaaatataagcacttgggtcattttgaaatgtttttatatccaacccttaatcagtgggatgattttcttttcagctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcagggtgagtacctcgagtgcctcggctccagccactggcaggctgataatgttcgacttacctagtgtttgccaagaacacttgaagcagccagaatttctgcatgtccaggaaatttgtcacccaatggtg

SEQ ID NO: 914 - DNA, 3089 bp, Homo sapiens
aaaaaaaaaaaggagaacggacctcagaggttgtctgaaggccgaggccaagatggcggtgctgtcagctcctggcctgcgcggcttccggatccttggtctgcgctccagcgtgggcccggctgtgcaggcacgaggtgtccatcagagcgtggccaccgatggcccaagcaggtgaagctggccttctgggggaggtcgtaccccctcgccccacccccatcccttccttattttctgcatcagtgccgcagccactgaggtgcatggatggggcagggagggggtcacacatcccagtccctgacctcatgtgggtccaggcctctggcagcggccgtgggggctcgcatccgcctctgggaagcacctgcgtggctgacgcctcctgtgcccgtgtgtctctgtgccagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggtagggccgggaccgcaccgcccacgagggagctggagacagggccagcgccacacggagcccggcggcccctgtgagggagtcccacacccccagcagacggcgggctcccccatcctatggatgggccgactcggagcgctgcctcttagtggagcctgtcccctgtgagaagtcggcgatgtattcaggcatcagagggatcagagggagcaggggaagctgagtggaattcctgacacacgcctggtttacagcagtttcatatggtcctacctggcacaaaccaaagacctgcagttagaaataccaagcgagaaggttcctgggggccaaggacactgtcccgcgccctcagccttacagaagggcacgcaggactccctgggacccggggtggccggatttggcaaatgaaaacgtgggaggcttagtttgactgtgaggttagggtgaatttgaccatcaggaaaactgttagtagtaattgtttagtacgagtatatcccaacaatatttgggctatactgacactaaaaagagcattggctgcatacctgaaattcacatcgcaccgggaacattctttatatctggtgatcccgtgggactcttgcacctcacgtggtcccacgagggccatccccccgggcgttcaccttgacagtggtccacggtaggcaggcttggaggtggcgctcatgtgggacaggggacagagtcctgttcttggccaccctgtgctgcgtgcggcattagctcatgcgcagagagcccagccctgagtcccgagtctgggggtttgggcaagcgagaggcacatcctggtgcctctcaaaagtggaggaacaggctctgactttggattccgcttccctggaaagggcgttgatttgttcagcgttctgcacggttcaggtcaccccgggggcagtggagagggcagcctgggcctccctgtgacttgacagcacagagaggtccatcctggggtcaggagctctgcccatgcccctggcgtcttcccctgcagtgcagaccaatggggcaagttgcgagtgtggactgtactcctccctccttgcagactgagctcctccctccctggggaccgcgctcctccctccctgcggactgtgctccctgtctggggactgcgctcctccctccttggggaccgtgctcctccctccctccctgcggaccgcgctcctccctccctggggaccgcgctcctccctccctgcggaccgcgctcggccctccctggggaccgcgcccctccctcccagcggaccgcgctcctccctccctggggacctcgctcctccctccctccctgcggactgtgctgctccctccctgcggactgtgcttctccctcccttggagcagcctggacttgccagagctctgccaggtggggcctggccgccctttcccaggccctgcagtggccttgtcctttctcacctgtttccactcctgctgtccccgttgggccctgggcttcgtcctcttgctcaagccctttgttctgaacctgcgtggcagccgggactgggggatccccagcaaagagctctggcttggggctcagaaagagggtcatcgggtcctcgtgggatgcccgggctctgggccacctcccctccctccgcccagcctccctgcctccatctccgtccagggcagccccgggccctgctccccactgctaagtgtgtctgctgagcgctggcccccattgagtcctgagggctggggccgggggccgggttagtgaggtcagcgtcttgtccgagaggtccctgtgacagcccgggatgagccacgggtggagggcagtggggccttgcccaggggaggaccccactcttcctgcagggacctcccctgcgccggctcccagtccctggcactgcgcccacccagggctgtcagcctccaccttcagaggccggcccgggaaacccttccaaagccgagccggctgcgctgtgcacgcggtcacgcgggctccggctgcgggaagcgagactgaggcaaggtccctgcaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgcc

SEQ ID NO: 915 - DNA, 2467 bp, Homo sapiens
gctggcgtgagctgggtgtttcctgcctctctcagtccgggtttggagactcctgcgtcctccgacttttcatggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgtccagcgggcgcatggaagtgctcaccgacagtgaagaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcgattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccagggtggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgacccctgtcgttgaacaagctgtgtctaagatctctacttttcatgagaatctgagactctttggagccaggctttctcggttctcagaggaaaagtatgaatgagtgtgaagtgtatgtgagaacttttgtttgcaatatttatttttgtgggtgtcgacttcctgtgtgggctttttgggtgacactcccttaagggttcagtttgacaattctgagagttgtcctgcagttggaggccaccagaggtatctgagctccctgcttcctatttcataatcctccagccccagcaggtccactcctggttcctgtgtgtttggcccgggcacaatccccactgctttgctagacgtgctttctgccatgtggctttgggcctagagcttgttgataattgcagcttgtggcagtggaaatatggctgaatgagcgtctaaatcgttgagaccagtgcaactttgggtgcaaggctttgtttagggatcaagccttttgccaccttgggctggtctttggcctggtgctcactgggaccccatatgtctgcgtaggagcagaactttccatggcagtaagtgtccagctctgtttctggttctttccccaactccagccccgtccagttgttctcctgattgacccgactccactccaggaaggccatctgaccctgtgacaggcatagctcataaactacccctccctgggatcccgctcctcttcagcctccttccccatgaagctgggctaactttctaagtcattttgcttagaaattcagtgtggcccataccctttgtcctcccagcctggcatccaggcagggacaccctcacaccaccagccccagggagcttccctgctataaacacagacccccttgtctttgcctctgatttttacacagtgtagagtggccagcagtgaacaggttgaggatgtgcgggtagatagataactttgggtctggtttgtgtctgtgttcatgtttgtttaagggatatgtgtgactgtgggtggggacgtgtgcttgtggggcacaggtggcggcccctgctggagcctggctgggcgcagcgcctatgtaggacgggtgttctcagtgacctacctcccaggctcctctgcacctgcaaaggaacaggagtgagtcgtgactgacaggggtggttgagactagactaggtagagtagttaccaggagatgtgaatgtgcgtcaggtgatggatgggtttgtcaagggaatcgttaccgttttataccaaaggtattaacatgggcagcctttgacacatgtattccaaaaacgagtttatattttcaaacggtttttacagcttagactttgtacttactgccctgcctgtgacagttgtatgccttcattttgtatccaacagcaaagtctacaataaaactttaaaacaatcatg

SEQ ID NO: 916 - DNA, 2251 bp, Homo sapiens
gatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacgcgcacggggccctgcccatcatccactgcaccctggcctgcaggccctggctgcgcccgactgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcatgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgt

SEQ ID NO: 917 - DNA, 2096 bp, Homo sapiens
tagcaacagaatatggacaaagaaagaaaattaatgcaagaagtagagtttttactgtaacagattcctgaaaatgtggaagtggctttggaactgggtgatgggaataggttggaagagttttgaggagcaggctagaaaaagcctgtattgtcaagaatggagcattaggccaggcacggtggctcagacttataatcccagcactttgggaggccaaagcaggtggatcacctgaggtcaggagttcgagaccagcctggctaacatggtgaaacgctgtttctaccaaaaatacaaaaaaattagctgggcactctggcgcacacctgtaatcccagctactcaggaggctgaagcaggagaatcacttgaacccaggaggcagaggttgcagtgagctgagatcgtgctattgcactccagcttgggcaacaagagcaaaactccaactcaaaaaaaaaaaaaaagaaaaagaaaaaaaatggagcattaaagacagttctacagttctggtgagggcttaaaagaagaccccagaactagggaaagtctggaacttcttaatggttactgaagtcgttgagatcagaatgctgatagaaatgtggctggtgaaggccattctgatgagatctcagatggaactgaagaaccacgtgttggaaactggagcaaaggtcatcctttttataaagaagcaaagatcttagctgaactttgtctgtgccagagtcatttatggaaagcagaaaatccgtaggtcacccatgttgtagagaatgaaagaacattttcagctgagaaaactgagagtgtgaccaagctaccgattgataagaaaactagtacacataaattagccaggcgtggtggtgggcgcctgtagtcccagctacatgggaggctgaggcaggagaatggcatgaacccgggaggcagagcttgcagtgagccgagatcgcgccactgcactccagcctgggcgacaaagcgagactccatctcaaaaaaaaaaaaaaaaaaaaaggaagaaagaaaattagtacacatagaacaaagccagaggctgttcatcaggacaagggagaaaaactccaaagccatttcagagatcttcaagactgcccctcccattactggcccagagctctaagagggcagaatggtttggaatgaccagctgctgcccagggctgccttgggtctctgctccccacatttctggtgcagcattcctcagccatcccagctgtggttcaagtggccacaggtgtgatgtggaaggtaaaagtcataaaccttggcagcatacacatggcactaattttgcaggtgtgcagaatgcaaaagctgagggggcatgccttctcccacctacatttcaaagggtgctgtgaacggccaccccagagagcccctagtagagcaaggtctagtggagctacaagggtggggccaccgccaagaccccagaatggtagagctatcatagtgcaatgccagcttgggagaactgcaggcatgagactccaacctgtgcgaagtgcaacatgggcagaacccagcaaaaccacaggggcagagctccccgaagcttcgggggtccaaattccatagtgtgtccaggaggtggcacacagagtaaaagatcattctgaaggtttaaggtttaatgttgttttctatgttgggttttgtactttcctggaaccagttaccctttttcccttgcctctttttccttttagaatgggaatgtctgtcctatgcctgttccactgttgtattttggaagtcaataacttgttttgactttacaggcttacagccagagggaatctcccatagaatgaattttaccttaagtctcacccacatctgatttagatgagaccatggactttggaattttgagttggtgctggaacaagttaagactttgggggttgtctaagtgtggtgtttcatgcctgtaatcccagtgatttgggaggctgaggtgggaggattgcttgagcccaggagttcaagaccagcctaggcaacatagtgagacctgtctctacaaaaataaaaataaaaagttagccagg

SEQ ID NO: 918 - DNA, 2343 bp, Homo sapiens
tattttgcaagtaaggaaatttggtcagggaaaggtttggtgcagtggggccaggattccaatgcaggcaactgtagtgtacggtgccgcatctcttagtctcctgagaatagctgctatttcagtgtttctctgaagataaatgaggcaatctgtgtggacactacataatacctatgcaatacaggttagctagtgctttctctttatttctttctaaaaaaaataatgatgactgatgtatatttttctgattcggagtctagataggaagctttataaatataagaaaaaaggctagggggcgccacctgctccatggtgaagagtgagacgtcagtaacagaagtccgtgcctgccatttgcagatggcctgtccgattatgctcagaacttctcttcccatttctaatgtggggacattgtcatctcaacaaggcctcttgttgccttcagagagccccacgttaagaaacgttttcagatcttcttataactatacacattgaccaaagggcccctctgactactgcacatactgggctcagagttagcctgctgtttagaagtttacccaattccaaaggtttattttgtttgtatcctacccatgaaatttgttaccatatgtatttgaacgcaataaaatcacagttctttaaacatctgtgactcaagcttccataaggaagactgctcttgcccccaacaattgatatttcaaacaaacaataattagtaatttctaaagggatcttttccctttagaaaaatgttatgagaaggccctggggaatcctggacatcagagagcagtcttggggtgtgaaggtcttaaagacaagaacgtgctggctcagtgcaaaaaacaaacgagaattaaaatgaaaccacattttattgtgctctttacaaattgctttcattagaaagaaaatgctacccagttgggactgtcgtaagaaattaaagcgtgtgtggcatgcacagctccaaggcctctcctcctgggcagtgattggcacttgctacctactggttagctgctgttgatggcgagtatctcttgcgcatcagtgtggtccactctttgtgggtttagagtctggaaggagcacagctgccatctgggtgccttcacaggtcaccgagctgggacccagccctggctccctccacccggtggcctggcccccagatgctctgctgtccctgcaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgtgagtatcctgtctcctggcgtcccctctcgtccctccctgtgctcatccttccttcttgcccagaggggctgcccgcctttcacagtggccaacatgttctttctgaagagccccctcaggagaagctgcagtctgctgtctgcggggccagcgcctccaccgtcaggagcctgggcctgaaacgctaaccctgttccgcagctcagagacctcaaaggcctcagccccccgcacccagtgtcgcctgcaccctcattacgtccccaccacagccctggccctcttccccaccctcattctcactggagcctcagtctctcctgcttggtcttggccctcaactggggcaagtgaagccagaggagggtccctcagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaagggagtgtcttctctctccaggtttcaccttccagtgtgcagaagttagaagggtctggcgggggcagtgccttacacatgcttgattcccacgctaccccctgccttgggaggtgtgtggaataaattatttttgttaaggc

SEQ ID NO: 919 - DNA, 1702 bp, Homo sapiens
agcgcttttctccggaggtcgcgcgcccgagagcccgcgctgtccgccgccgctgcctgagtcgactctgcgccgcccgccgcgatggaggccgccgcccagttcttcgtcgagagcccggacgtggtctacggccccgaggccatcgaggcgcaatacgagtaccggacgacgcgcgtcagccgcgagggtggcgttctcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctgtcggcgccattgcagttccgctctaaggaggtgtccaagagcaacgtggtggacgacatggtgcagagcaacccagtgctctatacgcccggcgaagagcctgaccactgcgtggtcatcaagtatgtgccgtacgtgggtgacagcaagcgcgcgctggatgagtatacctcggagctgatgctgggcggaaccaacacactggtgctgcgcaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactcagccctccttcc

SEQ ID NO: 920 - DNA, 2065 bp, Homo sapiens
gacatggtgctagaggttgggtggtcagacactgtgatcccgggtgctgtgcccgcactacgggaaggggaagcagcgcgtgggtctcgcatcaggaggcaaggccaggacccgctgacccatgcctcctgccgcggtcagagcccaagtttgtcaagaacgacgtgggcggccagcgcagcctggtcaacaagtggacgacgttcctgaaggcgcggctggtgtgctcggtgcccggcgtcgagggcgacacccacttcgatcagctcctgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagagggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtggcggccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcagaaaaccccagtcctcggccttgctatgtggtcttgggcaccttactagcggtgtcagggcccgagtttctcctgtccaaggttgcctggtgaggattaaaggtggttccggccaggcgcggtggctcacgcctgtaatcccaacactttcggaggcccaggcggacggatcacgaggtcaggagatggaaaccatcccggctaacacggtgaaaccccgtctgtactaaaaatacaaaaaattagtcgggcgtggtggcgggcgcctgtaatcctagctactcaggaggctgaggcaggagaattgcttgaacctgggaggtggaggttgcaatgagcctagatctcgccgctgcactccagcctgggcgacagagcgagactcc

SEQ ID NO: 921 - DNA, 1753 bp, Homo sapiens
agcgatggcggccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaggttgctagtgaactttatgtatctgcaaagcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgccgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggccccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagccc

SEQ ID NO: 922 - DNA, 2407 bp, Homo sapiens
gcgcaagcccggagcagcccgctggggcgcacagggtcgcgcgggcgcggggatggaggacggcgtggccggtccccagctcggggccgcggcggaggcggcggaggcggccgaggcgcgagcgcggcccggggtgacgctgcggcccttcgcgcccctctcgggggcggccgaggcggacgagggcggcggcgactggagcttcattgactgcgagatggaggaggtggacctgcaggacctgcccagcgccaccatcgcctgtcacctggacccgcgcgtgttcgtggacggcctgtgccgggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggctgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacag

SEQ ID NO: 923 - DNA, 1810 bp, Homo sapiens
agagtgtggtcaggcggctcggactgagcaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtg

SEQ ID NO: 924 - DNA, 1921 bp, Homo sapiens
aaaaagaggaaagtaagggctgactgaggctgtcagatcagagagctgaggctggaagtggctacagtggtcctgatgacccagctgaggtcactggttggctcttgcttcagtagaggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagagaaacatggatggaactggaggccattatcctaagagaaataactcagaaacagaaacagaacgtcgaataccacaatttctcacttgtaagtgggaactaaataatgtgtacacatggacataaagtgtgtgataataatcattgaagacccaaaatggtgggagagtgagagaggggtgaaggatgagaaattacataatggatacaatgtacactcttcaggtgatggctacactgaaagttcagacttccactacacaatttatccatgtaacacaactgcacttgtaccccctaaattcgtaaaattttttagaaaagattagtaaaaaacataacacctggtggtcaggaaatcttgattttagaactttgtatcccctaccttactttgtcacattggcaaagttacttcctcaactattgaagatgaattttagactagaattaactatcccccaaaacaggggtccccaacccccaggccacagacctgttatctctctgtgggctgttagaaaccaggctgcacagcaggaggtgagcagtgggccagtgggtgagagagcattactgcctgagctcctctgcctcctgtcagataagtggcagcattagatttttttttttttttttttttttttttgagacggagtctcgctctatcacccaggctggagtgcagtggcacaatcttgggttactgcaaactccgcctcccaggttcacgccattctcctgcctcagcctccagagtagctgggactacaggtgcctgccaccatgcccggctaatttttttttttttttgtacttttagtagagatgatgtttcaccgtgttaaccaggatggtcttgatctgctgaccttctgatctgcccgcctcggcctcccaaaatgctgggattacaggcgtgagccaccgtgcctggccagcattagattcttataggagtgcaaactttattgtgaccttcacatgtgagggatctaggttgtgcactccttataagaatctaatgcctgatgatctgaggtggaacagtttcatcctgaaaccattccccaccccccaacaaagtccatggaaaaattatcttccacgaaactggtccttggtgccaaaaatgttgaagaccactgcccccaaaagaagcaaatcactactgtgtctaaggcacagccagcctctgtaggggtatgagatgcaaaacatacaattctaaatcacaaggtgccattttgccctaacttattttcactaaatctctattttttcacccttagctt

SEQ ID NO: 925 - DNA, 2258 bp, Homo sapiens
aactactctctgctctttgggtccactcagttctcctaaaaatcattcactgcctgtgttagtttgttctcacactgctaataaagacatacccggccagacatggtctgtcacacctacaatcccagcattttgcaaggcagaggcgggcggatcacccgaggtcaggaatttgaacctctacctcccgggttcaagcaattctccagcctcagcctcccgagtggctgggattacaggcacccgccaccatgctcggctaatttttatatttttagtagagacagggtttcaccatgttggccaggctggtctcgaactcctgacctcaggtgatccgcccacctcggcctcccaaagtgctgggattacaggcgtgagccaccgcgcctggctagttagttattttctagatacaatgaggggtacaggcattgagtaaatatacccattccaaatgggagaaattggccaaaacataggggctacaggccccatgcaagtctaaaatccaatgtggcagtcaaatcttaaagctgcaaaatgatctcctttaactccatatctcacattcaagtcatcctgatggaaggggtaggttcccatggtcttgagcagctccgcccctgtggctttgcagggtacagcctctctcccagttgttttcacgggctggtgttgagtgtctgtggcttttccaggcgcacagtgcaagctgttggtggatctatcattctggggtctggaggatggtggtcctcttctcccagctccactaggcagtgtcccagtagggactctgtgtgggggctcccactccacatttcccttctgcactgccctagcagaggttctccatgagggctctgcccctgcagcacacctctgcctggacatccaggtgtgtccatacatcctctgaaatctaggcagaggttcccagacctcagttcttggcttctgtgcacctgcaggcttaacaccatgtggatgctgcaaaggcttggggcttgcacctcctgaagccatggccccagctgtaccttggcccctgctagccacggctggaccagctgggatgcagggcaccaaatcccaaggctgcacacagcagggggtccctggacccagcccaagaaaccatttttccctcctaggctgctgggcctatgatgggaggggctgccgcaaaggtctctaacatgccctggggacattttccccattgtcttggtgattaacgtttggctccttattacttatgcaaatttctgcagctggcttgaatttctccccagaaaatggggttttcttttctatcacattgtcaggctgtaaattttccaaacttttatgctctgcttcctcttgacgctttgccacttagaaatttcttccacctgatactataaatcctctctctcaagttcaaagttccacagacctctagggcagggacaaaatgccactggactctttgcgtagcaagagtgatctttattccagttcccaatatgttccttatctccatcggagaccacctcagcctggtctttattgtccctgtcactatcagcattttggtcaaagccattcaacaagtctctaggaggttccaaactttcccacattttcctgtcttcttctgagccctccaaactgttccagcctctgcctgttacccatttccaaagttgcttccacatttttgggtatctttacagcagcaccccactcctggtaccaatttactgtattagtctgtgctcgtgctcctaataaagacatacctgagactgggtaatttataaaggaaagaggtttgattgactcacagttccacctggctggagaggcttcacagtcatgactgaaggcaaatggggagcaaagtcacatcttacatggaggcaggcaagagagcttgtgcaggggaactcctatttataaaaccatcagatctcatgagacttaatcactaccaccagaacagtatgggggaaactgcccccatgattcaattatctccacctggcccagcccttgacacatggggattattacaactcaaggtgagatttgggtggggacacagccaaaccatattattatccctcaaaatagcctgtattcccccatctccctctcttctgtgaagagggaactatgtaagctccatctggcccttccttgagtctcatattttacatggctccatgcttatgcaagttaataaatttgtttgcttttctcctatt

SEQ ID NO: 926 - DNA, 1772 bp, Homo sapiens
agagaggggaccccttttactacagggcacacagccggctgagccaggacccaccacactcaactccccggcccctggctcccaggaggtggctcctccatggccgggaaggacccccacggctgctcccgcaggcagatggacagacgatggccccctcccacggcctgcgggctgtgtggcatcgccacctcctcccgagcaggctgcctttaagaaaccagaagattgatttcctggcaggctctacgccgaggagcccgtccaaatggtttgcatgtctgcattttttactgctccgtttaatatgtatgcaaatgccggccggctgcgcccgccgcgcggctgcacagtcacacgcggcgccccattaaagcggccgtcccgggcgcgcgcctcattcgaggcgacgggctccgggccctgatagatggggtgcggggacggagacaaatgacggcctttgtaatttcttttctctctttttccgggggagggggaactcgcagaggagatttaaatatatgcaaaattgtttgcgggctgggggtggggcggaaacctgaaaggggcggcggggggaggagctggtgtgttcctggtgggagtcgggctggaggcaggaggggagccgggcccccacagtcaccttctggcggagacagccgagcgagccgctctgctcctgataagcaggcccggtcctctgggaagcgtgggcttcagccgcagagaaaaggaaaatgctggttattttcggccccgttacacgcgggaagccggggatggtggtttttcccccatcgcaccaccgctttcttttcttgggcttccagggcttataacttaattggtacggtgtcatttaagtttcgcattagcccatgaagtgggtcccgggttcacacccattgtgcagatggggaaactgaggtttgcgggagtgaagtcccttggggagggttgcagagagagtgggtggggattgggtccctccagagccctgtctttgatccccacggccctctgctgtctctctggctctcagcggtggggtgtccgcgtgcctgcctgtgccccaaatctgcccgggctcgccccataccacgagccagccccctcctcctgcctgcccccacgcgcgccaggtgacaggcccacagcccagcgagctgggggactgagcctcacattttccaaatattgcttaagcctaaaatccgaagtgctggttttaaaggaatctttcctaatttgtcaggattttaggccacatggcagctgggggcagaaacatttctgagaggaggctccagcctcaggagagacccaccgtggagcagaccactcagacccaccggagacccagagttacacactgctgtgtccgtgtgtgcgcgcctgtgtccgtgtgtgcttgggtgtgtcgtgtcattgtgagtgtgctggtgtgtgtgcaccagtgggagtaggggagtgtatattagtgcatgtgtgagtttcagtgtgtatgtgttagtgtgttacgggaaaggggtcctgatccagaccccaagagagggttcttggatctcgcgcaagaaataattcaggatgagtccacagtgaaaagcaaaagcaagtttattaagaaagtacaagggattgggcgcggtggctcgcacctgtaatcccagcactctaggaggccgaggagggcagatcaactgaggtcaggagtttgagaccagcctggccaacatatagtgaaaccctgtctctactaaaaatac

SEQ ID NO: 927 - DNA, 2369 bp, Homo sapiens
ctgtatagcagtagatcatgaggacatggacaaaggcattgcacctactttctccttgagcaatttccattgatgtctgtgatgctgatactgaattacagaatcccgaggattctgtattgttgtagttctaaaccttttgctgtggaggttagcctgtggataggaagagtcaaacaagaacaacttatacagtttctctggctagaaaatgaacaatacatgcttcctgtccttatgatgttcccacatgtggatggtgaagcaggcaccaagatgactaagctagaacaacaagatttggtgaatccagagctgacgaataacagttcatctggcatggaagcaaaggaagaagttccagggaaggcaaaggcccaaatttgtgaatctgtgtgccatgtgctggggaaaattgaaaccttccaatgaactagaatgaatgttgtgtgtatgggaagcctatggactcaatgagaagaataattagtgaatgtgtccatgttgtctatattttacatgggtcagaaggaaggattgagtgcagaagacaaaatgttaatcggaagtggggtcattttcatatttaggcttaaacaagaatatagacattactattaaagcatagaaataaaaaaatgatgatatttttaagtgtcataacttctaactatttgccatcatatttttggtttactccctttcaaatacacttaagcgtaagtgtagcctagaagagagcaagacccaatatttggctagttcagggagtgacttacaagcaaagcagttccacccatgaccaatttcttaaatttctggagcaacccaagtagcaagactgggaaaatatgactgaatttgcaaaaaatcaagtcacttctttggaaagatgttaaactccaaagatcaatgtatagacctttccacttagcttacaactagataaaacattcttttgacatgaaatggcttaggacaaatgctttaacaaaagaactgattaaacactgctgttactaaagcctcacaatagttaatgcacttaaagagttctaaatcggctgagcattgacgtcttaaaggattatattgagtgtcaccatatacacaggaaagtctccttcaaaacctactatggagtataatggactatacatgttattgtaaacaaattggcaagattcgaggttttctctggattctagcatctttaaaaagagaatgtctgttgttttataaaagcatttatttacatctttatcaggtatcctccagtcccaaatgtgagaggttagggcaatctgtggattggggtggctttctcttctaagtcactcccagactagggaagtgactcagaagagtcactgagtggggaaacacagaaccagggatggctctgtagctctgacctaacttaaagctccagattggtctgaccttttctcactttgcgattcagacctgaaaaaaatgaggccaaagttggctcatcttcctcccttgaaaatgttctaaggagatgaaccacatcctgtcctatctcccccaaaccatacctcagcacaggggcttgtttcattggtacaagaataagttgtctttcttttgctagaaagctcacaactttaaaacctacaaaaaatgaatgaattataatctagaacttcagatatctgtatcataatagttggatatgcttatggagtatgatatgatcttttgcagcaaaatctcactttgtactcaacaaatacatacaattattatttgaaagttcaattaattagtttaaaaatctgtagaaatatcagtgtcttctggggaggaaattattacgtgcatgtcaagatttgccaaaattttaatactttgttaccctatgtcacttttgtgaagtgattatagggatatttttctaaatatagagtttatcataaggaagttttgttaacaatagaatcttaaaagtgcactaggatattcattgcaattttgtttttaaaagtaaaaaaacattggctggatgtggtggcttatgcttgtaatcccagaactttgggaatctgaggtaggcaaatcacttgaggcttgaagttcgagaccagcctggccaacatggtgaaaccccatctctactaaaaatacaaaaattagctgggtgtggtggtaggcacctgtaatccaggtatgtgggaggctgagacacgaggatcacttgaaccaaggaggtggaggttgcagtgagccgggattgcagtgagccacggcactccaccctgggcaacagagcaagactccatgtcaaggaagaaaggaaggaaggaaggcgagagagagagagagaaagaaagagagagataaag

SEQ ID NO: 928 - DNA, 2773 bp, Homo sapiens
ttgctgtgtcaattcctgaggacaagcatgcaggtggcactgaggagaggttccctcgtgcatcccatgaaaaggtttcccaatttccttcccaagtgcaggtggatcatattttaagtggtgctaccatcaaatctacaaaagagctactttgcagggcacccagtgtgccaggagtcccacaccatgtcctgcagctcccagagggagagggtttctgcagtaattcccctcttcaggttgataacctgtctggagataagagccagactgtggacagagcagactttaggagctatgaagagaatttccaagaaagaggaagtgaaacaaagcagggggtccagcagcagagcctgtcccagcagggttctctttctgcacctgatttccaacaaagtttgcctacgacatctgctgcacaagaggaaagaaacttggtgcccacggccccctcaccagcaagctctagggaaggagcagggcagcgctcaggttgggggacgagggtctccgtggtggctgaaactgctggggaagaagacagtcaggctctgagcaacgttccatctctctctgatatccttttggaagagtctaaagaatatagacctggaaattgggaggcaggcaacaagctgaagattataactctagaggcttccgcttctgaaatctggccaccacgacaactgacaaattctgagagcaaggcatcagacggtggtctcataattcctgacaaggtctgggctgtacctgatagtctaaaggcagatgctgttgtgcctgaattggccccctctgaaatagcagcattggctcacagtccagaggatgctgagtcagcccttgctgatagcagagaaagccataaaggcgaagagcccaccatcagtgtacactggagaagtctttcttcccggggtttcagccaaccgagactcctggagtcatccgtggaccctgtagatgaaaaggagttatctgtcacagattcactgtcagcggcttctgaaactggagggaaggaaaatgttaacaatgtgagtcaagaccaggaggaaaaacaactcaagatggatcacactgccttctttaaaaagtttctgacctgccctaaaatcctagagtcctctgtagatcccattgatgagataagtgtgatagagtacaccagggctggaaaaccagagccctctgaaaccacaccacggggcgccagagaaggaggtcaatcaaatgacggaaacatgggccacgaagcggaaatccagtcggccattttgcaagttccatgtctccagggaaccattctgagtgaaaatagaatcagcagaagccaagaaggcagtatgaagcaggaggcagaacaaattcaacctgaggaggcaaaaactgccatttggcaagtcctgcaacccagcgaaggcggtgaaagaattccaagtggatgtagcataggccaaatacaagaaagcagtgatgggagcttaggggaggctgagcaaagcaaaaaggacaaagcagaattgatttcccccacttcacctctttctagttgtcttccaataatgactcactcttctcttggggttgacacgcacaactccacaggccaaattcatgacgtccctgaaaatgacatagttgagcccagaaagcgtcagtatgtgtttcctgtttcacagaaaaggggaactattgagaatgagcgtgggaaacctttgccctcttctcctgatcttaccaggttcccttgtacttcatctcctgaaggaaatgtcacagactttttgataagccacaaaatggaggaacctaaaatagaggtgcttcaaattggggaaaccaaacccccaagctcatctggctcctcagcgaagaccttggcatttatttcaggagaacgtgagttagagaaagcccctaagttactgcaggatccatgtcaaaagggcaccctgggctgtgcgaaaaagtccagggagagagagaagtccctggaagcccgagcaggcaaatcgccagggaccctcacagcagtgacggggtcagaggaggtcaagaggaagccagaagccccaggcagtggacatttagctgagggagtaaagaagaaaattttgtccagggtggcagcactgaggctgaaactggaagaaaaggaaaatatcagaaagaactcagcctttcttaaaaagatgcccaaactcgaaacatcattatcacacacagaagagaaacaagacccaaaaaagccatcttgcaaaagagaaggaagagctccagtattactgaaaaaaatccaagctgagatgttccctgaacactctggaaatgtaaaattaagctgccaatttgcagaaattcatgaagattctactatctgctggacaaaagattcaaagtccatagcccaagtgcagagaaggtgcgatgtttttccctggttacttttcacagttgttgcttgtttatttcacaacatggttgtaaaaaagaaaaaagaataaattataggacgtgaaaaggaaaattgaagcagagattccacatccacaatattaaaaaagactaaatatcggaagacaagtgtctggatggggaaaatgatggaggattcttgcccaggttttgccagaattgagttctggggttttgggaagtcacacaacctttcactacattttttaaatcaggggaaggaacatgtcaaatgatattctagtctgaggttctgtggtcctaagattaaagagctctcatctgt

SEQ ID NO: 929 - DNA, 1928 bp, Homo sapiens
atatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggcttttaaagctgtcagtgatatctgcaaaatcctgaatattagaagatcagaagagctttccttgttaaagccgtctggtgactattttaagaagaagaagaaaaaagacaaaaataataaggaacccataattgaagatattctaaacctggagagttctccaacagcttcaggttcatcagtaagtcctggtttatacagtaaaaccatgacccctatatatgaccccatcaatggaacaccagcatcatccaccatgacttggttcagtgacagccctttgacggaacaaaactgcagcatcctcgcattcagccaacccccccagtccccagaagcacttgcggatatgtaccagcctcggtctctggttgataaagccaagctcaatgcaggttggctagactcctcacgctcccttatggaacaaggcacccaagaggatgagcagctgctcttacgatttaaatattattctttcttcgacttgaatcctaaatatgatgctgtccgaataaaccaactctatgagcaagccaggtgggccattctcttagaagaaattgattgcacagaggaagaaatgttgatctttgcagctctacagtaccacattagcaaactgtcgttgtctgctgaaacacaggattttgcaggcgagtccgaggttgatgaaatagaagcggcgctttctaatttggaagtaaccctagaaggtggaaaagcggacagccttttggaggacattactgatatccctaaacttgcagataatctcaaattatttaggcccaagaagttattaccaaaagctttcaaacaatattggtttatctttaaagacacatccatagcatactttaaaaataaggaacttgaacaaggagaaccactagaaaaactaaatcttagaggctgcgaagttgtgcccgatgtaaatgtagcaggaagaaaatttggaatcaagttactaatccctgttgccgatggtatgaatgaaatgtatttgagatgtgaccatgagaatcaatacgcccaatggatggctgcctgcatgttggcatcgaagggcaaaaccatggcagacagctcctaccagccagaggtcctcaacatcctttcatttctgaggatgaaaaacaggaactctgcatctcaggtggcttccagtctcgaaaacatggatatgaacccagaatgttttgtgtcaccacggtgtgcaaagaaacacaaatccaaacagctggccgcccggatcctggaggcgcacctgcaagccccattccattcctacagatctctcagccacctgtaagtcctttgtgaagatgtgggtgacacagggggacaggaaaacccatttctcaacccagatccatgtctccactgcttctactctgggttgggattcaggaagacaggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgactcctggccttttatctaaaggactttggcttttgtaaatcacaagccaataatagacttttttctccccctc

SEQ ID NO: 930 - DNA, 1764 bp, Homo sapiens
aaattgcctggctgctagaggaaacccgaagtcgggattctttctttcctgctctgagagggaccaggtccctcctccgtagcttttgtctctctattgcctgcgccgtgtcctggactgctcacgggagttctgcaggagacgccggaatatctggaagctgaaaaatggaaataaatggaaagaccagaatattgaagatcactacagaaatctaaggatgaaatcaacagccaatctgggtgccattgagacatctaaagccttactatgagccagatacccaggaagaggttttgggaggatcccaaagactccctggttgcagccatgtcaagactgatgctgaggaggaccccaactgtcacgagcaacaactgcctggggacagatcaagaagctgtcacagatggcagagaaaaacctgagaaaagcgggacaaccagtcacaatgagtaatttaatgatagctatgacagtggtgatcaccattgccatgagtattccttcaacaagggctgacacagagaacaattacacttattgggcatatttatcaatcttggctggcaataatgcctggatgtgatcactctatgacacagttacacatgctttctggtctcagtatttaccataataatctgctcctataattgaggcatactgccctcaaaaaactatttgtaaacaggattggacctggtcagaaaaaatgaacgtacttgtttgggaagattgcattgcagaacaggcagaggtgctgcacaacgattcctatggagtcattattgattgttcccctaaggggatgtttagcttgaattgcgcctctcagtctgcctgccatggccacactatgttcagctggtctgaacaaaatggtcagatggtagaaatgataagaagtatggcaagagttcctattatctggaaacatggtggtatagtggcacctcaacctcaaatgatatggcctgctgtaggagctaaacataaggatttgtggaaactattaatggctcttaataagatcaaaatttgggaaaggataaaaaagcatctagaaggacactctagaaacttggatattgcaaaattaaaagaacaaatatttaaagcatcccaggcacacctgaccttaatgccaggaactggagtgcttgaaggagctgcagatggattagcagctattaacccattaaaatagataaaaacacttggaggctctgtgatttcaatgatgattgtgcttttaatctgtgttgtctttgtatagtctgcagatgtggatcccaactcctgcgagatgtagctcaccatgataaagccacctttgcttttattgtcttgcaaaaacaaaaagggggaacatgttggggacaggctcccaaatctggccataaacaaaatctctgcagcactgtgacatgttcatgatggctatgatgcccacactgaaggttgttcatttactggaatgagggcaaggaacacctggcccacccagggcggaaaactgcttaaaggtgttcctaacccacaaacaatagtatgagcaatctgggccttaaggacatgttcctgctgcagataactagccagagcccatccctttgtttcacataaggaatatttttagttaatctataatctacagaaacaatgcatatcactggcttgctgtcaataaatgtgggtaaatctcttttcatggctttcagctctgaaggccgtcagccccgatttgccactccacattct

SEQ ID NO: 931 - DNA, 2540 bp, Homo sapiens
agggcgtcatcccaagtgcaacatgggagaattagagttagtgaaatgctcctaatctcaaagtagcataaagataatggctttccgtggtgactcagaaagtactttagggccacttgtttttttaaacaccttattatgaaacttcccaaccctaaccaaaagtagagcaaatagtatatgatccttccctctccacatttaagggcactgattttagtatctatttccattgttcatcgtagggggcacaggagagtagtaactggcaaatgctgtacagttttcagagtgccaccacacacacagacccactcgagtctgccagaaaaagaggatgggacaggtggggtttagcccattttataggtgaaaccaagatgagagggaatagccccgtggagagtgacagcccggactgtgaactcaggcctttgcggctgtggttcagcgccactgctcccctctgtcctgtgcgtctcgctttatgacatgccctggaatatcctaagggaaaaggtttgtgttttgtcagctcacttctgcctttttttccccccatacaagtaaggcattatagaaaggtatataagtttatctcacattgtaaggtaaaagaggtttctggatgatgaagtgcccgatgcaccagctttgactgtgcgtaacaatatcgtgtgcctgtgtagcatttaaattctttcctaagtgcttttgcatcctcatagcggcccgtgatgggcagagcagggctcattactcccgtcttctggatggggctctcgaaggcaagtgatcacctaagtgcgaatggacgaagattccgatctaggaggcaggtgcccttcctggtagcttggtgttctgtctatttcatcacagactgagaatctgggaaggctcagaggaggcagcctggaaatgaaatgtcttttcattttttttttcccaaactagttctttctcagaaaccttttatcctaaggctcaggactgtgagcaaccactggggaggtcctgggtttaacaatttcctttccatgtctgccaggctccagcccacctgggagaggcttcttctgaggttcacccctcccctgtgtctttgtctcctttctctgcgtctcagacgaggctgtcataccgggaatttcagtgggcaggtgctcaaggaagggagagaagcagataaggataccagaggcagccgaagtgtttttaatttaaattatcctcctcctcagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcagtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcct

SEQ ID NO: 932 - DNA, 2326 bp, Homo sapiens
tttgatgggaagaatgaggacctggttgataaaattaaagagtcccttactctgctgaggaagaagtgggcaggcttggctgaaatgagaactgctgaagcaggacagatagcttgtgatgaactattcacaaatgaggcggaggaatatagcctctatgaagctgtaaaatttctaatgctaaacagagccattgaactatataatgataaagagaaaggaaaggaagtaccatttttctctgtgcttctgtttgctcgggacacatcaaatgacccaggacagcttctgaggaaccacctcaaccaggtgggacacactggtggtcttgaacaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatatctcaaatcaaaactctctctaatggtaaactggcttctaatttttttaagtacagtatttttttttcccctttagtagtaacgggtttctatagatcttcctatacagtctgctttaactcaggaccttgagattatgagactgacgtgctgcccactgcactgagggggcttctaacagtctgctttaagtggtataattctgggatagatctgttactggcatagtcatgacaacctctggtaatcttaccttctcctttttatgaagggaagagcaatggtttggacttacatcttaattaaggctattttaagcagattgttttgcaacagattaagaattgggtcccaaagtgggttatttcaaggcatttttgaagactggaggagcgtaggagggagtggtgagggaacctagaacttcttgctccttgtgactatgacagatgtctgatgcccccagcgcactggagtctggggcttggtgcaggtggtgccccaccagtgtggacagacactacttgcctttgtggtttagtgttggaagctttaattattctacagttccatagattcacaattttatagccaaacagtttgtatccacctgctttcagaggaggaaccaaaggccaaattactttgaggtagggcttagctggacctgggttttcctatgctcttttcatgctgtgttggagggtgtgtccactgccagatctgtgtaacccgtctgggtcaggggatgagtgacagcaaaccatcttaaaatttttcatgagtacatttaagcggaagcatacgggaatatgagtgcaaaagtgtggctgagccgcgtatgcccttgattggttttgggaagcctgagggaggcagccttcctggctatgagccatcgcctgcccaatcaggctaagggtggtgactggggtggtgaaggggcagctctgctgagcatggtctgccttatggcctgaattgtcctcaaggggtgtggactgcagatggtgttcacatgaaccggagacatcactctttaggattctactggcagcccctgaattggctcaacgtttgtggaggtggtatttccctgaagtactgagctttgttttataataattaaaatccttatttggtccaatttaatatagtttagaagctattttttttgaggcaaaccgtttttgaaaatgtaaattttgtttttaattaaaaataaagtcttagttaagaaaactcaggatgcacaaaactattcagactgttactttagctttctcccattacctcatcagtaatattcaccacattttgctaaatatttattgattagagtgttgaaatcaaattctgctctaaatgtgtgtgaatatgttggagaggctttgtgttcttcactgtgaaatgcaattgtgccttgaataagaaggtacctagaagccaaattaaagtaataatgacttctt

SEQ ID NO: 933 - DNA, 2222 bp, Homo sapiens
agtttcttgaaacagctccatgttctttcttctggcctcccacatattccttgggctagaaatctctttcttgattttaatcttggcagccaccctccatgacagccttaggtctgcacattcatcgagagagccttgcttccttcccagcaccctgcacacgggtgtacatgggtacacatacatgcacacacacatgcacacacatatgcacacacatgtacacacatgcacgcgcacacacacacacacatatacacacacgcatcctttgttaggagtgagtttactactacattctggcctgtctcccacgttcgagtcaggcgaaggggaacagcagctttgaagatgaatttaaccagttcttcctgagggcggattgcggtctccttatctgacccttgctgagagagaaggagcagcgtggaggaggcggcagtcagggaagccttgtctcagtccaagagcaaagtgactaccgtgtgctgagcactggagcttggtgacccaaagatgaataagactcgactcttatccttaaggagcctgcagtctgatcaagtcattactgagaagagaggaaggaaaagatacccttggcctttccaacttgtcaagggtcaactgaattcctgagccggtccccctgagagggcagtgggcgagattccagcaggtaatggatgagtacagctatgccctgacagggacattgcctgcaattggttccagtcatatatggagccaaactgctttgaaaattgggggggatggtgacagaagagagcaggcccacccctcccccatcccctaggagcctagggccctgtcttgatcccccttctgggagatgaaacgtgtggtttcccaaagctaggagcagagcaaatatcttctgcctcggaggggttggtctctgcacaggctgggaacccccagggaagcagcactgagggccctaggagagagggcagaggccagaggcagggtactgcctgctcagaaggtcagattccagagcaaacagcaagctgtctgccttttcagactctgaaaggatgggggtaggggcaggaagggagggtgaaagtttagagcccctgtgggtagggaaggggcctctagggtctgacaggcacccccaggacactgtgtctgcccaagtgtttgctgagaaagtggaggccagtgcagccaccggttgagtgcagccactgggtcagcgcagcggccgggtgagtgcagccctcggattttgtcccaataaccagagtcccattagcacagtctgagcagggggcctggcagagcacttcgccctcctctgtcatttagcggggaaacagttcacacagggacaactaccatcttgagtctcttctgtcaactgccctgtggtctctctggccacactgggacagagcatcactccagtaaaccctctgagctcatttccctagctgagcaggttcccgcctctgttcctagagcaccagcatgagtgagcctcaggaaccaccccagattttaggagttaggagtgggtctagctgtgctgatggccacctggggctctggtgaactctagcctcctcccatccgcccatcgagggcatcgtcaggcctctgtgctgagccatttgcctcctgctctgccccaaacctgttcagcccccaacattctcactttcctgtccccttcatgcttcttaggtcatttctctctgcttctgcaaacctccctgccaaatgttcccccaccccaaaccgacccttttcatctctatgtccccccgtgtacacctctctcaaaatgcagggccacggggccctccttcttagggactaggccatgcctaggggtagggctgctgtggcattagtgacaaaaactgctatgtctacccacgtaaatcacataaatatacaagcaggggccaggcgtggtggctcatgcctataatcccaacactttgggaggctgaggcgggtggataacttgaggccaggagttcaagaccagcctggccaacatagtgaaaccccgtctctactaaaaatacaaaaattagctgggggggtggtggtgcacgcctgtaatcccagctactcaggaggctgaggcaggagaatcgcttgaacccaggaggtagaggttacagtgagccgagatcttgccattgcactccagcctgggcaacagagtgagactctgtctc

SEQ ID NO: 934 - DNA, 2188 bp, Homo sapiens
agccagaggaagtgaggctcagacagagcagctgctgttccagcaacagcagcaactgccgcacccttgaaaggaggcccctgccgtgtggacccgtaaaataaaatgggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaatgcatctaattcacaacagtctatttcaatgcagcaattttctcaaacgtcaaatccttcagcacacttccacaagtgtagcagtcatcaagaaggaaattttaatggaccttccccaaatatgacttcttgttctgtcagtaattcacagcaattttcttcacattattccttttccagtaatcatatatcaccaaacagtctacttcagtcctctgcagttcttgcatctaatcatacaaatcagactttatctgattttactggaagtaattccttttcacctcatagaggaatcaagcaagaatctactcagcatatcctaaaccccaatacatcattgaattcaaataatttccaaatattgcattcatcacatcctcagggtaattatagcaattcaaaattatctcctgtgcacatgaacttcccagatcctgttgactcaggaactcaaatgggccatttcaatgatcatgtagaaactaatggcttttcatctttagaagagaatttacttcatcaagtggaatctcaaactgagccattcacaggacttgaccccgaggacctccttcaggagggtcttcttcctcactttgatgagtcaacattcggacaagataattcaagtcacattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacagcctccatcttccaagaagagcgatggttctgggacatatactaagttgcagaatacccaggtgagggtcatgtctgagaagaagcagagaaaaaaggtggaatcagaaagcaagcaagaaaaggctaatcgtataatatcagaggccatagcaaaagcaaaggagcgtgggggacgcaatattccacgagtaatgagccctgaaaactttcctactgcttcagttgaaggaaaagaggaaaagaaaggtagaaggatgaaatccaagccaaaggacaaagacagcaaaaaaacaaaaacatgttctaagttaaaagagaagacaaaaattggcaaactcattattacattgggtaagaaacaaaaaagaaagaatgagtcttcagatgaaatatctgatgcagaacagatgccacagcatacattaaaagatcaagactctcaaaaaagaagatcaaatcgac

SEQ ID NO: 935 - DNA, 2300 bp, Homo sapiens
tggggcggcgtctggagcggggaggctcacccctgtgcccacgtcctcaggccacctgccagtccctgcccaccccggccgcggaggggctgtggagactcagggagttctgggatggcacagagggcccaggctggtagcaaccaaagccgtgggaaatgtgggagggatggcaggtgtcccccgaggagtagcccaggtgccccggaggctgctgagagggttgagagtgcagagacgaggggcccagggaagtcttggattctctcgccatcttcaatgtcggagcccagacggggcaaggcgaggaggagcccggggcgaagacgccacccacattcctccttcccgcaggcttcttctccttctagcccttccaggagagaaaccatcccacaagtccagagtagtggcgtccccggggccatgtctcctgagcaaacactgttttctaggagtccgaggggcctcagccatctaggtcaatccctttgcagaacggtgaaggaatctgaagcccagagagggaaaacaatgcctcctgggtcacacagcccatcaggggcagggcagggacgaacggcgagaaaaggaccagcgcgagaggagatccccagcagtgattcctcagccaagcccagcgtctacccacatccacacctcacagccacctgatggggaaggcaccattgccccttttcaaaggtgagaaaacagaggctcagagaggttcagcaacttctcccacagctacttcgttgtagaactgcagttccaggtgtccccgagctctcccttcccgagccatctgctcctgccctcctatccgagccctggccctcccagtcaaagccgggtagtggctgttcagaagccttggggctagtcaatcccagctgtctcggaccagggccccccccaggaggagaccctgaaggatgcagttgagaatatgtgctttctttggtaggtgatctcaggaattgcaggggaaagagggggagcgtgttagtgtaggctctccggagaagcagaaccaacgcacagaggagatttaggatgaggaatctggtttatgtgactctgggggctgagaaggcccaccatctgtgttgcaagctggaaacccagggaagcctgaggtgtgattcaaactcagctcaggtctggaggcctgagaaccagggcagccgatggtggacatccagtccaggggcaagagatgacgagatgtcccggctccagtggcgaggcaggaaatgaggggtgaactcctcctccctctgctgtctgttctattcaagttcttgagggattggattatgcccagccacttggggagggcagtccaccttcctgagtccacaattcaaatgctgatctaatccagaaacactctcacagacacagtgtgtagtctgggcaccccacagtgcacttaagtggacacataaaattaaccatcccagggagtgagatgggtaagggaagatgggccacagtgggtgtgtctccatgcctacccccactgtgggcagctgctggagcacacgcctcaaagtcttccctgagggagagggagctgaggtgtttatatcccagctctgtcaggcattggctgaatgtccacactcctggatcaccgcctctcatcctcatgatgtcccatggtcctcatttcacaagtgagctctgggtacatggggagcatcagtcacaccctgggtcagtacctcagctgtctctcacatgacatcctcattatccacactgcaaagccaaccatccctatgatgggttcattgtggatcatgacttagtgggtcaagagtttggaagtggctcagctgggcggttcttctgctccatgtggctgccagatggtaccctgctggtgggcagtctggtctagagggtccatgatggctttactcacatgcctggcatcttgacagggacagctggaaggcaaggttcagctgggactgtccacagagctcctccctgtggcctttccagcatggtggtctcagggtagctggacttcctgcatgacagctcagggctcccagagctactgtcccaagagatagaaggtggaaactgccagtctcttaggctaggaccagaaaccagcacccctgcacccacagccttttggtagtgatgaaataaacataagatttatcattttaatcattcgtaagtgggattaaatacatttacaatattgtgtaaccatcggcactgtctatatctaaaactttttcatcatctgcaataaaaactctgtatgcatt

SEQ ID NO: 936 - DNA, 1619 bp, Homo sapiens
ttacggtaagtgaggaggggctggggtgcccagcgttttggatctcccactctggcccggccccggaataccacatagaggccttgggacctgattcatcccgtccagacagccctagagacctgagcgactgaggcctgggatctggacgccggaatttcctgcgtggttctggacgccctgccctgggataaggggccatgcggggctctggtctcagattccaaatgataatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctggcccaagccaagaaggaatgctgggatcggttcctccaggagaagttagcttcagagttctttgtggatggacttgattctgatgagagcaccttggaacatttcaagaggtggctccagccagataaagtagccgtcagcacagaggaggtccagtatctgattcctccagagtcacaggttgagaagccagtggccgaggacgagccagcagccggggacaagccagcagcagcagaacagtaaattacacacacacacacacacacacacacgccgagcagctgtctcgggtccagagcgagcagcgtggagctcagtgacagcagcagggagaaatccactgaaggaaaaaacccaaatttccactccacaaagaaaacagctgcaagcccccagggacttacctggggctggcatgtgtgaccgtctcggatgaagtgactgacccagtgcacactggatcaaaatgctgctttcctctgtgtctcacagcttggctgagctctgtctctgcaggttagaagtctgctaaagatcaaatgtgaaagtacttggagaaactgaggcctcttatgtgtaatgtgtaagttaagtgagccatatattttcttgcctcttccggacattcatgcttgtgtcccaagcattcccttggtgaattgtcacgtgagtggggccagtaagagtgaagtctgctccttgaatccaagccccatctggggcttctctaacaaatctgtagtaagtatacggactccagggagagaggctgggcttctctctctcatttgttccttgtggaacaaatgggcaaaagaagtgtgaaaatgtgggtgtttatgtctgtgtatatgtattttttacttcatgcatggcttctcctccaacttcctcctgcacttaaaaagggccaggttccaaattagacttgtaaatatggtgttagtgtttgacactactcctggatagttccaaacatcttccttgtggcaggtttcctggctgagcccgagcttccctccctgtttattgtgttcatgatcagtatgtgtttccatataaaacttttctcaacgg

SEQ ID NO: 937 - DNA, 1917 bp, Homo sapiens
aaatttccctctacacactgctttaattttgaaatggagtttcgctcagtttcccaggctagagtgcggtggcatgatctcagctcactgcaacctctgccttctgggttcaagtgattcttgtgcctcagcctcccaagaaactgggactacaggcatgtgccaccacacccggctaatttttgtatttttagtagaaacagggtttcaccatgttggccaggctggtctcgaactcctgacctcaagtgatcctcctgcctcggcctcccaaagtgctgggattacaggcgtgagccaccatgcccagccccatgtcctttttaatgcctggattgactttgtgggacatgaggccaaggtaccttttaagatgtcacctgtatagcatactagtagtgaatgtaggctttgaagtcagatgcatctggctgtgagctgtgactagtcatatactagttgtgtcattttgaacaggttacctaacctctggctcctcagtttgttcatctgtttaaaaattgtgggaataacagttcctgctgggtcattgcaagatgtcagtgagacgtgtcaagtgcttagaatagggcttggcataagtagagtctcagtagggtaggtgttatttaatcccagaaataactgacaactttggaagatgagagtgaatgtctccgatcattaatttatttaacaaatacttatctagtactatgtgcccggcgctgtagacactgccatgttttatctcattcaatattcacagtgactgcccagtgaatggtattgcctccatcctctgagaaggtaaagagcctatcccagaccccacgagtggaggcgtcagggaggggttcttggcaggagatgggtcttgtagaaaggcttctgctttgctttcactcacggcctgtggccagtttgctcagacagctcccatcaggacaccattggcagcttttgcacgaccctgcctcccagggtcttcctgcgttttcccttaagttgccttattctttggttgtttccctacttgtttttgttagactgtgggaggaagaaatccatttcaaatctgctgaaacctgttaccaagcaacagcagtgattaaaagcaacctgatgagtgagtaaagaattagggtttcagacctgtagttaatgatggtctctgtctccctgctgccctgcattcccttcccttccgttcactgctgggtgaaggagggcttgctgcattttggaagttaagggaaccaataaggtgactcttttgcagattggaatatggtgctcagccagccatatggaagcactgtcctggcgtgatctgccctgggctgttggctctctgagtgctgtcttgggaggagcactgcccttcagaacagaagagatggcttccagtcccctctcccccttctcccagtctctctgaggctgcttgttgggtattgggcgtgctgtgtactaactcactcccgtctcttgtctcattatctgaaatgcatccccttttgcagaaagggctcaaacggagccttcagttctgctcctctgcatagccgtagctcagatcctagctcaggatgtcttgtctgggaagggcaaaacatggtccccagtgtagcattttcactgggttgattatctcagtggtggatcatctatcacccttgtgtggtgactttgtgaattatctgcctgagtgccacttcccttccaccctaatcactgcaggctcagggagcaagaaataaaatcatgaaatgcattccaaataaaattaccttttggctgggtgcagtggctcacacctgtaatctgagcactttgggaggctgaggtgggtggatcgcttgaggtcaggagttcaagaccagcctggccaacatggcaaaaccccatctctac

SEQ ID NO: 938 - DNA, 1953 bp, Homo sapiens
agcacggccgggtccccgcccccgcctgccggagggagccagcgggatcccccacgttacctcgaaggtcgagcccctggacggcggagggactttggaaaagctcggaattgaccgaggggagccagagaagaggttggaaaccttttctcccaccacgggcggtttaagatggaggaaaacgctcttttattgaaataaaagaagtctaagctgacctgcggttgcttctttaggagagtcgacgtgtctgcgtccagcgcgcccgggctgagctgcagactcgcgcctgccaccgccaccctctgccaccttgccctgttttgtctttatggcgcttccccctctgaaatactctttgcggggagttttgtggctctatcactcgcttcttccctggctccccagatgcctggagagcggggacctacttggtccccaacgtccagtccgcagcagggctccgtcactgtctccagagactgaacgaatgactttctagcagtaaggaagtccccgctggccccgtccccctgcacacgccgtggacctcgcccagggcccaggacgccccgagatggccttgggctgcagggaaccagttgtggatttcccgggggcagggttgggggcagtccctggaaccgggcctagcccgtctgggagcggtggggtagaagtgaaaggcttaagtgtgggtgcggggacttgcagccgcacagacaaggcagaccgggactgggaagctgcccggagcggctgctgcgactctccgctccgacctagccggggcagccctccctgccccgggagaagacggcgagcaggaggacccgcagagccccgcccggctgctccggccccgggggcactggcaccatcgggctgtggtcttttcccgatgcccgagccgtggacgcggccacctaagagcggtccggcgaaggcagcgcagccggtgtcccagagaccggtccccaacgccactcggtgcatttccccaggcgctggcaggggcactgattcctagcaatgaggcctcccttccccttcccaggccgcccctcctctgactccctccagagcagggccgagttttcctggggagcctgggtcccggcggccgggcggccgctgggaggtggaggagcctctccagccccggccgcagctcatcgtgagccaaccgcgccacctgccggccagatgcgggagtgtgcggccccggaggaagggcgagcggacaaagaccgcaacccgcaatccgcaaccccgcagagaggtggtgcgtgcgtttgggcgagcttttcagccaccgccaagtctcgtgcactagggctactcctaccgtggggctgcggacagcgctcaagaggtcctggagtctgtcgtgactctcgcctgctggatttcaaaagatggaatcggaaagcgtttcaaggagaaactcctaacaaaccttccgggggttgcctgagtggctgctctcggaaaagcggatcctaaataaagcgggagggttatagggcgacgtcgaggagaggacaggtctcgagtcactgctacagtttcaggtcactgggctccgcagcagatcgtgttttctcccgtggctcgagagctgcgctggtttctcatgcaaactcagagccgagctaatgacatgagcaacttttacttttacacaagatgagcacgcgtgccgaggcgctgggcggcggctgtgtgagttggtggcccagacgagcagcttgtgcgagactctgggcatttcggtttctagatacaagatttgcttaaatgtcacagtccaaagaagtggatttcagtcattgtagctactgattgcacacaagtaaaaagggaaaaaatatgtactcgggggatatatgtatgtgtgtgtgcgtgcataaattatttaaaataactgcactaaatccctttaagaaatgc

SEQ ID NO: 939 - DNA, 2017 bp, Homo sapiens
ttgggccgggcgcggtggctcgtgcctgtgatcccagcactttgggaggccgaggcgggtggatcacctgaggtcaggaggtccagaccatcctggccaacatggcaaaaccccgtctttactgaacatgcagaaattagccgggtgtcgtggtgcgcacctatggtcccagctacttgggaggctgaggcgggagggtcgcttgagcccagggggcggagcttgcagtgagccgagatcgcgccactgccctccagcctgggcgacagagcgagactccgtctcaaaaataaataaatgatttaaaaaaatctaaaatcgagaaatcacacattcagtggggagcgacttcttgcttatgggaagtcctcaagtgagtgatgttcaccatgtatttttttttctcttaggacagactaattctgaaaataccgaaggaaaagtagctctatgttctcaccccggttttcctgcgtgtgtgcccttgggtgcgatgcctcccccagcgctctgtggtcgccggtgccagggccccctctggtttggcagggcctggctgcctttgctccctgcagtgagtcttttggtgttttcatgcacggcttgtgcttctggatctgaggcctctcgtgttcacgcggacacttccttccttaagaagacgcctaaaagaggaagttggaatttttttttttttttttgggacggagtctcgctctgtcgcccaggctggagtgcagtggcgtgatctctgctcactgcaggctccgccatctgggttcaggcgattctcctgcctcattctccccagtagctgggattgcaggtgcccgccaccacaccagcctaatttttgtatttttagaggggtggagttccaccatgttggccaggctggtcttgaactcttgacctcaggtgatcctgagcctcagcctcccaaagtgctggaattgtaggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcgcgatgtcactacttgtttttctgacgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacaatgttgtacgtgaagattctaggaggggagggaccagcaaatctgagagaaccgtcctggggcctcccttcgaggagccctctgatgtgaggagggacttgagttgagtgacactgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaag

SEQ ID NO: 940 - DNA, 2045 bp, Homo sapiens
agccagaggatccttccacctcacctctgctgtctcccttttgctcaaccacaagtcccaaaataaaaatcttgtctgggaaatctgcttggccctgtgttaacttctgttacatgggagccaaagagcctgtggtctgtaacaggttctctggcaaccatgacgggattataggacgtggtgagcatttttctccaaggaggaggcttgtgagccagcaggatggcggggtgtgcctgcctccttcatgggtgacaggtggtcacctgaatctttgattcagcattgccacaactgcatggcttggcccccacagctatggcacagggagcagggtcatcaaaatccactctgctcttccagaagctgcagagagagggaaccctaaaacctgacatgccagaaaagatggagttttgctcttgttgcccaagctggagtgcaatagcgcaatctcggctcactgcaacctctgtctcccaggttcaagtgattctcgtgcctcagccttccaagtagctggggttgcaggcatgcaccaccacaccccactaatttttgtatttttagtagagatggggtttcaccatgttggccaggctggtctcaaactcctgacttcaggtgatccgtctgcctcagccttccaaagtgctgggattacaggcgtgtgccaccacgcccggcctgattaccagattttcttgttgattgtgtcattagtcatggctatcctaagacttttgccatccacagacaattgttatcttgttttgattcttttcaaaaggcagtttataatcagctatagaactctgacaggtgttcttgaaagcaagtctctgataactttggagattggactattagaatagaggaaaaaacttctaagaccttcctggagatgttacatgttaataaatattgagtggaacaagagttaattgcatggactaaactaatagaaaatcgaaataatctttttataaatttcctgaaattctgctgatcctttttgttttggttttcagagtcaagaaaacttttttcctgttgaactagttatatcttttaacaattaactactatatattcctataagcaaatttggagcatgtttctttctacctgatttctttagaatttggaaactatttgtgactattcttaacttatggcaatatagttatttgcataagttcaataagaatctgttttcttttgtaacagaacacaagtggggacactggctattttaccagacttttgactgaaatggcatgcttccaactgctttaaaaatttgaggttgacttataaagccgataaaaagccccttggagaaactggcctcataccttgtctatgcagtccctgtatagagtaaaaaatgtcactttctaacaggttctggaactccaagttgtattgggaccttaagaggggaggaattcacacaattcatacaagtatttatagggacagataaatcagtggctaggttcaaggctttaaaaagtctaagctaaggttccttacagaacaaagttcccgcaaaataaaaaatatatatatatgagagtctatacgacaaataattattcttgctgcactttatgcaaataatcaggccaagtataataagactaaaacttaattgcaaacaaatcagtactaccatgatttgtctttgataaaagtgaaactggagacaaaaagaccataacatacctgttgttagattctagtcttgtccattgttattgagttttaaaatattattttctatgcaacaaatatccaagctaacattttcaagtttttcttccatttttctgagttaaacacaataaaattgctagtatctcttttctaaggccctgcagactaaagtttatttcttataacacaggcaagaaaaatgtgtcagattgccagcatcttcctcctctgtaactaaagatgctttgagtgtaacgtctgggtagattatgcccacgattaatgtttgtttttcttctggttccatataaatgcctcttatt

SEQ ID NO: 941 - DNA, 2345 bp, Homo sapiens
ctggtgggaggtaattgaatcactggggcagttacctccatgctgttctcgtgatagcgagtgagttctcatgagatctgatggttttctaaggggattttcccccacttcacactgcacgtctcttgctgcctccatgtgaagaaggatgtgtttgcttcttcttctgccatgattttaagtttcctgaggcctccccagccatgctgaactcttaaagggagctgatgctggcaatgggatcagagtgtttgtacctgacatcgggatgttcattgctagtctgaccatctggctcctctgtagaaacattgttcagaaacctgtgacagacgaagcagcacagagtaacccggagtttgaaaatgaagaattggctgaaggagaaaaaattgattcagaagaggcactgatctatgaagaggatttcaatggaggagatggtgttgaaggcgagttggaagaaagcacgaagttaaaaatgttccgcaggcttgcctctgtggcctctaagctcaaggagttcattggcaacatgatcaccactgctgggaaagtcgttgttaccatcttactgggctcctcgggcatgatgttgccgtctttgacatcatctgtgtatttttttgtatttttgggtctgtgcacctggtggtcctggtgccggacgttcgacccattgctgttcagctgtctctgtgttctgctggctattttcactgctggacatttgattggactttatttataccagttccaattctttcaagaggcagttccacccaatgactactatgcaaggttgtttggtatcaagtcagtaattcaaacggactgttcaagtacttggaagatcatagtgaacccggacctgtcgtggtaccaccacgccaaccctatcctcctgctggtgatgtactacactctggccactctgatccgcatctggctgcaagagccccttgtgcaggatgaggggaccaaagaagaggacaaagccctggcttgtagccccatccaaataacagcggggaggaggcggagcctgtggtacgcaacccattaccccactgatgagagaaaacttttatccatgacccaggatgactacaaaccatctgatggcctgctggtgactgtgaacggcaaccccgtggattaccacaccatccacccaagcctgcccatggagaacggccctggcaaagccgacctctactccacccctcagtaccggtgggagccctttgatgaatcctcagaaaagcgagaggaggaagaggaagagaaagaagaatttgaagaagaaaggagccgtgaggaaaaaagaagtatcaaagttcatgccatggtctccgtattccaatttattatgaaacaaagttacatctgtgccctcatagctatgatgaggcctggagcatcacctatcacagctggctgaccttcgtgctgctgatctggtcgtgcactctttggatgattcgcaacagaagaaaatatgccatgatcagctctcccttcatggtggtttatggaaacctattgttgatattacagtatatatggagttttgaacttcctgaaattaaaaaagttccaggatttttagaaaagaaagagccaggagaacttgcttccaaagtaagtgaatagaatacaataaaacaaaacaatgacacaaaaccacaatcatcatcataatcgtatccaagagaaaccttataaaaacaggttccaaatattcactgctttgtaaaaatgaacaaacatgagactgtaagaaacagtttgcggtgcttagaggcctctataatttaaacatgaacatatattacaccatgatttagcttttacttaggaatgacaatgttttccactcaaagaaaacttgtataaatgtttttaagtataaatcctactagataaaaattaggtgtgaaaataggaaaatacagtgcaaaatgtgttaagggattataggactgtctttgattatcattttataaaacatgcttagtgcattagtgtcacagataagtattgattattcatgacgtttttctccaattctttcctaaagaacatttttagcagcaaaaatgaagtatgacacttgctgtttttcttctactgattatatgatatgttcttatctgagttagaatgttcatactcttctcattacttatttgctttcatgggccattttaacagttttatttcaaaagattaggtttcccaacttactgtttgttttgttaacagaatggcagactaaacacacattccctttgtgttaataatttagttttaagacagtaaaaataagcgtgtttatattg

SEQ ID NO: 942 - DNA, 2594 bp, Homo sapiens
atgtctttgatgtaagtcatgatagtacatctttaatgacagttttcatgatgatgcttttggctcaacccatagactaatccagcgatgaaagttacagctatcatgtttatgtcttctgcttttaatgagactcatgtgtccagaaatgctatctctgaaatattcactgggtcttaagaaacatttggaaatatttcattgaggaacagcagtcttgctgtcctcttttatttacctcgtctgatgttactattagagtatctcacctttcaataattatggtcagatgtgtcatgtttttcatttcctctgagttcagtagccatgttttaccatggattggtctatacattttatagtcttggaaactggaaaaccatctcagttagctttttgtgacattcaagaaaagtatttattctaatctattctcaaactacaaataggcttttccctctcccctcacccaatcgtggatgaagcaagctcacttggatggaattgcttgctctcttccttctcattcaagaaaccttctgaaaattcatttcttcattgtggtggaacaactccaatttcctggatattattggagacggggtttcactgtgttggccaggatggtcttgatttcctgacctcatggtccacctgcctcggcctcccagggtgctgggattgcaggcgtgagccaccgctcctggcctgacagagaaattcaaccccaggcctggcacagtggctcacgcctgtggtcacagcactttgggaggccggggcaggtggatcatgatgtcaagagatcgaaacaatcctggccaacatggtgaaaccacgttcctgctaaaaatacaaaaattagctgggcttggtggtgtgagcctgtagtcccagctactcgagaggctgaggctggagaatcgcttgaacccgggaggcagaggttgcagtgagctgagatcgcaccattgcactccagcctggcgaccgagcgggactccgtctcaaaaaaaaaaaaaaaaaaaaacaaaaaaagaaagaaatgtaactccagcctctgatgaaaaacggatcggaaccaagatggccaaataggaacagctccggtctacagctctcagcatgagggacgcagaagacaggtgatttctgcatttccatctgaggcataggctatggctgtggcttccctcatgtctgcgttggctgcccaactgctctgtcccccgcagagctgccgcccgcgctctcgcaccttccacagcacggcattttggaatcaccagtgagacaattgtgaaaccagcttcaatttctgaggaagaattgttgaagttaataaataaactgagtaatgttgataattagataattagatggccaccttgttcagctgcctcttccagagcacactgatgagagaaagatctgcaatgctttttctccagacaaggatgttgatggctttcctgtaatgaatgtaggacgaaagtgtttggaccaatattccatgttaccggctaccccatggggtgtgtgggaaataattaagcgaactgacattccaaccctagggaagaatgtggttgtgactggaaggtcaaaaattgttggaatgcccattgtaatgtcactgcacatacgtggggtgcatgaacgtcccagagatgatgccaccgttagaatatctcatggatatactcccaaagagcagttgaagaaacaaaatatttgcagatattgtaacatccgctgcacgaattctaaacctgttcacaatagatataatcaaggaaagaacagcagttgttgatgtgggaataactagagttcaagatcccgtaactgctcaacccaaattggttggagacgtgggttttgaaggagtcagataaaaagccggttacatcatgccacttcctggaggtgttggcctcatgacggtggcgatgctaatgaagaataccattactgttgcaaaaaagttctgaggcttgaagaacagtaagtgctgacgtctaaagagcttggagtagccactaatgaactattgtgtcttctatgtcacaaacagcactccaagccagctcaagaagcaaagcaggccaatagaaagacaatattttttatttattctactgaagtggtttaaaatgatgctttgtatttattgaaagcttaaattggagggtgtttgtgcacaatagctctgcagtacctcaccagggagcattccactatgcaggggcgtgtatctagctaacagcagccattaactcagtgatgaacctgggagacatttgtcatattgagatggatatttaactctgtcaaaccacctcggttgaatatttgccttcattaggactgcgtttcccaaatgctatttcaataagagttgatactcattttaggcaccaaaacttttgggttcaactgatcaaaccaaaggaaaagtgttgctagacaaaattagggaaaaggtgaaagaggaaaatatggtagtaatcgagtagaaaaaaattcctctaatttatatatgcattgattagtaaccagatttatctaagtaggactgaattggctaggat

SEQ ID NO: 943 - DNA, 3133 bp, Homo sapiens
attttgttgcctctgtttctccacgagggggggttaaaggcccccaaaacatgcacacatgaaaagggcaaaaagtaaccgtccttgacagggagtcttaactagagaaggaaacgggactaaactggcgggctccgtggaagcgtggccggcagcgtcccggacgaggagatgtctttggtggacttgggaaagaggttgctagaatcagcaagaaaaggccaagatgatgaagtgagaacgttgatggcaaatggcgccccattcaccacagactggcttggaacatcacccctccaccttgcagctcaatatggtcattattccacagcagaagtactccttcgagcaggtgttagcagggatgcccggactaaagtagacaggacccccttgcacatggctgcagccgatggacatgcgcacatcgtggaactgcttgttcggaatggtgcagatgtgaatgccaaggacatgctgaagatgacagctttgcattgggccacagagcgccaccatcgagatgtcgtagagttacttatcaaatatggagctgatgtccatgctttcagcaaatttgataaatcagcctttgacatatctctggagaaaaacaatgctgagattttggtcatcctccaggaagcaatgcagaatcaggtgaatgttaatccagagagagccaaccctgtgactgaccctgtgagtatggctgctccattcatcttcacgtcgggtgaggttgttaacctcgcaagccttatttcttcaaccaacaccaaaacaacctcaggtgacccccatgcctcaacagtacagttttcaaattctaccacctcagtgctggctacccttgcagctcttgctgaggcatcagtccccctctccaactcacacagagccacagccaatacagaggaaattatagaaggaaattccgttgactcatcaatccagcaagtaatggggagtggaggccagagggtcatcaccatagtgactgatggagtccctctgggtaatatccaaacttcaatccctactggaggcattggccagccatttattgtaactgtgcaagatggacagcaagttctaactgtacctgctggtaaggttgcagaggagactgtaattaaagaggaagaagaagagaagttgccactaacaaagaaaccaaggataggagagaagacaaacagtgtggaggaaagcaaggaaggcaatgaaagagagctactacagcaacaactccaggaggccaatcgaagagcccaggaataccgacaccagctcctaaagaaagagcaggaagcagaacagtaccgtcttaagctggaggccatagcccgacagcagcccaatggagttgatttcaccatggttgaagaggtggctgaggtagatgctgtagtagtcacagagggggagttggaagagagagagacaaaagtgactgggtcagcagggaccacagagcctcacactagagtttccatggcaactgtttcatcttaatatgcaagggccacaatttgcactgtgttcatattaatcctcttttaaaaaaggaaatatacagaagacaaacattgtataaaaactaagagtgtctttaagaagaaaactatagcagggtacaatgcttgggctcaggaagtttctctgtgcaactagaaaattcaaagccatatttagggaacattttttctgaggggccaaaagaataaaggaccaaatttcttagctcatatcattgctttaaacatagaagtaaaagaatactgcatgttgtgggttgattttttttttttaaataactgactttctcacaaaagattttaagataacatttctaatatatatgcaccaatatatatgcctttaataattataccatcaagtgacctgaaaatgccccttagatttatgatgcgtatctgttggaaaaaccaattggaagggaggttagacaagctttggggaagagaaaaggaatatagtccatttccaaaggagcaggaactcccaaccttaagttaatttcactgaagagaattttcccttttttttttcttttttgagacacggtctgactctgtcacccaggctggagtgcagtggtgcaatcttggctcactgcaacctccgcctccagggcacagcctcctgagtagctgggaggacaggcatatgccaccacatcactgagaagaaatttttgattgtctgacagatacttatccattatgtgtctatagttcagatgcttgtgtaagaaactgaaataagctgcgtgtggtggctcacacctgtaatcccaacactttgggacgttgaaatgggagaattgcttgagtccgggagtttgagatgcgcctgggcaacatagaaacctgtgtctacaaaaaatttaaaaattagccaagtatggtgacaggcacctatggttccagctactcaggaggctgaggtgggaggatcgcttgtgccttggaggtcaaaactgcagtgagccatggttgcaccactgctctccaggcttgagtgacagagcaagactgtatctcaaaggaaaaaggaaactaggccaggcgtggtggctcacgcctgtaatcccaacactttgggaggccgaggcgggcggatcacgaggtcagatcaagaacatcctggctaacacggtgaaactccatctctactaaaaatacaaaaaattggccgggcgcagcggctcacgcctgtgatcccagcactttcggaggcagaggcaggcggatcacaaggtcaagagattaagatcatcctggccaacatggtgacaccccgtctctactaaaaatacaaaaattacccaggcgtagtggcacatgcctgtaatcccagcactttgagaggctgaggtgggtggatcacttgaggtgaggagttcgagaccagcctggccgacatggcaaaaccctgtctctaccaaaatacaaaaattagttgggcatgatggcatgcgcctgtagtcccagctgctctgggggctgaaacaggagaattgcttgaacccaaaaggtggagtttgcagtgagctgagattgtgccactgcactccagcctgggcaatagagcgagactctgtctc

SEQ ID NO: 944 - DNA, 3639 bp, Homo sapiens
ctagtttgttggcggcgcctaggctgtatcgcagcgagagcgtttttgcctgtggagagccggccgacgggagccgcggcggagcctgctgagctcgcgcgggctgccgggagtggtctctgaggcggcggcggcggcagggatcgtctccggcactggcgcaccatgtcggtcagtgtccatgagacccgcaagtcgcggagcagcacggggtccatgaacgtcaccctcttccacaaggcctcccacccggactgtgtgctggcccacctcaacacgcttcgcaagcactgcatgttcaccgacgtcacactctgggcgggcgaccgtgccttcccctgtcaccgtgccgtgctggccgcctctagccgctattttgaggccatgttcagccatggccttcgggagagccgggatgacactgtcaacttccaggacaacctgcacccggaggtgctggagctgctgctggactttgcctactcctcacgcatcgccatcaacgaggagaacgctgagtcactgctggaggcaggcgacatgctgcagttccacgatgtgcgggatgctgccgccgagttcctggagaagaaccttttcccctccaactgcctgggcatgatgctgctctcggacgcccaccagtgccgccggctgtatgagttctcctggcgcatgtgcctggtgcactttgagacggtgaggcagagcgaggacttcaacagcctgtccaaggacacactgctggacctcatctcgagtgatgagctggagaccgaggacgagcgggtggtcttcgaggccatcctccagtgggtgaagcacgacctggagccacggaaggtccacttgcccgagctcctccgcagcgtgcgtctggccttgctgccgtccgactgcctgcaggaggccatctccagcgaggccctcctcatggcagacgagcgcaccaagcttatcatggatgaggccctgcgctgcaagaccaggatcctgcagaatgatggcgtggtcaccagcccctgtgcccggccacgcaaggcgggccacacgctactcatcctggggggccagaccttcatgtgtgacaagatctaccaggtggaccacaaggccaaggagatcatccccaaggccgacctgcccagcccccggaaggagttcagcgcctcagcgatcggctgcaaggtctatgtgacggggggcaggggctccgagaacggggtctccaaggatgtctgggtgtacgacaccgtacatgaggaatggtccaaggcggcgcccatgctgattgcccgctttggccatggctcagctgagctggagaactgcctctatgtggtggggggacacacatccctggcaggggtcttcccggcctcgccttctgtctccctgaaacaagtggagaaatacgaccctggggccaacaagtggatgatggtggcccccttgcgggatggcgtcagcaatgccgcagtggtgagtgccaagctgaagctctttgttttcggaggaaccagcatccaccgggacatggtgtccaaggtccagtgctatgacccctcggagaacaggtggacgatcaaggccgagtgcccccagccttggcgttacacagccgctgccgtcctgggcagccagatcttcatcatgggaggtgacacggaattcacagccgcctcggcctaccgctttgactgtgagaccaaccagtggacgcggattggggacatgactgccaagcgcatgtcctgccatgccctggcttccggcaacaagctctatgtggtcgggggctactttgggacccagaggtgtaagactctggactgctatgaccccacttcagatacatggaactgcatcaccacagtgccctactcacttatccccacggcctttgtcagcacctggaagcacctgcccgcgtgaggagcacctgctgagcccagccagaccgcggccttcagtgtcacagcgtggccttgcttgtctgccacagcgggagctaagccggccctgggccagcactccgagaggtggaaggggccctgccagctctggggagcagcagccttgggctgttctgagctttaggcaagagaagagaagcatctcttgcatccgtgcccctgggggcctcttcagctttgcagtggtttgtgggaagacatacctcccagaggggcatggactgccaccaggactgaccctggcgtcggggagaaggacacttgcagagccttgagatcacctgtttggcaggtcctggactggggccgggcaggcaggggcagggaggcgccccgggtgggctttggggctgcggcactgccacacatcctttccctcctggcctgccctgctggggctctactgccatctatagatggtgtcctgggcctgggaaactaggttcccaggggttgagaccagaaaggtgaccaagacagattttttaaggtgcagaaactgcaggggggcctcagtgacatccatgaggccttattagcaaaggacacccagacctccaaggtttgtgggccccttccacaaagctgtaagtcccagcccacctactcagggccttgctcagtgctgtggcccggtggggacacagttgctcgtggccactcagtggagctgggcctgcagcagactcaaggctccgagtgccctgggggtcacccctcccctcccctcctcagagcccaccctgagaggcagcagtgacccccatggcacacacctgccaacagcactgggggcttctccccaggagaccacgctgccctccaagaccaggagcagctgtgagctggagacagcagagggaccccagggtgtcccctgcagatcccaccagggccgcatccatctcagtgtggaggacagtgacgggaccctcaccatcctcttgcgttttggcccccatttgctccctgagctccaagataagaatggccccgagagaactgctgaacatttgttcattgctgtcacctcctgagtcactggggtccctcaccagcacctccctgacacctgggctatggagaggttggcgcctgtcagtgaccatcctaatgcctctcgctcactcccaagccaccatttgagagggaggggtgttggtgccctgacagggactgggcagggtgtccaaacttggggcttcccaggcacctgcagtgtgaacactgcttggctggctcaagattagggccgcggagggggctgtgcacatatcagttacttaagcagccacgagtgtcccccatgccttggtgcgggtcctggaggcctcttgggggtgggacctttgggcagggtttgcccactgacacgcccgccatggggcactggctgcatggggctccttggaccctgtagacccagcagaccccgcctgtgtcaggccagctgcccgaaggcacttggctgtggtcccaggggacggctctgctggcacactcaggagcctggccgcggggactgcagggagggtgcctggacccgtggggttgcttcattgagataaagcacacttatcacgtagcacaaaggacgtgccatggtgctttccccaaaagttgtgttgcttttatcagttttctaacttaataaaaagagttg

SEQ ID NO: 945 - DNA, 2845 bp, Homo sapiens
attttctccccgagatggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggagccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccatccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgg

SEQ ID NO: 946 - DNA, 3115 bp, Homo sapiens
caccaaccaatccagtctcggccacctgtgaccacctccaatgccatccctcctgctgtggtagcaactgtctcagccaccagagctcagtctccagtcatcactacgacagcggcgcatgctactgattcagcacttagtaggccaaccttgtctatccagcatcctccatctgcagcaatcggtattcagcgtcctgcccagtcacgagatgtcacaacaagaatcacactaccatctcaccctgcattagggacgccaaaacagcagcttcatacaatggctcagaaaacaatcttcagtactggcacgccagtggctgcagccacagtagcacctattttggcaaccaacaccattccttcagcgaccacagctggatctgtgtcacacacgcaagctcccacaagtaccattgttaccatgacagtaccctcccattcctcccatgctactgctgtgaccacctcaaacatcccagtcgccaaggtggtgccccagcagatcacgcacacttctcctcggatccagccagactaccctgccgagaggagtagcctgattcccatctccggacatcgggcctctcccaatcctgtggccatggaaacccgaagtgacaacagaccgtctgttcccgttcagttccaatattttttgccaacttaccccccttctgcatacccactggcggcacatacctacaccccaatcaccagttccgtgtccactatccgacagtatccagtttcagctcaggctccaaactctgccgtcacagctcagactggtgttggggtagcgtctaccgtccacctaaaccccatgcagttgatgacagtggatgcatcgcatgctcgacatattcaagggacccagccagcacccatcagtacccagggtatccagccggcccccattgggaccccagggatacagcctgcaccacttggcacacagggaattcactcagcaaccccaatcaacacacaagggcttcagcctgcacctatgggtactcagcagcctcagcctgaaggaaagacttcagtggtgttggcagatggagccacaattgtggccaaccctattagcaatccatccagtgctgctccagcagcaacaaccgtggtgcagacccacagccagagtgctagcaccaacgctcccgcccagggctcatcgccacggccaagcatactccggaagaaacctgccacagatggtgccaaacccaagtctgaaatccacgtgtctatggccactccggtcactgtgtccatggagactgtatccaatcaaaataatgatcagcctaccattgccgtccctccaactgcccagcagcccccaccgaccattccaactatgattgcagcagccagtcccccgtcacaaccagccgttgccctttcaaccattcctggagcggtccccatcactccacccatcaccaccattgcagctgcaccacctccatcagtcactgtgggtggcagtctttcctccgtcttgggccctcccgttcctgaaattaaagtgaaagaagaagtagaaccaatggatatcatgaggccagtttctgcagttcctccactggctaccaacactgtgtctccatctcttgcattgctggcaaacaacttgtccatgcctacaagtgacctaccacctggtgcctccccaaggaaaaagcctcgaaagcaacagcatgtgatctcaacagaagaaggtgacatgatggagacaaacagcactgatgatgagaagtccactgccaagagtcttctggtgaaggctgagaagcgcaagtctcctcccaaggagtatattgatgaggaaggtgtgagatatgtcccagtgcgtccaagaccccccattactttgcttcgtcactatcggaacccctggaaagctgcttaccaccactttcagaggtacagtgacgtccgggtcaaagaggagaagaaagctatgctgcaggaaatagctaatcagaaaggagtatcctgtcgtgctcaaggctggaaagtccacctctgtgctgcccagttactacagctgacgaatctagaacatgatgtctatgaaagacttactaacctgcaggaagggattatcccaaagaaaaaagcagcaacagatgatgatctccaccgaataaacgaactgatacagggaaatatgcagaggtgtaaacttgtgatggatcaaatcagtgaagccagagactccatgcttaaggttttagatcataaagaccgtgtcctgaagctgcttaacaagaacgggactgtcaaaaaagtgtccaaattgaagcgaaaggaaaaagtctagacccagaacaatcaggagattggaagcaaatttatgaagaatgatggtgggggtggggggagggttttggttttttccaaagtggaacattgaaataaaggaagtgttccttagttcccgtgtgaaagcagaggaacccatgacatccaagggcgtgaaaggatcagagctgactggacatagtgagctgccttcttgcgttcgggtgcacccctgttaaacctgatctgtgtcataagtgactccggatgcatcagtgtccaccagttggaagcaatgacaaggatggctggctggtgtttttcagccttccggtttatagactgtatttatctagtggattcctgcaggccccatactgagcctggactgaaagtatccactcggaccatctgttatctctctacactgaaaataaaacctcttccacccaccccattcggttcttctgcctgaccttcaaatgcccatgttggccttttacagcagtgccacggcaccaagcgagctgccacatctcacactctaaagggtttgaactattagttcttgtcattttttaaaaaaaaccattcccaagtgaaattgttatatcgtctgtcttgcgtgtgtcagaactgggtttttgtggaggttcagagcaggcaacaccataagttgctctcagatccttgttctgaagtacattcttggttatctgtacttctgtagctggtgtgatgctgttaattgtatgtaccacacatctccagacgttaataaaggactcaaagaggtt

SEQ ID NO: 947 - DNA, 3760 bp, Homo sapiens
ctccgcttcctgcgcgcgcgagactcaagctgccacagtggctctgccgccagcgtcccagctcctcccacacccgagtttttatttcctgctccctctccagcccggcccaggccagcctaccggcgactaggatgctttcgctttcgctctcgctttccaatactcgggactggggaaaccgggagaatagaagcaggtgtccccagcgcagccaatcggcttccgaagtaggtgagttgctgcctgaagagaaaagacaaactccagtatctttcattccattggccagacgcgccattccccaagtgagttctgttctccaaccaaagtgctggattccaagggactggaagggaaagtccctaaaaatcacgagttcaggcgtctgagacttggtgggaacggaccttcctcttagtgcccaagcctgttctaatttttaaaaactgatgtctattaagacccaatgttaactttatgaaaatggttcctaaggagattcacatctctgtgtccgaattctgtgtgcagcaaacatcatctcaagtgcgttttcccaactacgcttctttccaggataaaatactctaagtgacaaatgttgggtacattatcaggtatgttcactattgtgagaactgaagccatctacactcacatagcttgccaactacattaacctgacttcttattccattattttcatcaacatacatttactatttcaagaaacttttgccagggaccggaaagttgcaaatatctttattgcttaatccagtatcttcttcaaagatccaaccactcttcaatggaaaacatcaaagaacagtttacattctaagactttgaacctttacctcaaaatcctagccttgttttatctaccaatcctaaacttttacccgtagctgactcaattctaaccaattcccctcattaaatattagacttacaatgggacttcaaaatctcaatacatatagcccaaacttgctcttccctctctgagacaccacttaaattctgtcaagttattgttctccattacctaagtgagcaagaaacttagctttgtcttatcaacaggttgctttgatattactgggagccaacatttgacattcttggaggctccagcaagacctaatcaacctcccaaccctcaactcagaatcagtgtgtgccctgaagtcccttcaaccttcttgaggctctccctgatctcaaaggtggagaaagtagatcttgcatcaggttgaactccagtttctttttgctcagtttttcaagcgctgagtttattttgtccctaggcataaagaaatctttctaggaacccctttggttatgggaccagattttaaaagctttttaggcttggtgaaaaatctgccttatcactagcaacactacgacttgtctctgttcttgttttttgttgtactcgtgtaaaagaaaagttcaagggaagagaacaggctcaagtctacttctcacgctggctctggggattaggaaattcagaaagttttgtttcagactggcagtgctgtctgatataaacacagcgtcaagtactgcacgctgtagctacctgaggtttaggccggaagaggcacggctgatttaaaagtgaaagaaagtaaccaattggttcgcagacaaccttttcccaaaaggcgggcgattcaaacccctagccccacctgctccgtttcccgcccagctggagctctggagcctttgcttcctcaaatacgagcgggaactgcgttgagcgctggattccaggccgagtgctggcgaggcgcgcagtgagtgagcacacagggcgctggggtgctccgcggggcgcggtcacgggcgcggccgcggcgggctcgagtcccggctgggaggagaaggagctgggtgtcaggaagccggggactgacagcgccacccatctggggagccgggaggacacaggttttattttggtagtgctgcaagtccccttgtgtgctggggggagcggggcggcgtggtaggattggaagaggcttagagttggcctcgacccctgcccttgcccctggaaaggtagaaagtgggggttggggtgcggagaagcaggaagagagggagagtgaaggaggggaggaaagggagagaggaagagggagagtgaaggaggggaggaaagggagagaggcagagagggggaaggagagagggaaggaaggagagattgagagacagagaaattcctaaggggagctgtcaggtgggctggacatgggccccaggctgcactgctttatccctttgctgtaggaagtcaagcaagttctttaggtaagtagaaccttgatgtcaagtataaaacaggggttggtataggatagctaagagcactttatattttgatataatctgatttatcctggatactgaaaacaatgtagggagacggaggatattggagtgttttcttaacctcttgcccctttccactgtgattgctcaagtacatgcaaaattaatgtttctttctgcccattttattttcctttttttgtctgtgtctattaatcattcctaaagcacccggatcctctctcaaacttcgtaagatgagacatcatgaacagacacagtgaatccctagattttcttaatagttgggcaacaagttcttgcatttagggatgttgcaacatagcccagttccgcaattgtacattttctatttttttttcctaggttctctgctgtttaaaaagtatccctgtgtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattccattcacctaagaaaaatccagaagaccagaccatgccccaaaataggacaatatatgttaccttgaaggtaaaccacaggagaaaccaagatatgaaacttaagctcacacatagtgagaatagtagcttatatatggctctcaacactctccaggctgtcagaaaagagatagaaactcaccaaggccaagaaatgcttgtgcgtggcacagaaggaatcaaagagtacataaaccttggaatgcccctcagttgtttccctgaaggtggccaggtggtcattacattttcccaaagtaaaagtaagcagaaggaagataaccacatatttggcaggcaggacaaagcatcgactgaatgtgtcaaattttacattcatgcaattggaattgggaagtgtaaaagaaggattgttaaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccattttgaaaagagaaagtgaaaaaatcattgaaaacttc

SEQ ID NO: 948 - DNA, 3320 bp, Homo sapiens
acagagtcatgtgctgctgctcccgtcgccgctgctgccgctgccgccgcccgtggtgccccggctcctccgccgcgcttcgaggtggcagccgcgggcggggccgcgggagcagggtccagggtgcagcgcgccttcgccgccccggcgcgtcccggtgcagccgccgcccgccgcgggtgatgccgccacctccggcctcagcataagccgtggcttggcggccgagctgcaccccaaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattagaaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactat

SEQ ID NO: 949 - DNA, 2621 bp, Homo sapiens
gtccttgcgcagccggtggttgatatccgctgtatccatccccgagagggacctggtacctctacccaggtttctatcgctctgtctcctgcgctgtgcccttctgtagtcacaggagctgtagagaggaccccaggacatctgaaagccaggaaatgatgtttcaggaccctgtggcctgtgaggatgttgctgtgaacttcacccaggaggagtgggctttgctggatatttcgcagaggaaactctacagggaagtgatgctggaaactttcaggaacctgacctctatagggaaaaagtggaaagaccagaacattgaatatgagtaccaaaaccccaggagaaacttcaggagtctcatagaagggaatgtcaatgaaattaaagaagacagtcattgtggagaaacttttacccaggttccagatgacaggctgaacttccaggagaagaaagcttctcctgaagcaaaatcatgtgataactttgtatgtggagaagttggcataggtaactcatcttttaatatgaacatcagaggtgacattgggcacaaggcatacgagtatcaggactatgcaccaaagccatataagtgtcaacaacctaagaaagccttcagatatcacccctcctttagaacacaagaaaggaatcacaccggagagaaaccctatgcttgtaaagaatgtggaaaaacctttatttcccattcaggcattcgaagacgcatggtaatgcacagtggggatggaccttataaatgtaagttttgtgggaaagctgtccattgtctcagattatatcttatccatgaaagaactcacactggagagaaaccgtatgaatgtaaacaatgtgttaaatcctttagttattctgctacccatcgaatacatgaaagaactcacactggagaaaagccttatgaatgtcagcaatgtgggaaagcattccatagttccagttcttttcaagcacataaaagaacccacactgggggaaagccatatgaatgtaaacaatgtggcaaatccttcagttggtgtcattcctttcaaatacatgaaagaactcacactggggagaagccctgtgaatgtagcaaatgtaataaagcattccgtagttacagatcctatcttagacataaaaggagtcacacgggagagaagccttatcaatgtaaggaatgtagaaaagcattcacgtatcccagttcccttcgtagacatgaaaggacccactctgcgaaaaaaccttatgaatgtaagcagtgtgggaaagcattatcttataagttttcaaacacacctaagaatgcgctctggagaaagaccttataaatgttagatatgtgggaaaggcctttattctgccaagtcatttcgaagacatgaaaaaactcacactggagagaaaccctataaatgcatgccatgtggtaaagccttcaatctttccagttcctttcagtatcatgaaaggactcacactggagagaaaccctatgagtgtaagcaatgtgggaaagccttcagatgtgccccacaccttcgaaggcatggtaggactcactggagagaaaccctatgagtgtaaggaatgtgggaaagccttcagatctgcctcacaccttcaaattcatgaaaggacacaaacacacataagaatacactctggagaaagaccttataaatgtaagacatgtgggaaaggcttttattctcccacgtcatttcaaagacatgaaaaaactcacactgcagagaaaccctatgaatgcaagcaatgtggtaaagccttcagtagttccagttccttttggtaccatgaaagtactcacactggagagaaaccctatgagtgtaagcaatgtgggaaagccttcagatctgcctcaatccttcaaatgcatgctgggactcaccctgaagagaagccctacgagtgtaagcaatgtgggaaagccttcagatctgccccacaccttcgaatccatggtagaactcacactggagagaaaccctatgagtgtaaggaatgtgggaaagccttcagatctgccaagaaccttcgaattcatgaaaggacacaaacacacgtaagaatgcactctgtagaaagaccttataaatgtaagatatgtgggaaaggcttttattctgccaagtcatttcaaatacctgaaaaatcttacactggagagaaaccctatgagtgtaagcaatgtgggaaagcctttatttctttcacttcttttcgataacatgaaaggactcacactggagagaaaccctatgagtgtaagcaatgtggaaaaaccttcagatctacctcacaccttcgaaaacatggtaggactcacactggatagaaaccaaagcaggtgaatcacctgaggtcaggagttcaagactggcctgatcaatatgatgaaacccctgtctctactaaaactacaaaaattggccaggcgtggtggcctgcttctgtaatcctagctagttgggaggctggcacaggagaatcgcttgaatctggggggcagaggttgcagtgagccaagattgtgccattgcactctagcctgggcaacaggagcaaaactccgtctc

SEQ ID NO: 950 - DNA, 4769 bp, Homo sapiens
cagaaaacgctaagggggcttcggaagcgctggagcttgagaggtttctgtatacatagccttcaggactgcttttggtggaaagagatagcaggtggtgctaattcactgtgttggtgggaactctggctacactgaaagattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcagtgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaaggtgtttttacatttttgttaaatcttggagcagtggccctttccctgaagatcgctctttcaagccccgcctttgcagcctcagttcttcattataccgtagatctgagacctctgtgcgttccacggactcaagagaggcattctgtttcctgaagaccaaaaggaagccaaaaatcttggaagaaggaccttttcacaaaattcacaagggtgtataccaagagctccctaactcggatcctgctgacccaaactcggatcctgctgacctaattttccaaaaagactatcttgaatatggtgaaatcctgccttttcctgagtctcagttagtagagtttaaacagttctctacaaaacacttccaagaatatgtaaaaaggacaattccagaatacgtccctgcatttgcaaacactggaggaggctatctttttattggagtggatgataagagtagggaagtcctgggatgtgcaaaagaaaatgttgaccctgactctttgagaaggaaaatagaacaagccatatacaaactaccttgtgttcatttttgccaaccccaacgcccgataaccttcacactcaaaattgtggatgtgttaaaaaggggagagctctatggctatgcttgcatgatcagagtaaatcccttctgctgtgcagtgttctcagaagctcccaattcatggatagtggaggacaagtacgtctgcagcctgacaaccgagaaatgggtaggcatgatgacagacacagatccagatcttctacagttgtctgaagattttgaatgtcagctgagtctatctagtgggcctccccttagcagaccagtgtactccaagaaaggcctggaacataaaaaggaactccagcaacttttattttcagtcccaccaggatatttgcgatatactccagagtcactctggagggacctgatctcagagcacagaggactagaggagttaataaataagcaaatgcaacctttctttcggggaattttgatcttctctagaagttgggctgtggacctgaacttgcaggagaagccaggagtcatctgtgatgctctgctgatagcacagaacagcacccccattctctacaccattctcagggagcaggatgcagagggccaggactactgcactcgcactgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccggaaaactttcctaagagaaaactttgaacacattcaacacgtcgtcattgacgaagctcagaatttccgtactgaagatggggactggtatgggaaggcaaaaagcatcactcggagagcaaagggtggcccaggaattctctggatctttctggattactttcagaccagccacttggattgcagtggcctccctcctctctcagaccaatatccaagagaagagctcaccagaatagttcgcaatgcagatccaatagccaagtacttacaaaaagaaatgcaagtaattagaagtaatccttcatttaacatccccactgggtgcctcgaggtatttcctgaagccgaatggtcccagggtgttcagggaaccttacgaattaagaaatacttgactgtggagcaaataatgacctgtgtggcagacacgtgcaggcgcttctttgataggggctattctccaaaggatgttgctgtgcttgtcagcaccgcaaaagaagtggagcactataagtatgagctcttgaaagcaatgaggaagaaaagggtggtgcagctcagtgatgcatgtgatatgttgggtgatcacattgtgttggacagtgttcggcgattctcaggcctggaaaggagcatagtgtttgggatccatccaaggacagctgacccagctatcttacccaatgttctgatctgtctggcttccagggcaaaacaacacctgtatatttttccgtggggtggccattaggaagaactccaaatcaaaatgctatgtaaatgtctatgggtgacagtctgctgatggtagaaacctttctttttagttcacaagtcagagatttggacggagctgacacaaagagtttggagctcccccatttctggctctcctttcaggggttccttccccaacccttttcagcagcggtggctgccccccattctgacccctgactcttccagccagaaagatggtggttttctaaaggaactttagctgtcctgcacaatgccgatctgtgtcttgcattttgggtaaaagccataaaaataagaaactcagcctgtggcctttctttcttccaaggctgggcttctttttttaagtgacttcatgcagtttgttgcttttaaaaatttgtccagaatcgttttctgcagaagcatggtctgttaggagcttactggccgtagcagaagcaattgtttcctgaattcttgacatttatctttgctgtattcatttagggcttgggagagtccgaagataattcagtcactgtcagattaataattttgtcaggacaaagaataccgttatgattatttaatcctttaaaattgtggtctccagagcttgttctcagaatggcccagaccaagccttaattgtgatagtgaatattaatggtcactttaaggagaaattataggccaagatgaaatgaacataaacctgtttgccctggctttcagtggaagatgatattagagaccaaaatctggttctgaaggtgtgtatcagccctaaggtgaaccagacttgggaaagattgtctttaaaaatcaatgagtttatgttttaacttctcagcttagttctatgcattgctctataacacacctagttaagttttatgttattcttgaactgtgattttttttctatttactttcatggtttggtgggccattgttatggactgaatgtttgtgtcccacccttcacccccaaattcccgtgttgaagccccaacctgcactgtggagctggggctgctaaggaagtaattaaggttacatgaagtcatggtggggctctgatctgctaaggttggtgtccttatagggagagaccccagagagcttgttccctccctccctgtgcatgcaaacaagagggcatgggagcacacagagagatggcagccacctacaagccaagaggagaagcctcacaatcaaactctcgctgctggcgagagtcttggactctgtcttggacttccagcctccagactgtgagaaacaaatttctgttgtttcagcttctcagtctctggtgttttgttattgcagcctgagaacacagctgtacgattatttgtcaaacagaaaacactgacacttaacaatgctaatgcaattatttatttgcttttcagtctctacaaaacgttctaaaacactaatctaaatattaacagtaaaatatttgcataactaatggaaactaagaaatcatatgaccaatatttcacttattggtaatcttactctactgatttccccccagactgtgatttttgaacttccttgcctttctcctgtctttctgtgtttattcatggaattccagttatctgggcttgaaattgcaggctctcctaacttaagcaaaatctgacagatcagcaaaatgagataaatgtttcttttttctttctgactgcattaaatcagatacaactcagcattaaaaagctatctttgtaaatgttgttactaataaattagtcttataagatccctgg

SEQ ID NO: 951 - DNA, 2860 bp, Homo sapiens
gtgctcgtcgccgcgctcgtggaccggggccgggcggactcggggaccggcggaggacgccgggcgcgcccggcccgaggctgggggagcggggcggcgtggcgggcgcgccgaggaccccaggccgggccgggccgagaggctgccatgggctccgtggggagccagcgccttgaggagcccagcgtggcaggcacaccagacccgggcgtagtgatgtgcttcaccttcgacagtcaccagctggaggaggcggcggaggcggctcggggccagggccttagggccaggggcgtcccagctttcacggatactacattggacgagccagtgcccgatgaccgttatcacgccatctactttgcgatgctgctggctggcgtgggcttcctgctgccatacaacagcttcatcacggacgtggactacctgcatcacaagtacccagggacctccatcgtgtttgacatgagcctcacctacatcttggtggcactggcagctgtcctcctgaacaacgtcctggtggagagactgaccctgcacaccaggatcaccgcaggctacctcttagccttgggccctctcctttttatcagcatctgcgacgtgtggctgcagctcttctctcgggaccaggcctacgccatcaacctggccgctgtgggcaccgtggccttcggctgcacagtgcagcaatccagcttctacgggtacacggggatgctgcccaggcggtacacgcagggggtgatgaccggggagagcacggcgggcgtgatgatctctctgagccgcatcctcacgaagctgctgctgcccgacgagcgcgccagcacgctcatcttcttcctggtgtcggtggcgctggagctgctgtgtttcctgctgcacctgttagtgcggcgcagccgcttcgtgctcttctataccacacggccgcgtgacagccaccggggcaggccaggcctgggcaggggctatggctaccgcgtgcaccacgacgttgtcgccggggacgtccacttcgagcacccagccccggccccggcccccaacgagtccccaaaggacagcccagcccacgaggtgaccggcagcggtggggcctacatgcgctttgatgtgccgcggccaagggtccagcgcagctggcccaccttcagagccctgttactgcaccgctacgtggtggcgcgggtgatctgggccgacatgctctccatcgccgtgacctacttcatcacgctgtgcctgttccccggcctcgagtctgagatccgccactgcatcctgggcgagtggctgcccatcctcatcatggctgtgttcaacctgtcagacttcgtgggcaagatcctggcagccctgcccgtggactggcggggcacccacctgctggcctgctcctgcctgcgtgtggtcttcatccccctcttcatcctgtgcgtctaccccagcggcatgcccgccctccgtcaccccgcctggccctgcatcttctcactgctcatgggcatcagcaacggctacttcggcagcgtgcccatgatcctggcggcaggcaaagtgagccccaagcagcgggagctggcagggaacaccatgaccgtgtcctacatgtcagggctgacgctggggtccgccgtggcctactgcacctacagcctcacccgcgacgctcacggcagctgcctgcacgcctccaccgccaatggttccatcctcgcaggcctctgagccagccccgcccactgccagggacgccgagggcctgaccaggggccccgaggcctgagggcccctcccctgtccccacctcagtgcctgcggggccctgagcctccccctgtgccagcagccccactccctcagggtccagccatgccccaccctggactgaagttctgcaaagtcctccgaggaccggaacacgtttctgcgacccggggctctggccagcactgtgttctgcgtttggtctcatacctgcgtctaccttccatctgtgtccagcggccccggctccagcccagccagcactctgcagggtcacacgcaccgtgtccccacccaggacagcagacacccgccagagtgtgcgcgcccagtgactgcaccccggccctcatcacccaccggcactgatcggggcaccgcctggcccagcctccaccagggacccctcctcatgaactctggagccctgagaggagaggggcagccccccaccttgtcaccctcagggcttccccttctgtcctcattcttagagactgcttctcccaaacataacgcgttagccatgaaggagtcggagccctgggtccgaatggacccgcctgcggtctgcatcagcctctgggaaaccacagcagtgatgccagctgggcacgtcaggacctccccacacacccacacgatgccacaggtcagggggctgtgcctgactagggagccctcccattgccttcctggcccgggatagaagaggggaggtaagtctgggggctacgaagccgggcccccacaccctggctgaagtcagcttgacctaggtcttgaccctcatccagcaagggactcgacagacccaagggtccctggaacgtagggaggggctgggggtcactccagcccgggcctcccagaacaccaggcccgtgtgggtggcaccctgaggtcaggggatcctaagggtgtccttccagagacggtgtttccagggggaggaccgcccccgcttccagatccccggccccggctgtgactgccctgtttcacccctgctgtgtcccatcccccgtctgtctactaactgtaccgcaccggccattaaaagatgaaggcagaccgctgc

SEQ ID NO: 952 - DNA, 3498 bp, Homo sapiens
atagtccctgcccgcgggaggctcgcgcgggaggaggcggcggagccgcgcaacttcccgggagcccgggccaaagtgagcgcaaagtgctgcccaagttgccgggatggagctgcagagccggcccgaggcgctcgccgtggaactcgcgcgccaccagaacggcgacctcaagaagcagctccacgaaaggcagccgcggatcgccgcgctcagcgacaaacaagctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgctgccgccatggcccccagcaccgccgtgtctgtggtcagtgacagcatcaaagtccagcccctcctcatcagtgctgacaacaaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgaggacccctgctggaagaacgagatcacccacgatgagcactgtgccgcctgcaagcgaggggccaacctgcagccctgcggcacctgcccgggggcctaccacctcagctgcctggagccacccctcaagacggcgcccaagggcgtgtgggtgtgccccaggtgccagcagaaggccttaaagaaagacgagggtgtgccctggactgggatgctggccatcgtgcactcttatgtcacccacaagacagtcaaagaagaggagaagcagaagctgctgcaacgaggcagtgagctgcagaacgagcaccagcagctggaggagcgggaccggcggctggcgtcagcagtgcagaaatgcctggagttgaagacaagcctgctggcccgccagaggggcacccagtcatccctggaccgcctgcgggccctcctgagactgatacagggcgagcagctgctccaggtcaccatgacgaccactagccctgccccactgctggccgggccctggaccaagccctcagtggcagccacacaccccaccgtccagcacccccagggccacaactgaccccgagggaccagtcttcatacccacggaaagttattgggaccctgcttacacagcctgggggttctgtcggccttaattcataaacactatgaatttcagacaaaaattaaccagacagaggagaggagggaggaagagctgggcgagaggcctagagccaggaccaggtgggggtgcggccctgtgccctccaaattcacagggggtacctaggagccaggtggggtacgacaggctggggcacacagtccccccccggccacctcggggctgcctgggcctctggcttccaggccctgctctccacggcctccctctggcccgttggaggggcaggctgaggctgtggaggggacaagcacgccccccagaacgcagtctccactgagggcaccgcctattggtgtcctgtgggagggcgagctgagaacacatggactagctgagtggtagcggtagttggaacgagaagcggggtagtggatctaggtagttcctcaatgccccacgctcctaggaggtccccctggggtgggcgggcgggcctggggcactccgtcgcctttgcagaaccacctgggcccctttctgtcagtattattagggttacgaattgcagctgtttaacttgaaagacactgtcggaggtgagcatctgggcgccgggacgctgcagtgatccccgccagagcctgtgcccttcctgctccgtctttggggtcctcaaggctgcctccttccttttgccaatctcttggactcagtttgccgttgaagcgtttttctcatggagtttctgggcagagtggagctgcaaccctgttgtggggggcagcatttggcaggttttctctttggggttgaatcattcaacttaacgactgaagccctttcttgtctcctttggaagagccgataagtattccactcctcccttcttgccagtgcagacactatgccaaaaaataacttcacacttttgtatggcgtttttattgtgagatatttaatgtgaatggttggggggactctggctgacttcctttctgcttctagtagtctctgcttcaaggtacaaatgggaacacctcccctcgggaagcctggccaagctggaagatccggcaggttttttaagagccgggtggagggttggggaggaaagaaagggcggtggcctcgggaggttccggccttcggggaccagacttgctgccaagggcttctgcatccagggtgggcagtggcagcttgtcaccctcgcccgattcccacatcccagtcctgagggactcagcacaacaggataagcgtccaggagccacgggctcccaccccgagcatatcacatggtgccgaattgcactgaacacgcgtgtgtgcatcgcacgcggccacgaccacagacacgcatgcacacacgcagaggtgcagagcgaggaggccggcaaatcccgcagctgccacggtccctcctgtcattctcacgactccgggagaaactgtgctgtatgatacagatctattttaatacacttaccactgggtgaacaagatttttatattcttttattgatgaacaaagtgaaccgtgtgaggcacacgtcttctatattggctactctgtgccaagtatgcattaccgcgtggcttgcgatgtccatgtcttcagcttccttttctgttggtttggttttcttcgcggatggattgagttacatgttttaacagtgtaatgggaggatctgaaaggttggacccgggaggggtagctgccgatgtgtcttgagattgttaggttttttttggaccaaggaggaccgtccagtgggtagtgaggatagagaaaaagtgtttgtcttaaatacgccaatgtagttttccttctttacaatgtattaaactcgatcgatgatttc

SEQ ID NO: 953 - DNA, 3255 bp, Homo sapiens
aggctgtgaggcttccagcgtcggcccagaccttctctttccctttccagcagccggagaagtgcgacaacaaccagtactttgatatctccgccctctcgtgtgttccttgtggagctaaccagaggcaagatgcccgaggtgttacagaagatggctggaactgcatttcttgccctagtgacttaactgccgaaggaaaatgtcactgtcccattggccatattttaggctggtcttgaacttccgacctcgggtgatctgcctgcctcggcctcccaaagtgctgggatacaggcttgagccaccgcacctgaccttggcatgtactttagaaggaatgtacaacataattgaagaaattttggaaagagacattaatggaacattgttgtctcaagcaacttgtgagctctgtgatggaaatgaaaactcttttatggtagtaaatgctttaggagacaggtgcgtccgatgtgagccaacatttgttaataccagcaggtcctgtgcatgttcagaacctaacattttaacagggggattatgtttcagcagcacagggaattttcctctacgtagaatttcagctgcacgttatggagaagttggcatgtctttaacttcagaatggtttgcaaagtatttgcaatcatcagcagctgcatgttgggtatatgccaatctaacatcttgtcaagctcttggaagtatgtgtgtgatgaacatgaattcttacgactttgccacatttgatgcatgtggactatttcagtttatctttgaaaatactgctggactgagcactgttcattctatttcattttggagacagaatcttccttggctgttttatggagaccagttaggattagcacctcaagtgctcagttctacctctcttcctacaaatttcagttttaaaggagaagaccagaatacaaaactgaagtttgttgctgcttcctatgatataagaggaaattttctcaagtggcaaactttagaaggaggtgttttacagctttgtccagacacagagacaaggctaaatgctgcttattcatttggaacaacctaccaacaaaattgtgagattcctatctctaagatcttaattgactttcccactcctatattttatgatgtgtaccttgaatatactgatgaaaatcaacatcaatatattttggctgtgcctgtgttaaacctaaatcttcaacataataagatatttgtgaaccaagacagcaactctggaaagtggcttctaactcggcgcattttcttagtggatgcagtaagtggacgagaaaatgacttaggaactcagccaagagtaattcgagttgctactcaaatatcactgagtgtccaccttgtacccaacacaataaatggaaacatctaccctcccttaatcaccattgcctacagtgacattgatatcaaagatgccaacagccagtctgtgaaggtttccttctcagtcacatatgaaatggatcatggagaagcacatgtccagacagatattgctttgggtgtattgggtgggctagctgttttagcatctcttttgaagacagcaggatggaagaggcgcattgggagtcccatgattgatttacagacagttgtgaaattcttggtgtactatgctggtgatctggccaatgttttctttatcatcacagtgggaacaggtctttactggcttattttcttcaaagcacagaagtctgtgtctgttttgctgccaatgccagttcaggaagaacgttttgtcacttatgttggatgtgcctttgctctgaaggcactacaatttttgcataagctcatatcccagattacaatagatgtattctttattgattgggagcgacctaaaggaaaggttcttaaagctgttgaaggtgagggtggtgtacgaagtgccactgttcctgtaagcatatggagaacatattttgtagcaaatgaatggaatgaaattcagactgtgagaaaaattaattcactctttcaagtacttactgtcctcttctttttggaggttgtgggattcaagaacttagcattaatggactcatcttctagtctttctagaaacccacctagctacatagctccttatagctgcattttgagatatgcagtgtctgctgctctttggctagccattggaattatacaggtcgtgttctttgctgtcttttatgagagatttatagaagataaaattcgacagttcgttgatttatgctctatgagtaatatatcagtgtttctgttatcccacaaatgttttggatattacattcatggtagatcagtacatgggcatgcagatactaatatggaagaaatgaatatgaaccttaaaagagaagcggaaaatttgtgtagccagagaggtttggtacccaacacagatggtcagacttttgagattgcaatttctaaccagatgagacaacattatgacagaattcatgagacactaataaggaaaaatggtcctgctagactactgagttcatcagcaagtacttttgagcagagtataaaagcatatcatatgatgaataaatttcttggctccttcattgaccatgttcataaggaaatggattactttataaaagataagttgcttcttgaaagaattcttggaatggaattcatggaaccaatggaaaaaagcatcttttacaatgatgaaggttattctttcagcagtgtcctgtattatggaaatgaagctactcttcttatttttgatctgctgttcttctgtgttgtggatttggcttgccaaaattttattttagcatccttccttacatatctacaacaagagatttttagatatatccgtaatacagtaggacaaaagaatttggcatccaaaacattggtggatcaaagatttttgatttaacttcctgaataaataacttaaagactcagtataatcatggccaaaaaaaagtcatgatatcaggttagtttgccatattttttaaaacttataatgcagactattctgtttttgttttttatttgcagaaagatttatttttataacttgggaatatataacctgatataatagaaaatactgttttcccattgtgtgtagtatttaatgcagtaaataataaattaatactgacagtgaggccaaaaaaaatctaaatgttgctttcagcataatactttttaatgctaattaaaacagtccccatc

SEQ ID NO: 954 - DNA, 2754 bp, Homo sapiens
gagttgagccacgagctgttgtgcatccagaggtggaattggggcctggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcagcctcctcagttccagattttgaggaagctgtcccaggaacctgtggccacagccatcccgtcagctgtgactcccaggcagctcaccctgttatcgtggccagagaggatgcctgaggaagagggaaaggagtcagcctgtctctccaagctgatttggaaagcagtgtgtgcatgcgtgtaagtgtatgtgtgggtgtgtgggtgtgtgtgtgtatgtgggtgtgtggggggatatgtgtgcatgtgtatgcatgtgtgggtgtgtgtacgtgtgtgtgtgcatgtgtgcttgagcacatgcatgcagggatcctagactcggtagactgggctcaacccctgaagaaggctaagagactgaaagaggattagctgtagggcagggggttctctgtcaagagctttggttgggggagggctgggatcagacagagaaaggctggaagcatctgtgtactatgaaaaaacccgagggcaccttgacaggtgctggaaaagagaaggcaaccgttcatcctatttctttgcttccagatgaagaaactgaggcccatggaggagtgacttgtgcaaggacactcagaaagtgagcaacagaattaggatttggattctgcccctggccagtgttattttcatcagcacctggcctcttgatagagaagaagccatcctatctgaccaacttcaggctagtcttagatgagccctaggctgcagtcagggccctcgggccactccagatctccttgattctgccttgattccatgtttccctgaggctgtcttgcctctcagtgggtgcccctgaaatgccaggaacccagaactgactggacagccatggtccacagatctcctagggcagggagcagtcatggcattgggcagtggagagaggctgcttagagcaacactgagggaaaacagtcctagttgggaaccaaggggtactggattccaggggtggagtcacccagtgacaagggacagcagtaagagagtccgaaatgggagctgatggggggtacagaatggggagggagggctggggagggtccttccagctgaggaagcagcagccagggctggcccttacccacacgctcagacttcatggagtcccagacattgcagttgaagtcgtcgtagccagcgaatagtaggcggccactgagggagaaggccacggacgtgatgccgcagatgatgctctcgtgggagaagcagatcagctcctggtctgcccgcaggtcaaacaagcggcaggaagcgtcatccgagcccgtgcagatggcctctccattggggaagaactgagggcacgggtggcaagtgggtcagggatcagacctgggcagcccacagcctctcccgccctctgcctcccacctgacagctccagggcaagccgctgctctcagcctccctgcctgtccctcccttggtttggggtgagaagcagccctgccaacacataccacgtgccagtgacttccctatgcccctcgcccgctctgcactatacagcgctgcaggcaggcatcatttccacgtcgcaggcaagagcaccaaggcttgcctgcagtgacccggctagaagggcggacggaggttgtcccagactcccagactacacaagtgggctggatcagggtgtgtaagaacagggtccagtacaaatgcaaggcctggatctcacggcgagcaaatgtcagataagctcaaacggagggagagtctacagaaaactggtttgtactcttcaaaaacgtcaatgacataaaagacaaaggtgggaaaacagttccagtttaaaggtggtgacgaaaaagatatggcgaggaaaggtaatgcacgtttctggattggatcctggacagaaaaaaacatgagctattatggacatttttgaggctattggtgaaatttgaatatagactgtagactgtagtattgtgtcaatgttgagtttcctgatcttaagaatcatacagtgattatgctacagaagggctttgtttcgggaagtacttaaggggtaaagaaacatgatgtctgcaacctactttcaaaagacacagaaagaaaatgtatatctac

SEQ ID NO: 955 - DNA, 3322 bp, Homo sapiens
gaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtactttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccacgaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagatactgggagaagagcaatgagcaaaacggtctccttgtatcatggggagagactctgtcaagcctaaagtgagcctcggatcttcctaatgacctcctgctggcccagctggatgcaagacaagctcgtttaagcctctgctgacctttcactcctccactacaagaactgcaccactcatttccaccgtcttcagaactgtgcaccaaatagaccacaaagcttcatggctgacgaatgatttccttttcatgatgcaaagagatttttacaaatttctattgatgagagttaacattaagtctcttgtggcattataacctctgttgcacaaatacaatgcttctatataactcttatttttaccttccttataaaggaacaatctactgttcttgccagcattatcttgaaaattcaggccaaaatatctgagcagaatgcacatactgagtgcaccggtggtatttttcatgaagagaccactttgaaagggtcttcctgatttccacctccctcagaatctatctgaccttctcacagactttattggtgtgaatctttcttatatttaaccatttatttgagatgctcatttttgtagcccatcttttctttttaaaaaacatgggctggtttctacccagaagagggtggtaagactgtacatgtacgttaacattcacttgtataactcagcaaaagattagaaagctgatcttattgtcacaagacacagtgccaacataaacctacatcgtaaactgttgaccaaagaactcgatgacatgggcctggactcgtcgcagccctcccttagcaaggacctccgcgatgaatttttggtgaagatatatggtgtccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacacagtgtgcaactagccccagttttgacagaataattcttggtcttccccaaagagacaatttgttgtacccatgactgttgcctgc

SEQ ID NO: 956 - DNA, 3226 bp, Homo sapiens
catttacagggaccctcagagacctcactcagacctgggaggcccattgctcacatggcctggctgctcccggtgggcagaagatggagaagccacagacagcgtcctgcgtggggtctgtgggcgctgacccagcagccgtgcagggaacagccctgcccgcagaagcggatgccggggcaggtggcagtgcaccccgaggaagccttctggacggagtggtggggagggcgcgggcgcatgtctcaggccagtgcacttcacatctcatcccacacctgcgggtttgagcttggtttggggtgccagctcccacctggccagccaccccttggggactcaccctgggctctcctgccaatcaaggtggagactttgggacagccctcctccacgtgaacagactgaccgagacacctctccaccacctccctcacactgtgcccgcccagccgccccctcccctggcccttggcaggaggctccttggcagctgacgggaggctcgggcactgccagatggccccttcgcaagtcttcggtttgtgtctaaccactttttccttggaaaagtgtggggtgaagagcgatatgggactccataggcagccgccaggtggtggtggcctcgctcctcctgctgccgggggctgccacggccacctccagggatggctgtctggcccgtctgtggaagcccatcaggaagcacccccagtgccgggcctcagccaagagcaccggcctggaaggggcagggctgggggacagtggcatgaggtcagacatggcgtggggccgaccccgcaggcagcccaccatccacagcctccatgttctgtctgcaaaatggggccacagtggggcctgggcagaggagagaactgcccactgccccaagcacggtccccagagagctggaggccagccagtcctccacacccagcccctccccagcagacccttcttccagtggggcgctgtgcccgactgggtcctctctgaacctctgccttttcgtcactgaagttcgtaggttcttgttcttgggaactgtgagttcaggcactaccagcacgacagccagagggacggacggacggctggacaggctggaggcccctgccatgggcactcaccccgtgggacagacagaaggatggatggacggttggacaggctggaggcccctgccttggggcactcaccccgcaggatggacagaagggcggatggatggctggacaggctggaggcccctgctatggggcactcaccccacgggacagacaaaggatggatggacagctggacaggctggaggcccctgccatgggcactcaccccgcgggacagacagaaggacggatggacggctggacaggctggaggccccttccatggggcactcaccccgtgcgacagacagaaggacggatggacggctggacgggccggaggcccctgccgtggacactcaccccgcaggacagacagaaggacggatggacggctggacaggctggaggcccctgccgtggacactcaccccgcaggacagacagaaggacggatggacggctggacaggctggaggcccctgccgtgggcgctcaccccgcagttgctgggcctccgtggggtcctgggaaatttcaacagcagtccagtgtgcgggccgcgcctttgttctgtccagccagcggcccaggctgcgcctttgttgtatctggccgccggcaggccaggcaccttctgaggaagggttgctgcgtgtctgtggctcacggaggccttcctctgtgtgtgactcacaccccccacccaccccagcccacttctgggagcatcttcctgggggctttggaggcccatccattcttccctagggacaaaagtgcagggagcggcgtcccaggtgccaccgtctctggggaacgtgggccaggactccctttgctggacacagaccctgcccacaccgggtgaccgtggggtgacctcacagggtgtgtggggttccgaagccgccaccctccttcctgagcctgcactttgacctggggctgctgagcccagaagggccttgagagggctggctcagtggcacgtgggggccttgggtggttgggtccccgagacaggccatctcgctccttgtgtggcaggctgcggggccctgcttgcctgggtcccacgtggtagaactcggcgtttggtgggggcctgctggggacaggaagggacagcaccccaccctgagctggcactcatgcttcactggagccaggcggaggggccgagggcaccggcacaaggtgcagacgtgtcggtccctttgaggaccgagatcatgaccaccacggagcaagcgcccgggtcctcagatcaaaggcccaatagccagtgaggcttctctgcactggtcccagcagaagcggggcctggctgaggcagtggcatcagagactcggggcaatgggagtgcgaggggggtctcagcgtcccacagctgctgtaacaagtcgccgtaaacacagtcactcaaaacggcacgagctgatggcagcagtggagctggaggtccaggatgggtctcaccaggctgaagtcaaggtaccgacctcaggggaattggtgtcctgcctttcccagcctcagaggccccacttggctgtacctgggcagctgctccgctccacgggcctagcctcgctcacagggctccaagaacagagcctggatcgtcctgagggccccgtgatgtccccgtcacagcaaaggaagatttaggatgcactggaagcccagaagtccagagaaggggctcagagccatcggtcgccacggggcacctcgggggtcccacgaacactgcagcgggcgtcagaccctcaagcgtcggtaagggcctcaccgccttgggaggggtcagcagttaccggaggactctgggcagtggcagggagcagcaacaagggccccccattcaggccctcacccccggcacttggaggaggtgccgcccctgcctcggaagcctcgagggcaacctgcaccctcaggaggcccagccgggggcgtcactgcagggcaccggcagaaactggggtctgaaaacagcagcccagagtggatttggaacagaacagggtgtcacagaaaggatgtttcatgaggtgggttttgatgagtatgtttaaataaatgtaacttaattgatgtt

SEQ ID NO: 957 - DNA, 3579 bp, Homo sapiens
ctcgggaacccagcagaatgctggaagaacagctcagggccttggctgagagcagactcgcagcggagagcagctctgtgtgccctcaaccctctgcctttcctcaggaggacagcttctgaccgccagccaggtggccgaccgcagcctcccaccttggaccccaccagcacctcttatgaatcccagctcggccagaacagcagcagcgaggagagccctaagaaggacacagagccggggagcagcccctgttcccctgaactgcagggcggcaccaggcgtgcatctcccccagagttctgtgtgctgggccacgggctgcaaccggagcctcggaccggccacatccaggacaaatcccagccagaggcgcagccccagcaagaggaggtgtcctgacaggctgacgagggggccacactcacgcagtcaccccagaaggccaagtgtgacagccaagtgtccagcctgacccagagatgatgggcaaaccaaactcctactgaggtgtcctggaaaggcctggaaggtgcactgcccagtgggtctgctgaattttaaacaatcgccgttttcagtcccagatcttgctctgccttggggttcaaaggttaaccagaacttttagaccccacaatgacagtatttaatgcttcaagtgctggccttaatttggggtggggtggggggtggagaatgtatagttgcatgcttgatagggttttaactgggttcattccttgagatcacttaagcctcacaacagtgaatgaagcacatagcattcttcagttttgcgcatatgaaaaccgaaggtgtggggagaggccccctcaagtgtctggctgaaggtcatacagctaagaagagaatagagcaaaattttgcacagatgagtctggtgttagaatctctctgctctttttattacattccattgcccgtaactattgcgtcactccacctgcctaaagcagacatgggtgcgcaaatggtcgcaaagcttctttgttgtaaggttaagtagcggcacagcattgacaaagtccctattgagagctttgtttagaagtgcatggctcccaaaatgagaaggctgagtgagccaggattaaaacacacagccccacccgtcctctgtcctctcctccttcccaagctcagtttcaatgctgtaaacttaaagctgacagctcacaataccagccacgctgcctctcggcctaagcatgtagcaaatgctctcactgccctacgcattacatgcttctcgacggagtagggtaaaccaagcctcccaaacaaggcagcccattctccacatgccgtgggtgctggagctcagaagatagcgtgggtgaggcatacgtactcacacgccgatctcccctcggaggcttcttggccaactttattcccaggtcatcttgcagaacttctgctggagtcgaaatcaaagtgaaaaacagttgttcatgccaaaaacctgcttctgccaatgagctagatatttgctgcagatcttggaatgcttccactggaggctgtggtgtgcgttctatttagaaaagattttgcagtaattgagtgattcaatgccggctcaatgggttggcaaaagacaagaattcttacccactggggtacagcaaagggacgatcctccagatctgctgcaaagctgatttttaaagtttggggtaattatagacctcaaacccattcttgctgggactgtgggctcaaaaacttgttaaactgggtccctagggactatagcaacctcccccagagagaggctatgactctgagtaaatgaatcccaccttgacttgtccaattattattcaaaggcacccaaagaacagctgattaaactaccaagaggggccacaacccacccctctgctggaaagggacacacccagctgtctgctcgcatttgctcctgttgccgccctcatctcagagaagtgctcaggcagtgcccaggccagccgattctagagccaagccacacccactgctgggtggacacttaggagctgcctggactgcaggcaacgcagggaagtccagccacccaggcagggcaggggccaaggtaagcacgtgaggatggaccaggttcagcaaacttgcccgacagagatctgggcattctccctaaatggttgggcagaccaaccattgggtcaccatggggtgagccttaggtaagctgggcactgagctgagtgagcaggagacacacagtgtgagcggcctttgaggtctagctcacaagtaagtggcttcaggtgggactgctcagaaagtgggccctgcctgggctcagatttaggggcaggattcctggaggtccgaggaaacgaagctgttccccagctgcagggagactggagtgggacacagtgggtgaaactggggtaccatgaggggtggaaccccaggaattatacacattttcattactggaaccgggatatgaagtggagccactccagcagtgaggggaagcaaggctgagtctccagcccaggcctccttccgtaaagggcctcatcttaaaagtccagggctgggtagaaagtggaaagggtggccgagtgccccctgctgtggccatgcaagctagcggcagcagggagccaggcagattattccaccacagaaggggtcagtatcatggagaacacgcaggaagggtccggaatgaacaacggtgctttccgtgagcatgcatggcaggaggctgtctgagactagaggttgtccctcgccaggctaggctggcaagcagcaggaagtgcccacccaccatattgcaggcagcagacgaaggggtacagggcacccgggatcctgccatcagctgtggagatgcccatgatgcctccttgtccctctggaggacctccacgtttgcttggggccaacgtgtgccaggacagggcgaggctcctgccataggtccccacacgcgatgtcataaaagcccccagctgccaccagacccaggcagccgggacagtgagctggtgacaccattgtgttgcccagtaaccctaggctactggaattccaagtcagcttcccccactccagggaagatggggaggggttgccaaggtgctgggggctgggggtcagttaggtcaaaggtgaagcagtgctgagccgacataggagcaggcgggtcaaagatgtgtttttggctaccataccaactaccagacttagctcaaattacatgtgaattagactttgtacaaaaggaattaaatccacaatggaacagttttgtggcatctggtcagttttgccccctagagaccaggtcttccacaaacttgagtctgccttggagcacgcattgctggtggcaggaggggcaaacccagctgtacagcttctcagacaagggctgttcacgcccaccatctcccttctacccaagaatggtatccttgctgggccaaatccacttcctttgcccaagggggaagggaggacagtttttctttgttctgctttttgttttaataaaaattattaagccaatgaacccaactc

SEQ ID NO: 958 - DNA, 3053 bp, Homo sapiens
attctgcgaggaatggcagcggcagcagcatccccgccagaggcggcggcggcggcggcagcggccacggccaccaccgcggacgctattgttccctggtgttagacgcgctctccctccttctcatctgaagcgaacaatagcaggaaagagctttgctttctgtactctttgaaaagacgttccaagagcggagaaaaattccctgccgagcgtgctacggctctggaccctggagtggctgcaggcggcatggggctgcaagccaggcgctgggcgtccgggagccggggcgctgcggggccgcgccggggcgtcctgcagctgctgccgctgccgctgccgctgccgctgctcctgctgctgctgctacgcccgggcgccggcagggctgcggcgcagggcgaggcggaggcgcccaccctctatctgtggaagactggtccatggggccgatgtatgggagatgaatgtggtcccggaggcatccaaacgagggctgtgtggtgtgctcatgtggagggatggactacactgcatactaactgtaagcaggccgagagacccaataaccagcagaattgtttcaaagtttgcgattggcacaaagagttgtacgactggagactgggaccttggaatcggtgtcagcccgtgatttcaaaaagcctagagaaacctcttgagtgcattaagggggaagaaggtattcaggtgagggagatagcgtgcatccagaaagacaaagacattcctgcggaggatatcatctgtgagtactttgagcccaagcctctcctggagcaggcttgcctcattccttgccagcaagattgcatcgtgtctgaattttctgcctggtccgaatgctccaagacctgcggcagcgggctccagcaccggacgcgtcatgtggtggcgcctccgcagttcggaggctctggctgtccaaacctgacggagttccaggtgtgccaatccagtccatgcgaggccgaggagctcaggtacagcctgcatgtggggccctggagcacctgctcaatgccccactcccgacaagtaagacaagcaaggagacgcgggaagaataaagaacgggaaaaggaccgcagcaaaggagtaaaggatccagaagcccgcgagcttattaagaaaaagagaaacagaaacaggcagaacagacaagagaacaaatattgggacatccagattggatatcagaccagagaggttatgtgcattaacaagacggggaaagctgctgatttaagcttttgccagcaagagaagcttccaatgaccttccagtcctgtgtgatcaccaaagagtgccaggtttccgagtggtcagagtggagcccctgctcaaaaacatgccatgacatggtgtcccctgcaggcactcgtgtaaggacacgaaccatcaggcagtttcccattggcagtgaaaaggagtgtccagaatttgaagaaaaagaaccctgtttgtctcaaggagatggagttgtcccctgtgccacgtatggctggagaactacagagtggactgagtgccgtgtggaccctttgctcagtcagcaggacaagaggcgcggcaaccagacggccctctgtggagggggcatccagacccgagaggtgtactgcgtgcaggccaacgaaaacctcctctcacaattaagtacccacaagaacaaagaagcctcaaagccaatggacttaaaattatgcactggacctatccctaatactacacagctgtgccacattccttgtccaactgaatgtgaagtttcaccttggtcagcttggggaccttgtacttatgaaaactgtaatgatcagcaagggaaaaaaggcttcaaactgaggaagcggcgcattaccaatgagcccactggaggctctggggtaaccggaaactgccctcacttactggaagccattccctgtgaagagcctgcctgttatgactggaaagcagtgagactgggaaactgcgagccagataacggaaaggagtgtggtccaggcacgcaagttcaagaggttgtgtgcatcaacagtgatggagaagaagttgacagacagctgtgcagagatgccatcttccccatccctgtggcctgtgatgccccatgcccgaaagactgtgtgctcagcacatggtctacgtggtcctcctgctcacacacctgctcagggaaaacgacagaagggaaacagatacgagcacgatccattctggcctatgcgggtgaagaaggtggaattcgctgtccaaatagcagtgctttgcaagaagtacgaagctgtaatgagcatccttgcacagtgtaccactggcaaactggtccctggggccagtgcattgaggacacctcagtatcgtccttcaacacaactacgacttggaatggggaggcctcctgctctgtcggcatgcagacaagaaaagtcatctgtgtgcgagtcaatgtgggccaagtgggacccaaaaaatgtcctgaaagccttcgacctgaaactgtaaggccttgtctgcttccttgtaagaaggactgtattgtgaccccatatagtgactggacatcatgcccctcttcgtgtaaagaaggggactccagtatcaggaagcagtctaggcatcgggtcatcattcagctgccagccaacgggggccgagactgcacagatcccctctatgaagagaaggcctgtgaggcacctcaagcgtgccaaagctacaggtggaagactcacaaatggcgcagatgccaattagtcccttggagcgtgcaacaagacagccctggagcacaggaaggctgtgggcctgggcgacaggcaagagccattacttgtcgcaagcaagatggaggacaggctggaatccatgagtgcctacagtatgcaggccctgtgccagcccttacccaggcctgccagatcccctgccaggatgactgtcaattgaccagctggtccaagttttcttcatgcaatggagactgtggtgcagttaggaccagaaagcgcactcttgttgg

SEQ ID NO: 959 - DNA, 3052 bp, Homo sapiens
cagagccacttccgccccggaaagcgaggccgccaccatcttttgggtccgggagaaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccagttatgccatctcagaactatgaccttccccagaagaagcaggagaaaatgaccaagtttcaggaggctgtgacattcaaggatgtggctgtggtcttctccagggaggaactgcgactgctcgatcttacccagaggaagctgtaccgagatgtcatggtggagaacttcaagaacctggttgcagtggggcatcttcccttccaaccagatatggtatcccaattggaagcagaagaaaagctttggatgatggaaacagaaacccaaagaagcagcaagcatcaaaataagatggaaacactccaaaaatttgcattaaaatacctttcaaatcaagagctgtcctgctggcaaatctggaaacaggttgcaagtgaattaaccaggtgtcttcaggggaagagttcccagttattacaaggtgactctattcaggtttctgaaaatgagaacaatataatgaaccctaaaggagatagctctatttatattgaaaatcaagagtttccattttggagaacccagcattcttgcgggaatacatatctgagtgagtcacagattcagagtagaggtaagcaaattgatgtgaaaaataacctgcaaatacatgaagacttcatgaagaaatcaccatttcatgagcatattaaaactgacacagaaccaaaaccctgcaaaggtaatgaatatggcaaaatcattagtgatggctccaaccagaaattacccttaggagagaaaccccatccatgtggtgagtgtggaaggggcttcagttatagcccaaggcttccccttcatccgaatgttcacacaggagaaaaatgcttcagtcaaagctcacatctgcgaactcatcagagaattcacccaggagagaaactcaatagatgtcatgaatctggtgattgcttcaataagagctcttttcattcttatcaatctaatcatacaggagagaagtcttatagatgcgacagttgcggcaagggattcagtagcagcacgggtcttatcattcattacagaactcatactggagagaaaccctataaatgcgaggaatgtggtaaatgctttagtcaaagttcaaattttcagtgccatcagagagtccacactgaagaaaaaccatacaaatgcgaagagtgtggtaagggcttcggttggagtgttaatctccgtgttcaccagagggtccacaggggtgagaagccctataaatgtgaggaatgtggtaagggcttcactcaggctgcacattttcacatccatcagagagtccacactggagagaaaccctacaagtgtgatgtgtgtggtaagggcttcagccacaattcaccattaatatgccatcggagagtccacacaggagagaagccatacaagtgtgaggcgtgtgggaaaggctttacccgtaatacagatctgcatattcatttcagagttcacacgggagagaaaccctataaatgtaaggagtgtggtaagggcttcagtcaggcttcaaatcttcaagtccatcagaatgtccacactggggagaaacgattcaagtgtgaaacgtgtgggaagggcttcagtcagtcctcaaagcttcaaacccatcagcgagtccacactggagagaaaccatatagatgtgatgtgtgtggtaaggacttcagttatagttcaaatcttaaactacaccaagtaattcacactggagaaaaaccatataaatgtgaggaatgtgggaagggcttcagttggagatcaaatcttcatgcacatcaaagagttcactcaggagaaaaaccctataaatgtgagcagtgtgataagagcttcagtcaggccatagattttcgggtacatcagagagtccatactggagagaagccatacaaatgtggtgtctgtggtaagggcttcagtcagtcctctggtcttcaatcccatcagagagtccacacgggggaaaagccatacaaatgtgatgtgtgtggaaagggctttagatacagttcgcagtttatataccatcagagaggccacactggagaaaaaccttacaaatgtgaagagtgtgggaaaggctttggtaggagcttgaatcttcgccatcatcagagggtccacacgggagagaaaccccatatatgtgaggagtgtggtaaggccttcagtctcccctcaaatcttcgagtccacctgggtgttcacaccagggaaaaactctttaaatgtgaagagtgtggtaaaggcttcagtcagagtgcacgtcttgaagcccatcagagagtccacactggagaaaaaccatacaaatgtgacatatgtgataaggacttccgtcaccgttcacgtcttacatatcatcagaaagtccatactggtaaaaagctttagaaatgagaaatgtgttaccaacttttgtcggaatgcacatcttcaagtttttggctagtccatgctggtggtaaaccctgtaaaactactgagagtggaagggggtttgttcacacttggaatctttctaacaaatccatcaagatgataacacagaaccatgaacaggaatagaactcgtatttaggggagaaatagggctggtggctctcttggtaagatctagttaatataaatgatcacctttcattgtgaatatatgcctgaagataatgtgtggaaggatatttgccatatgctaactggttttttggccagggagagttttgggttattatcccttttctttaattttcattttatacttacagtgatcattattttcataaaagctgtaaagctatgaaaaatgaataaaattactaaaaattttctgt

SEQ ID NO: 960 - DNA, 3785 bp, Homo sapiens
attcatcacactccctgctttgaatcgcctctccttcagttgctgaggtcaattccctaggaaaacagcaggatcttgattgcaccatgccactcaacagcctcgcttgggtaagggaaacaccaaaagcagaaaaatccatgctgaaggaccccaggaccagcaccagttcctgagcatctttcccgggctgagcagcagagactcctcaggaagactcactggactgtacccaccacctgccatgtctctgtggccacctttccgatgcagatggaagctggcgccaaggtactctaggagggcgtctccacagcaaccccaacaggactttgaggccctgctggcagagtgcctgaggaatggctgcctctttgaagacaccagcttcccggccaccctgagctccatcggcagtggctccctgctgcagaagctgccaccccgcctgcagtggaagaggcccccggagctgcacagcaatccccagttttattttgccaaggccaaaaggctggatctgtgccaggggatagtaggagactgctggttcttggctgctttgcaagctctggccttgcaccaggacatcctgagccgggttgttcccctgaatcagagtttcactgagaagtatgctggcatcttccggttctgggctctctggttcctatgaagacttgcagtcaggacaggtgtctgaagcccttgtagacttcactggaggggtgacaatgaccatcaacctggcagaagcccatggcaacctctgggacatcctcatcgaagccacctacaacagaaccctcattggctgccagacccactcaggggagaagattctggagaatgggctggtggaaggccatgcctatactctcacaggaatcaggaaggtgacctgcaaacatagacctgaatatctcgtcaagctacggaacccctggggaaaggtggaatggaaaggagactggagtgacagttcaagtaaatgggagctgctgagccccaaggagaagattctgcttctgaggaaagacaatgacggagaattctggatgacgctgcaggactttaaaacacatttcgtgctcctggttatctgtaaactgaccccaggcctgttgagccaggaggcggcccagaagtggacgtacaccatgcgggaggggagatgggagaagcggagcacagctggtggccagaggcagttgctgcaggacacattttggaagaacccgcagttcctgctgtctgtctggaggcccgaggagggcaggagatccctgaggccctgcagcgtgctggtgtccctgctccagaagcccaggcacaggtgccgcaagcggaagcctctcctcgccattggcttctacctctataggatgaacaagtaccatgatgaccagaggagactgccccctgagttcttccagagaaacactcctctgagccagcctgataggtttctcaaggagaaagaagtgagtcaggagctgtgtctggaaccagggacgtacctcatcgtgccctgcatattggaggcccaccagaagtcagagttcgtcctcagggtcttctccaggaagcacatcttttatgaaattggcagcaattctggtgtcgtcttctcaaaggagatagaagaccaaaatgaaaggcaggatgaattcttcaccaaattctttgaaaagcatccagagattaatgcagttcaacttcagaacctcctgaaccagatgacctggtcaagtctggggagcagacagcccttctttagcctggaagcctgccaggggatcctggccttactggaccttaatgcatcaggtactatgagcatccaggaattcagggacctgtggaagcagctgaagctctctcagaaggttttccacaagcaagaccgtgggtcaggatacctgaactgggagcagctgcacgctgccatgagggaggcaggaatcatgctcagtgatgacgtctgtcagctgatgctcatccgctacggcggcccccgcctccagatggactttgtcagtttcatccacttgatgctgcgtgtagagaacatggaggatgtcttccaaaacttaacccaagatggcaaagggatatacctccagaagccagagtggatgatgatggcactgtactcctgagaaggctgagtctcacctgccctcactgaagactctgcatgtggcccaagagcagcctttggctgagaccaacccatgcccaccctacttactgatcttcaggacagcctcactagccgtcaccttctcagctgggaaggtttctcttctgcagccctccccgtgcatggccagcatgcagaaagggaagggaggaagtaaagattacatcagagttgtaaaagctagccatccttccctgaggccacaaccttgtcacaagcggagatgttacctgacatggcctaagcattctgactccagagctggtgtggttagcctccatacaacactgcctctgtggctgcaaactcaagtgactttagacatgccacatgttctcacatggtggggtaatcatctaggttttaaggtctgaaatgggaatgatatatccttagacatttagtcccagcatctgcaaattgatagagacataggctaagtttcagctgtttggggatggggtcagggatatagtgggctttcagaaacacagacagtaagagaattggcagagtccaggtggggtgggctggctctggcatctgaggtcatggggtagtcttcttctgacaatatctccgtatgattggatctggggcaacctagtagatttaaaacacctgagttctcaaagggcttcctgcttgtgacaggtgtgtctatttgcttgatatatagactatcagatccatttcaaatctgtccagaaattctctgtctatctacttcaaaggacaaaaacaaacccatgctaaattatagagtcaatcagtgggtggttggtatatctgattttttgaactaccatgaaacaccttgtttatgtcatccctctcaaccaagaatacaggtgcaaaaccagaacaatggcctttttccaaagtctatgcaatttattcataagttagcacctcagagccatttattactacaggttgagcatcccaaatctgaaaaccccaaatctgaaatactccaaaatctaaaatttctgagagtagacatgaaactcaaaggaaataggggcattttggattttgaatttttgggtttgaggtgttcaactgacaagtctataatgcaggtatcctgaaatctgaaacacttctggtcccaagcattttagttaagagatagtcaacctgtattctatttaatcttaatttacaaacaattctaacaaacatggctgtttgatttccaactccatagcagactcaggaaggaagctgaatgaagagataaaagtgtgtccattggcagaggactaaaggagatttgagcacctgtcagatgggtactgtaccagaagaaaggagcactttgaaagcgtagcttatggggtaggaaagtattttatttaggaaaaaaaacccttcatttattccaaatgataaaatgtaaaatgggtttccataaagtgccagatacatgagatgttgttgattttataaatgatgatcatgtatttacagccttttacagttttttatatccattgacttatttgtgtctttgtctttaaaatctgccattgcaaatagctgttttaataaaccaattttgccttggcccctg

SEQ ID NO: 961 - DNA, 2472 bp, Homo sapiens
aggccgggatagggtggagggggcttgggctgcgcccagaacacgggggccaggcggtccgtgcgagaggaccaacggagcgctgaggcgggcgttttcttggatgaattgcttgctttggaggcatctgcaatcagattcatagaaagaactctaacaggtactcttgaatacagatttctaataactttaagatcaatggaaagcagagctgcactgcggttagggcctagttccatcagcggctgcagccccatgggtcgcccatggggaccctggccttgggcacctgtggagtacgtggcgctgggtcgctgggtcgctggcgccagtgtgcaagatgctccgcaaggaggcagcggcgggctggatggtgcttggctgccggccctacctggcctttaccgccttgagcgtgcctggctcactcaacatcaacctctattcactggtgtgcgccagcccggggcggctgtggggtcagcgtgctacttgctgccagatgcctcggagcacgctgctgctgcaggagggcagcatcctggcggccgtgatggtgctgaactaggggagctgccacgggcagaagctgtgcgaggagagtgcccggcgggttgtcctcacctcactgctcgcctgcctgccctcctgctggcgggtctacttcctcaaagggggatatgagaccttcttccagggttgcatggatgtaaaactcgtttcactcgtttcaaagtgagagagctctcatcagccagtgtggaaagctagtagtgctaaacatcaactacaggccagcttatgatcagggtggtccagttgaaatcctttcctccctctaccttggaggtgcctaccatgcatccaagtgcaagttcctcatcaagctatacatcacagcccagctgaatgtccccttgtggacctggctgtgaggcctgcaagacccacctacatacgaatggatccttgtggaagaaggccacatggctgacattagctctcactttcaagaagcaatagacttcattgactgtgtcagagaaaagaaaggcaaggtcctggtccactgtgaagctgggttctcctgttcacccaccatctgcatggcttccctcataaagaccaagcacttctgcctgaaggaggccttcaattatgtcaagtggaagaggagcatgatctcacccagctttggcttcatgggccagctcctgcggtaggaatttgaaatcctcccttccacacccaatccctagcttccctcctaccagggggaggcagcaggctcttcattgataagccatttgcagacatttagccctgacttgaagggtgtctactgcacattccctgcctcagtgctggctccagtgcccacccactggacagtctcagagctcagcaggagccctgtggccacagccacattctgctaaaactgggatagaggaacaagcccagccccaagagcagctatgacttttgtttttaagaatggacatttcacatctgtgcaatactgaagacctcactttgtcatgttgccccagtgacatagtgagaggtcaccaggcttgcaaatgaacttcacacagacctcagggtaggttctcaggattgaaggaaggccaagcaattacaggagcacagcacgtgctgactactgtacttccagaccccctgccctcaagggactgcccagtccttgcacctcaaagttcgccttttcatttcaagcataaggcaataaatacctgcagcaacatgggagaaagaagttgctggaccaacagaaatggcacttatgaagccaattcattttgaaggaagcacaatttccaccttatttttcaaactttggcagtctcaatgtctgtctccgttgcttcaggaaataagctgatcaccatctagtcaggaaagtaaccctacagggtttgtggagacatgatatatatgccaatttgaaccctgaaatgttttttacataccctcttgggtccaatggaggcagttggttgaagtagcaagatgttggcctttctggttttctcttttgctgtggcttcctcactgaccttggacttttataagtatgatacaaatctacacttgaataagtatgactgttactcatacttgaacttatctcattgcacctcttctcagcagctcttcatttgagaaaatattttttcagatcatagactaaaaaatcataccatcaaggtggcggcaccaggtgccaggaggaaaagggtacttgctgtgtatcctgggtcagtaatattgaaaactgtcttcttcagcttcctgtccttctatgtgttgtgtctcttgtgacagttgttttgtcttcaagccactgacttctggaatttgcagattttgcaatccatgcaaatgtgaagaaaagctctatgttactgaccattgttgttgttgtttatagtgcaaagtaaaaatagc

SEQ ID NO: 962 - DNA, 2569 bp, Homo sapiens
atttttagcttctctgaggtgtgttcaccggatcagagatagcagagcgccgagttggggccacgaaggcgtgaggggagtcgtcgtccctcctgcacgaaagcgtctaagccttggcgacgccgccctgggggacccacgtcaggcctgggatagggaccgctgtccccgggtccctaccaatgtcgcccgtcgctcccggcccagctctacccgcagagtctgatggcagtggccactctgaggacgccaactcagggcactgtgacctttgaagatgtggccgtacacttctcctgggaggaatggggtctccttgatgaggctcaaagatgcctgtaccgtgatgtgatgctggagaacttggctcttttaacctctctagatgttcatcatcagaagcagcaccttggagaaaaacatttcagaagcaatgtgggcagagccttgtttgtgaagacctgcacattccatgtgtcaggggagccttccacctgcagagaagttgggaaggacttcctggccaagttgggatttctccatcaacaggctgctcacactggggagcaatcaaatagcaaaagcgacggtggggccatcagtcacagaggaaaaactcattacaactgtggagaacacacaaaagcattcagcggtaaacacacacttgttcagcagcagagaaccctcactacagaaagatgttacatatgcagtgaatgtgggaaatcctttagcaaaagctacagtctcaatgaccattggagacttcacactggagaaaagccttatgaatgtcgagagtgtgggaagtcctttaggcaaagctctagtctcattcagcaccggagagttcacactgcagtacgacctcatgaatgtgatgaatgtggaaaattatttagcaacaagtctaacctcattaaacatcggagagttcacactggggaaaggccatatgagtgcagtgaatgtgggaaatcctttagccaaaggtctgcactccttcaacatcggggagttcacactggggagaggccttatgagtgcagtgaatgtgggaagttttttacatatcattccagtctcataaaacaccagaaagttcacattggatccaggccttatgagtgcagcgaatgtgggaagtcatttagccaaaactctagcctcattgaacaccatagggttcacactggagaaaggccttataagtgcagcgaatgtgggaaatcctttagccaaaggtctgcactccttcaacatcggggagttcacactggggagaggccttatgagtgcagtgaatgtgggaagttctttccctacagctccagtctccgaaaacaccagagagttcacactggatcaagaccctatgagtgcagtgaatgtgggaaatcctttactcaaaattccggcctcattaagcacaggagggttcacactggggagaagccttatgagtgcacggaatgtgggaaatcctttagccataactccagccttattaaacatcagagaattcatagtcgataaaagccttatgagtggcaaatgtggaaaatctgttagcaccctggagaaagtccttgagtacacagtgaatgtcagaaagcttcagctgaaggccatatctcattgagtgccacacagttcacaagggaaagacacttttgatatgtagggatgtccagttgatataacagctctgaaggagatcccttatgagggtggcatcagcctgaattgaacatcctatatctgaacatctgcataaattccaggtatgtgtgaactgcattgcaccttttgccctgcccagggcccatgtcagatttatgtctctgctgatactatagtgtaagccattttacctctactgcctggcaggtgaccaccagtgtgcaccactcacccatcccagtgtattcaggccatggacctgacccagtttggcccagaggactctgctggtgacctgaaaagagggactacatatttcaggatattgttggtctcacatgactcttgatagagtttgccagccttcaaatcaccaactgtgggaaccaactgcctcttattgccttgctgtgttcaattacaaaaaaagatggaaaagactgttatgaagccagatgaacctttctccagtcttccttcactatttttttttccttcaccatttatcatttcatagtcatttatgtttcatcggtcctcatgtgtactagtgcgttattttacttatactcccggatatcatattatttaatgcatagcctcttcagaatgcaattttaaaatgtaaaggctcttttataaccccccaaaaaatcacacaaatatattttaaaatgtaaatattttatcgcttctgttttctcagttgtctaaaacaatgtgtttcttaaggaagatcatttttattcaggatccaaatgtatatttaatagctttcagtagttgtatctcataagtctgtaacctacaggttccatttacctttgttttcttatttcttgaagttgctgagtcattttttaattagaatttgctgtattct

SEQ ID NO: 963 - DNA, 4150 bp, Homo sapiens
agagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccgatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacattcccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgtt

SEQ ID NO: 964 - DNA, 3361 bp, Homo sapiens
aacatcgagaaggagagggaacgatgactacaaacaagatggccttctcccccgacccgacctccttcccaggcactcacacgccctcctgtccacaaccctccgcgtgtgtggtacctgacgggagtcgcagtccatctgctgccttcccgctgccatttctactcgtcaggaacaatggaaaggtgaaaaggaaagaggactacaagcaagatggcggaagagggacatacacctgactagtagtcgatcttacgaggtgcgatgggattagtagttttatagccttccagtgttccttaagaatggcggaaccaggaggacgaggagactaccgtaaagatggcaggctacctagcctctcccggtctccgctttccaccaccttgggcacctcgcccgcctgtggtctcgaaatcccccccaccagtggcgcacggcctgacgggagttgcagtctcccggctcccgtctatcatctcaagtcgagacaatggaaggggatggggcggggccaccggcaaagatggcggctgcagggccggggcgactgcgacatgggatgtgtagtccaggcgtctggcctcttccctgcggaaatgagggagaggactacgaaaaagatggcgacctcgcccctcgacctctgcgccggtgcctgctgggaaatgtagttccttgccgagtccaacagagaaaggacgtcgctgttgaaatgtgaatcccggcggacacgccaaattgcgaggcgacggaaacggaaagactcttttctcctctctccgccaccggcttctgaacagcctggcgggaaatgtagtcccaagctttcactcgcgagtggaggggaaggatttatgtcaccagtggggatcagtgcgggtgggggagaaaaacgtcgggcgatccgggaataaagaatgtccgcctctccatggggcgaggacttcgcgtttcaggggagggcccttaaaggaaggcagcaggaatcagtcttgtcaaacaggggggcgtggttctcgtcgagagtgcattcacactcttgttccctagaaagcctgggcacctcccactcgattcctgctcctcagacctccgggaatcagtgtcttacaagacgtgcgggctccggggagaaggacctggagtcacagcgaatccccgccccgccccgggaagccaccaaaccttgctttttctcatctgcaaaatggggacaatggggataatgatccccacctcgaagcacagttgtgagtgttaaacaagccaatgttcttgtcaccaaagtgcccaactctggcacggggcacgcggtggtagatccctttctaaggtcccttccagcccagccgttctgggagcccaggaatccatgatgccggacagagttcgctcctgtgagaagaaaactgacccgcaggctcctcccagattgaaccgacccccgcccctcctcatcggggtcctccagcgtctgttaccgagcactgctcccagggggcgctcaatctccattcgactgaggtactacaaacacgatttccgcaacctggagttggaggcattgcaggctgtccagcctcatcccctgcctgatatccagtcagccttggaggcctctgcctagacacttcaactgcctatgcaaatggaacggcttctcatctttctgccgttttttggttttttttgtgtgtgttttaaggtcttgctctgtcacttgggttggagtgcagttgcaggatcatagtttgctgcggcctcgacctcctgggcttaagcgatcctcctccctcagccttgtgaatacctgggacttcaggcacgcgccactacacccagctaatttttaaactataatttttttttgttcagacgaagtctcgctatgttgcccaggctggtctcgaactcctggccacaagtgtgcctcccgccttggcctccctaagtgttgggattataggtgtgagccagcagccatacccctcttctcaatcttccttctcccctggaaaacctgctcacttctgaccccaagacagccccctccccttccctctgtcttctgtgtttggcagaccagccccagcgaggacttgttggttgtggtttttctatcagggaagtcaatggctggccagtgtagtgtgaagtcccagcttggcagagacttgcccaaggctggataggaggcttctttgccgctcaggctttatcagtcaggaaatccttagccctccctagaggattggctgtcccctctatcctcactgcttgaatttggtgttgcatgattgatttctaccctgttccctctgcttgagggctatcctccccatgcccatctcacttctccaccaagttcactgttcatcatttacaggtctctatttatgtatttattatttatttttctactttcccacttttctaaaaggtctctatttaaatgccactgtcaatcccggcactttgggaggcctaggcgggcgtatcatgaagtcaggagttcgagaccagcaatggccagtatggtgaaaccctgtctctcctaaaaatacaaaaattggccgggcatggtggaatgtgcctgtaatcccacctactcgagaggctgaggcagcagaattgcttgaacccgggaggtggaggttacagtgagctgagatcgtgccactgcactccatcctggacgacagagtgagactctgtctcaaaccaatcaatcaatcaatcaatcactgtcctggccagttgcagtggctcacgcctataatcccaacacttcgggaggccaaggtgagaggataacttgaaactaggagttcaagaccagccaaggcaacatagtgaggccccatctttacaaaaatacaaaaattagctggacgtgtagtcccagctacttaggaggctgaggggcaaggattgcttgaggctgagagattgagcctgcagtgagctatgacgatgccactcgctgcattcaagtctagatgacagagcaagaccctgctcctggacatactactaagtgctttcagcatttcatgtggtcctcataaaaatcttgagggccgggcatggtggctcacgcctgtaatctcagcactttgggaggccaaggcaggtgggtcacctggggtcaggagttcgagaccagcctgaccaatatggtgaaaccccatctctactaaaaatagaaaaattagccaggtgtagtggtgtgcacctgtagtcccagctcttcaggaggctgagaaaagagaattgtttgaacctggaaggcggaggttgcagtgagccaagatcacagcactgcactgctgcctgggcgacagcgagactctatctc

SEQ ID NO: 965 - DNA, 3656 bp, Homo sapiens
tttaaaaatgtactccgttctccaactcctgaaatgcctctgcagttgctggagaaaagggcccgaaggtcgccgttttcaaacagaagctgccgtgtgtgcgcgcccggcatggtctcctcatcccgccggggccagtgaggctctgggggctttgcccccgccgcggcagctggtagagaagagacgtgtttcacctccccgacgtctggaccagtctggaagggatggaggcgctgtggccaagtgcagtctctctcggggtctctccccgcccgggtggacagggcgctccctcctccgcccctggggctcagcagcagtcctgggcagccgtgcggccctcgcctgcgtcctgcggccgtcccgcggtgtcatgccggcaacaatacaaagtcgtcgttgacgtcgaccatgggcacgtagaaggagggcacctcgttcacgcacagggacttgtgcccggcggggtccagttcctgcaccttcagctgccactccatcctctgcacggcgttcagggccgcggcctcgtgctgctgccgcatgaggaggaaagtcttccatgtgtctttatgaagctttcagttttttctcacggctctggttaggaagggcctagtggcctggggagggtgtggtgtgagtgacttcctgcaccatcatcttagggctggccagaaatgcacactcagctacgcctcagacctgagttcctcagcacaagcccccaggggccacgctccccaaatacccacagctcccaccgggtagggctggtggttctcatctgtgcccacatcagcacctttctgagagctgcagtatgacacacgggtgcttggttcagggacctgggtggtgctgagcctgatactgcaggtagccggggccgcctgctcccaggcctggctggtgactgtacagggtgacgctgactgtaaagttctgtaacttggcaagtttccgccttccgttgcctcctggtggatcctccagggtgtcccggtgagcagccctcgcgaccgggataagggtgtgctgcccttcccggcacctcccccgcccctgcccaccgccctggccagcacttccagagcagtggagggtgaatgctgggaccttagagggggctcacagggcagtcccaggagttctgaccatcaagcctagggtcctgttgagctggcgacaggagccgctccctgcacaccgggacagaagggaagactgaggaggccacacgcagggacaggacctcacctccccgaaggcatcggccagattaagagaatctgaaattgtcaccgcccatcacagaactgggcagcggcctccccccaggcagcgcaaagggggttgtcaccacccatcacagaactgggcagcagcctcccccaggcagaactgaggggacgcgcaacaccgaccttcatgcggtcatacttgtcatccacgtcctggagccaggagatgaactggcgggcgttgaaacggtcgcgcactgacttgttctcgtcaccctgtggaaaccaaacacgggagtttcatcaggagccccagagaccgctacgggaaggcatgccagcctgggcgatgctgcagtgaccgttctcaagggacaaccacagggggagcctcattccaccgcgcacacactgaatcatgttcaaggcatggcaggcgcaccctgcccatctccctaaacagcctccctaaaatgcgcgtggaggcagctgggcctttgtctcctgggcaccgggtgcccgcaggccccacctgtgagccggtccccagccctgcccccaggggacagtcagagctcagcccactgccaactcctgggagagactttttttttttttttaagggacggagtttcgcttgttgcccaggctggagtgcaatggcgcgatcctggctcaccgcagcctccacctccagggttcaggcgattctcctgcttcagccttcctgagtagctgggattacaggcagccaccacgcccagctgattttgtatttttagtagagacggggtttctcctgggcgagacttctagatgtcaccgtcctgtgtcctgaagggtggacacggataagatgtccaggctcctcccctttttcacgggttcatggtgaagctgacaatgccgtctgtttctcagaacatgtggagcaccgacagaaacccacacacctgcagggaactcactttccacaaaggtgccaagaacagaataacgatcacagggaaaggacagtctcttccgtaaacagtgctgggaaaactggctacgcatcgcagaagagtgaaacgagaccctagctctcgtcacatacaaacatcaaaccaaaatggatcaaagtctggaatccaagaccttaaacgatgaaaccactacaagaaaacactggggaaaatctccaggacattggcctgggcaaacatttctcaagcaataccccgaagcacaggcaaccaaagcaaaaatggacaaatgggatcacatcaagttcaaaagcttctgtccagcaaaggacacagtcaacagggtgaaaagacacgcacagaatgggaggaaacgcctgcaaaccgctcctgtcacacagattcacaagcagaacatagaaggcatgcaattaactcgatatgaaaaaatctaataatcccatcaaaaaaacgggcaaaagatctgaatagacgtttctcaaaggagacacacaaatggccaacaggcatctgaagaggagctcaacatcattgatcgtcagagaaatgcaatacaaaactaccgtgagacatcacttcaccccggttaaaatagcctttatccaaaagacagacaatcacaattgctcgcgaggatgtggggaaaagggaaccctcgtaccccgttggtgggaatgtaaattaaaacagccgctgtggagaacagtttggcgtttcctcaaaaaaaactaaaaattgagctaccataggatccagcaatcccactgccgggtatagacccaaaagaaagaaactgggggccaggcacggtggctcacgcctgtaatcccagcactttgggaggctgaggcgggcagatcacctgaggtcaagagtttcagactagccttgccaacatggtgaaaccccatctctactgaaaatacaaaaattagccaggtgtggtggtgcgcgcctgtgatcccagctacccgggaggcagtggctgcagtgagctgagatcgtgccactgctctccagcctgggtgacagaggaagactcagaatcacaaaaaggaaaaggaatcagtatattgaaacggtgtccacactcccatatttaacgcaaccccatttactatagctaaggcttgtgtccatcaacagatgaatggataaagaatatgtgctacatacacaacggagtactattcagccacaaaaaagaatgagatcctgtcatttgcaaacacgtggatggaactggggtcatgatgttaagtgaaataagcatacaaagacaaacatcacatgttctctctcacttgtgggatctaaaaatcagaacaattgagctcatggacacagagtagaacgacggttaccagaggctgggaagggttgtggggggctggcagggaggtagaagtggttaatgggtacc

SEQ ID NO: 966 - DNA, 2998 bp, Homo sapiens
agctgacttgctccctcccgggctgcggctgctgcaaaagccagcagcggcagcgggagctgtccggaggccggcgtcgaggtgagacccgggcagactgaggctgcggggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagctggcaggtcctggggtggaggggggtgaaggcacccagaaacctcgggactacatcatccttgccatcctgtcctgcttctgccccatgtggcctgtcaacatcgtggccttcgcttatgctgtcatggtgagccccatgggaccctagcccaggcctgctgtggctcccagcttcccgccagcgctgcaatagagcctctggaataatcatgccttccttcccctctcctctctgcatggatcccacctccccaattccagggcctttgtttgcctctccctaggacctaaccctctgagccaccactgccctgcccctttgggtgggagggatatggaaacacgtgtcacacagcctcgctgacctgtgccctcctccccctgccccttcactcctccttcctcccttacccgccatctatggggctggcctctctctcttctggatgacttttccacctgatcccttctgggctggcttctcctgaccccggctatgtgcctccacccctcgccctaaccccagtcccggaacagcctgcagcagggggacgtggacggggcccagcgtctgggccgggtagccaagctcttaagcatcgtggcgctggtggggggagtcctcatcatcatcgcctcctgcgtcatcaacttaggcggtgagtgggggcttgggacaggcaggggaggaatggaagggttggcaagggcagctttactaacccctgcccctgctctctcctgtctgtcctccttacctctcctttgtctctccttgtctccccctccccccgtctgtccttccctctcctctcccacagtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaactgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaagtctgggggaagaaaaaaactaaaattcttaaaaaaaaaaaaaaaggctattatcaaactgatttctccctttttgtatgccggatgctgcatgagtctgaaacaccaataaacggagactgcatgag

SEQ ID NO: 967 - DNA, 3026 bp, Homo sapiens
agattgcgccagggaaaggccttatcgctgtgtgtgtgtttcagtctacgtggattaaacattacttcgctccgtctgcctggattaaacgtgcactttgcagtcctcacttctccgtaccagtgatctggggatcgctacggaccttaaaatacccatagccccttcgcccctgcaacaggcacttctccccacgtttgatgtgtgaataattacattgactgagaaagaaacccagaagaggaagaagaggaaggaaaaggagtcagtgatggctactcaggggcatttgacattcaaggatgtagccatagaattctctcaggaggagtggaaatgcctggagcctgtgcagaaagctttgtacaaggatgtgatgttggagaactataggaacctggtcttcctaggtatctctcctaaatgtgtgatcaaggaattaccaccaacagagaacagtaatacaggagaaaggttccaaacagtggcactggaaagacatcaaagctatgatattgaaaatttatacttcagggaaatacagaaacatctacatgaccttgaatttcaatggaaagatggtgaaacaaatgataaagaagtgccagtgccccatgaaaacaatcttactggtaaaagagatcaacatagtcaaggggatgtagaaaacaatcatattgaaaaccagcttacatcaaactttgagtcacgtctggctgaactgcagaaagttcaaactgaagggagactttatgaatgtaatgaaacggagaagacaggtaataatggttgtttagtttctccacacattagggaaaaaacgtatgtatgtaatgaatgtggcaaagcctttaaagcgtcttccagccttattaatcatcagaggatacatactacagagaaaccttacaaatgcaatgagtgtggcaaagcctttcatcgggcctcactactaactgtacacaaggtagtccatacaagagggaaatcatatcaatgtgatgtatgtggcaagatcttcagaaaaaattcatattttgtaagacaccaaaggagtcacactggacagaaaccctacatatgtaatgaatgtggcaagtcctttagtaaaagttcccaccttgcagttcatcagagaattcataccggtgaaaaaccttacaaatgtaatctgtgtgggaaatcctttagtcagcgtgtccatcttagacttcatcagacagttcatactggagagagacccttcaaatgtaatgagtgtggcaaaacctttaaacggagctcaaacctcactgtacatcaggtaatccatgcaggaaagaaaccatataaatgtgatgtatgtggcaaggcattcagacatagatcaaatcttgtatgtcaccggagaatccacagtggagagaaacaatacaaatgcaatgaatgtggcaaggtcttcagtaaacgttcaagtcttgcagtgcatcgacgaattcacactgtagagaaaccttgcaaatgcaatgaatgtggcaaggtcttcagtaaacgttcaagtcttgcagtgcatcagagaattcatactggacagaaaacttacaaatgcaataaatgtggcaaggtgtacagtaagcattcacatcttgcagtgcattggagaattcataccggcgagaaagcttataaatgcaatgaatgtggcaaagttttcagcatacattcacgacttgcagctcatcagagaattcatactggagagaaaccttacaaatgcaatgaatgtggcaaggtcttcagtcaacattcacgtcttgcagtgcatcggagaattcatactggagagaaaccttacaaatgcaaagaatgtggcaaggtcttcagtgaccgttcagcttttgcaaggcatcggagaattcatactggagagaagccttacaaatgcaaagaatgtggcaaggtcttcagtcaatgttcacgtcttacagtgcatcggagaattcatagtggagagaaaccttacaaatgcaatgaatgcggcaaggtctacagtcagtattcacatcttgtagggcatcgaagagttcatactggagagaaaccatacaaatgtcatgaatgtggcaaagcctttaatcagggctccacactcaatagacatcagagaattcataccggagagaaaccttacaaatgcaatcagtgtgggaattcctttagtcagcgtgtccatcttagacttcatcagactgttcatactggagacagaccttacaaatgtaatgagtgtggcaaaacctttaaacggagctcaaacctcactgcacatcagataattcatgcaggaaagaaaccatataaatgtgatgaatgtggcaaggtattcaggcatagttcacatcttgtaagtcaccagagaatccacactggagagaaaagatacaaatgtattgaatgtggcaaagcctttgggcggttgttttccctcagcaaacaccaaagaattcattctggcaaaaaaccttataaatgtaatgagtgtgggaaatcttttatttgtcgctcaggcctcactaaacatcgaataagacatactggagagagccttacaactaaactcaatgtgacaaggccttagacgttgtcctagtttctggaatcaccgaataattcctacttactgatataccttgtatatttaccccttctcttgaaatccctgtggaattgtaatctccagtattggaggtggggcccattgggaggtgattgaatcatggaagtggatttctcaaactgagaaagatgtagcgtcatccccttggtgctgtcctggcaatagtgacttctcttgaggtctggctgtttagaagtgcatagcacttccctgtcgcttgccctcattctcaccatgtgaaataccgacacccgctttgccttccaccatgattttaaccttcctgaggcttccctagagggtgatcagatgccagcaccatgttttcatttaagccttcagaaatatgagccaattaaactcttttctt

SEQ ID NO: 968 - DNA, 3211 bp, Homo sapiens
gagctagcggcgagcgcggcgagcaacggagaggagcgcgagcagcagcatggcggggctccgacgcccgcagcccggctgctactgccgcaccgcggcggccgtgaacctcctgctgggcgtcttccaggtcctgctgccctgctgtcgcccgggaggggctcagggacaagcgattgagccgttgccgaacgtggtggagctgtggcaggcagaagaaggggaactcctgctgcccactcagggtgattctgaagagggtctggaggagccttctcaagaacagagcttctcggacaaactatttagtggaaaaggcttacattttcagccatcagttttagattttggaatacagttcctgggacatcctgtagcaaagattctccatgcttacaaccctagtagggacagcgaggttgtggtgaattcagtgtttgcagctgctggacatttccatgtaccgccagttccctgcagggtaattccagcaatggggaaaacttccttcagaattattttcttacctactgaagaaggaagcattgaaagttccttatctattaatacctcttcgtatggagtcctttcctatcatgtatctggaattggcactcgtagaatctctacagaagggtctgcaaagcagctaccaaatgcttattttctgcttccaaaggtccagagcattcagctgtctcaaatgcaggcagaaaccactaatactagcctcttgcaggtgcaactggaatgcagtttacataataaagtgtgtcagcaattaaagggttgttatctggaatctgatgatgttttgcgtctacaaatgagcataatggtaacaatggaaaacttttcaaaagaatttgaagaaaacacacaacatttgttagatcatctctctattgtttacgtagctacagatgaatctgagacctcagatgattcagcagtaaatatgtatatattacattcaggaaacagccttatatggatacaggatatacgccatttctcacagagagatgctctgtctctgcagtttgaaccagtactactacctacttctacaacaaactttacaaaaattgcttcttttacctgcaaagcagctacatcatgtgacagtggaattatagaagatgtgaagaaaacaacacacactccaacactaaaagcatgcctcttctcttctgtggctcaggggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggaagggagtctgggttttgaagtgatagcacattgtggcatgcattatttcatgggaaaatcaaaagcaggaaatcctaattggaatgggagcctttctctggatcaatctacctggaatgtggattctgaacttgcaaataaattgtatgaaagatggaagaaatataaaaatggtgacgtctgcaagaggaatgttttgggaacaactcgatttgctcacttgaagaaatccaaggagtcagagtcctttgttttctttttgcctcgtttgatcgcagagcctggcctcatgttaaacttcagcgcaactgcccttaggagcaggatgatcaagtactttgtggtgcagaacccgtcctcttggccggtctccttgcagctcctgcctctctccttgtaccctaaacccgaagccctagtgcacctgctccacagatggtttggcactgatatgcagatgattaatttcacaactggtgaattccagctcaccgaagcttgcccttacctgggtacgcattctgaggaatccaggtttggcatcctccacttacatctgcagcctttggaaatgaaaagggttggcgtagttttcacacctgctgactatggaaaagttacctcactcatactaatccggaataacttgactgttattgacatgattggcgtggaaggatttggagcaagagagttattaaaagtgggtggaagacttcctggtgcaggaggctcactccgatttaaggtgcccgagtccacgctgatggactgccgtagacaactgaaagacagtaagcaaattttatctattacaaagaactttaaagttgagaatattggacctcttcctataactgtttcgtctctgaaaattaatgggtataactgccaaggttatggattcgaggtgctggattgtcatcagttttccctggacccaaacacatcccgcgatatcagcattgtgttcactccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactg

SEQ ID NO: 969 - DNA, 2477 bp, Homo sapiens
aagtggagagaaatatcaggttgacagcgacctagctgaaagacaaaaagggcaggttacaacaggtgacagagacagcaacaggggatgctgaatgttttacttaaacagaagatcagcgaagtccaggcgcagtctttctcccagctcggctcgtcaggcctcaggcattggtggctcgaacccgaggtcgtcaagccgcgcccaccctacgccccgaaaggccagcggacggacgggggcgggatctctaagcgctgtggccggcggagctccgccgccgcgagggtgaccttgggcgagaagctgccccaaaggcctcggtatcgcggtctgcgcgccgtgtgggcagaagactgcgggattcggagctggagcgccgggaccccaacctcccgcgcggggctttggtatgccggtccacggaatgggcctggcggggccagcggcgcgagcgtcggggcctgctgaggagcccttaactcccccaccgacttctcctcccctacccttgccgcccgtggtcctggccacgcagtacctgccaagggctcagcgctcacatcccccgcccaagatatcctctctgccgccggcgcaggcctgttgcagcctcagctgccgcaacagattcagcctgtgccttcagcccccggaaacgcttcccggtcccgccccccgaaactgacagtgcttccgggggtgcgtcagagagaaagcggagtgcgcatgcgggacttaccgtctgagctgggcgtcgggagagagcgcggaggtagcgggcgcctgcgcagtacactctggagcgggtcaattttagggactgactacgctgttgaaaataggggagcagatactgagttctaaaccttcttgaaaccttggcataggccaggcgcggtagcccacgtctgtaatccctgcactttgggaggccgagaggggatgatcgcttgaggctaggagttcgagaccatcctggccaacatggtgaaaccctgtctctacaaaacatacaaaaattagctgagcgtggttgcgcgcgcctgtaatcccagctacttgggaagctgagacaggagaattgcctgaacccgtgaggcagaggttgcagtgagccgagatcacgccgctgcactccagcctgagcacagagcaagactcttaaacaacaacaacaacaacaaaacaaacaaaaacaccttgaccttctccgtctcttctctaaacaaacgaacgaaaaccttgacctcagtatgcctggcggagattatctccaaatccgtttctgccttcacagcacccatctcgctttttggcatgtagtagatgctcagtaaatggtcaatgaaaggaccagtgcctttccgtgggctgcattgtgctgggcactggggtcacacagatggtgggacagaaacgatctctctagcctccaattctcccactccctcccaaaacctccatacctcttctcgcccctttcttccccactgcccccccatgttagtgtagaagagagataggtctttagcggtgggactcttacctttggacccgtttacagaccaagtgccctctttgtagaagaactaatttatacctgaaatccaggcagctgaagcgatgtggtcataatgccttctggatttagggtggatgttctcgtggggcctgacatgcctgtttgatattgtctgtctcagtttaagctgattggtttcccagctgttatgcctgtcttgcttgttgttgggccctaggacacaggagtgtagctttcctagagaattctaccaaaaaaatttttttttctagaaaacaaaatgaaagaaaacaaatatggaagcacagaaatgggagtggatgcagaacagcttgtcaaagattctacttcaaacatgtatgctccagctcccccgccttgtggttttgttttgttttgttttgttttttttttggagacgaattcttgctctgttgcccaggctggaatgcagtggcacaatcttggctcactgcaacctccgcctcccaggttcaaacgattctcctgcctcagcctcccgagtagctgagactacaggtgcatgccaccatgcctggctaatttttgtatttttagtagagacggggtttcaccatcttggccaggctggtctcaaactcctgacctcatgatccaaccgcctcggcctcccaaagtgctgggattacaggcgtgagcaactgcacccagcctagttgagtatactctttaagtgttttgccacttttattcctgcctctaagcagacctgaagtttggaagttcaactgccatcatgtgcctatgaagtggtaagtaaatgctaaggctggcaaagcaggaagattgagagaacctaggtcccatatgacattaggccacagttccagctttggacacccttaagtgttttgttgcatgagccaaataaacttcttacttggacttt

SEQ ID NO: 970 - DNA, 2361 bp, Homo sapiens
tgcctcccatagcctcttgcttttctacgttagtgtcacatgttatgtgatcgcacccggactgttcatatgttaagcacacatactttagatgtgtgctccctgttatctacattgcctggaccttgttcttggctctggcctttcctacttgtctttaacatggacactcatgagtcatcctccaggacgaccagtgcatcctcaagctctgctccttcagggccagtgacttgctgggcttcgtgttcatgctggccatgcatgtcatctatgcaagcgtttccattgccactgcagaatgaagccagtgcacatggtattagtcatcagccagaacttcctgttctgtgggtctggggtcaccagctgagatgtcacctgctttatttctggctttggcctgtggtctgtgatacccatcctgcttgatgttctgcagaatggcacttgactgctgggcatgcatgaagttaagggcaagaaacagtatgccatgtgttcggtaccatcatgtgtcccttcttgcttctgggcccttctactggtgaactttcatcaagatctgcgccatgccgtgtcactatcaagccattaagttttgtctgggttgctgtcagccccagttggcttcctggtcaacaaggacctcaagaactgcctgtggaccgaggccccctaccagtgcatgagacacacacctaccctccccagctttccaggaaccctactggctgccagactgatgggcgggctggtatgtgtggacatgtgttcactgtcattatgctgtggctccaggtgagggtgaggactgggcctatatagaatccagataccattgtcaacttcccttattcccgtctaagatgtgagcagagtgccatagtaggggttctgggaagaggtatttctgatttgtgggcctctgcttgcttgacttcaggtcacttatacttcttattttgcttgcctgccttcatccctcatttcctccctctcattcttctttcctccctccctttcctggtagcctcctttcctccccttctgccttctccttccttctttccttattcttttttattttgtttaaatagtaccacagagaaaacaactgaaaaaccacatttttctacatacagctggggaggtagctgagaacttggcactgcgcacacatactaggttgaaagagagttgaggaaaccagaaggccaagtggatctgctggcaaaccctgaacctgtctcctgcgcttgctctacagttctgaagttgaaaatccttttcatgcctagcatctgcttgagttataaaccccaaggcagccatgtcatagactagtgtttactcttgttttgactttgttttaatgcttcctaagacccaagtgcctcctgctgtttcctcctttgtggtagcctctggccatctggacctcaatccccagctttcccactttcagcagtcctttgctctctttgcttctacctcaaatagccccaggagtgggctttagtctccaatatggagcatctcaagcttctcctgggggatggggattgggatgggcagaatctgttttggatctccgggttatttccagtgggtgtaaaagcagagctgggcctttccctctcttatccctgagggtgggtaagaaggactgtatctacacctgttcttccctaccttctcttttgttagggaggcctcattctaagttcctcaagagagtccttggcttaaagctgtagcaagggtgtgctaggtgggggatttggagcaaaaccgtcgagtaggcatgatactggtatggagtgggcctgcaaaatcagacagaaatggcttgagaagccgcagggggagcatgcctgtctctcagtgatagagtatgggagggacctccctagcttggaaaatgagaattgaaggggttatgaacaaataggatgcctagttgaggatgttcccaaagttttgtccaatcttatcattagtagattttataagccacagagacaaaccagaaacggaataatgttactttggatgctttatttttttgttctaggtgtggctttgtacatgcagaagaatgctatatgctgcacattttgcctttaaagtcttacgactttccccattttagtctaatgggaagatacagatgtgcaagtctgcttttttgttctgtgaaaataacctccccaaaataattagtaactggttgttctacttggtaatttgacaccctgttaataacgcaattatttctgtgttcttaaacagtataaatagttgtaagtttgcatgcatgatggaaaaataaaaacctgtatctctgttatatttctg

SEQ ID NO: 971 - DNA, 2922 bp, Homo sapiens
acagcaaggttatgcagacaactcttgcgataaacaacagagggcaagaaaattggatgcagaaattgtggctgcagagaagaagaaacagattgttgcagagcaagtgatgatagaccacttatctagggctgtcatcagtgatccagagcaaaatttagccattgagcaaaaagaaagtgatcatatccttccagattcaaagatgacacctcttcgatttagaaaaagaacactacatgaaacaaagataagaactcattctacattaactgaaaatgtgctttctcataaattacagtttgatggtaggatcgtatcacgtaatggacgtgatgcttgcagagagctcattgggttctttttcactcatgaccaatcccttacaatttatgaatatcgacaatttgggaaaaatagaacaaatgtgcttccttttattcaaaaaagcatttatagtcatcagtgtggacgaagaaaaggaaaacaataccgacttggtgatttttatgttggtgcaaccttgacatttttgagttctgatcatctcagccttccagaaagcatcaaagaaaacacattacttaaactccgaatcacaaatattgatcaaatagctttggattctctcaaaactgcttctatggaacaggaggatgatataatcattcaagaaaccaatgataggctggtcttcaaagcaattcaagatgtgctaaaagaaaaactacataaaagaggtgttcgtattttgactggattgggaaaatattttcaacagttggacaaggaaggaaatggacttttagataaggcagattttaagcaagctctaaaagtgtttcacttagaagtgtctgaaaaggattttgggtctgcatggctaattctgaatgacaatggcaatggcaaggttgattatggagaattcaaacgtggtattattggtgaaatgaatgaatacaggaaatcatatgttcgaaaggcctttatgaaactggatttcaacaaaagtggcagtgtgcctattataaacataagaaaatgttactgtgcaaagaagcattctcaagtaatttcaggccattcaacagaggaagaaatcaaatcatcctttctagaaacattaaaagttgcctgcagcaagtctgatgaagtgtcatatggtgaatttgaagattactatgaaggtttaagtataggaatagtagatgatgaagactttgttaacatcttacgtactccatgggggatttagtctttaataatacatatgtcatcaacactaagcattttattggagagatgatatcaatgtaaaggatgatcaaacactggaatatattttcctaggacttcctttattctggtttcttgtttgtttgttttgttttgttttgttttctcaaaaatgttgaatttggaaagagaactatccagaaagatagatgtaggggtgtgttagtgtttgtgcatgtgtatgcctgttcacatgtccttacatttgtaaagatatctttttggtttattacttatcttgcgtatattttagaggtcattttttattaacttcagtaggaaagttacatctgcatcaaacaatatggcaacatctatttattaaccaagtttcctgtcctttcacattgttttttgctacctcttcctcagaatatatttgccaccatggtcaatttgataaattagaattgggcccaaagccagtgagataattcaatgtgtttttaacacatgaaaatattaaaggatatgcaagagaaatttttcaagcagtgtgattatagatgttttctgtatatagaatatttcaaatgatggaggtttaccccatgatgctcatttaaatactgacttgtcttttaaatctgtcttctaaattatgtactgttgttggttaaatagagcacaatgtagttattctaatgcccagttgtatttgttcttttattctgctttttaactgtaatcctttttaccagcatacgattgttattgagcaatatgaaagggaaatgttctttattaaaatcaatacattatcttattaaacaaagatcctaaaagtatattgttgcatatatgaatccaaggaatagttcagtaattattgcctaaaatgtgaaagcatattttgtatcctaaaatgaatgtatgatattctaaacatctgttttagtataacaaacaattgaaacatttccttctaaatatatgttatttaatagttacatgtattataatcattctttctaaattctttgctagtcatttcttcctgggaatacagagaaaagagacaactttatgagttgttttcaacttcataattttaaattttctatgttaatataacataaattagaaaaaataagtgattcaaaatgaaaatatttactttgtagaatatgactttagacatatcactgtatccatctatacttggcagcaacatgagaagtgtgatacatgtgaacccaacaaattcaaagttgcacttttcaagatgtgagaaggtactaaaacttaatactaaaacatgagagggaaaatatgtgtaaacctctagtgctattttcactggctaaattctttatttcttgatttttttaaaaattaggttattaaaattaaaacaatatgctagaagacattttggcagaaataagtctataacactatttttgtcacatatctttttcttggaaaaatttatccaactatagacatcttaaaccctacaaattgttcttgttaaaaatgactaatactgggggtgctcaatatgcatatagtgtttttcattgataatttttatttagttcttaagaaacctgttcttaatgttggcatgtcacatttttctgttactataatcagaaaatgtatagtctgttatactgt

SEQ ID NO: 972 - DNA, 2410 bp, Homo sapiens
actccacataccaccagcaccgctaatacccctgtagaaggagctctccaggatgaagctccagactgggttgtagggggctcagacaaaagagaaactgcccgtcttcaagaaccttcaatctaatggggagacaggtgaaccctcgcccccgtgggaactgccagttggatagggaagaagggacacagcagagagtcacagcacacaggaagactatgtcacactgccaggtgctgtgggaggacaaagacagtcagtgctgggggcatctggactgggtgtgggcccatgtgagcaggagcagtcagagaggcctccctgggggaggaggcattggagctgatctgggacggaagggacggatttggagaggacagcagaggcccttaactgcaacctgggcagagcagagggcctggccgcctctcagaatggcctccaccctggcccagggcaaggacccgcccatggagaaggccctgagcatgttttccgatgactttggcagcttcatgcggccccactcggagcccctggccttcccagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcaccgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacaggcagacaaaccctctgatctatgaagtctctgcagggcaaggggaccagggacctggaaccctcttggccaaggggagtgggagagacagagggaaggtcacaggcaagggtgcctatctaagtggaactaattgcccgagggctcagcaaggccaagaggagacagccgtgaaggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccacgtggggttgggtgtggggctggtccttctccctcccacaggcctgtgttcttggggctgctcccatgcagacaggatcacctaacagagatggaagccagggcatggatggggctttgggtcctcgaggttggaccccagcttcttgccaccttcccctccgggcagtcagctctccatccatccccctctttaatctatgaatctataggctcggtgtgtgtaacacacacacccctatcgttgtccttcaaatactcagcattaccattggttgaggccaaattcagagctttctcaaatcagatttacaatctccattttcattaacggggaaacatccccgagccactgagtgctgtgctttgtcactgaaggttagatctgaacccagggtgtcaacagctgctctcaactccccacctctgggcactgaggagtatttcccctcattctacctctctaaggctatgcacccctccccacgtcttccagctgggggatggggggagtcataggaaaagcccccatctcccatctgggatagggaccttccatcagccttaaccctgggaaatgcctgctgcccccagtgactcttggtttcgtctcccacatacagaagcagggtggaggggaagggtgggtctcagttagcaggggtccccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcac

SEQ ID NO: 973 - DNA, 1643 bp, Homo sapiens
acacagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttccggtcgatctctctcctctctgacctggatacgctttggtttctcaacttctctaccccaaagaaaagattattcaataaagtttcctgcctttctgcaaacat

SEQ ID NO: 974 - DNA, 3086 bp, Homo sapiens
gcggacgcgctgaccgagcgcagcggccgggccggcgggcgggcgggcggctgcgagcatggtcctggtgctgcaccacatcctcatcgctgttgtccaattcctcaggcggggccagcaggtcttcctcaagccggacgagccgccgccgccgccgcagccatgcgccgacagcctgcagccagcctggacccccttgcaaaggagccaggacccccagggagtagagacgaccgactggaggacgccttgctgagtctgggctctgtcatcgacatttcaggcctgcaacgtgctgtcaaggaggccctgtcagctgtgctcccccgagtggaaactgtctacacctacctactggatggtgagtcccagctggtgtgtgaggaccccccacatgagctgccccaggaggggaaagtccgggaggctatcatctcccagaagcggctgggctgcaatgggctgggcttctcagacctgccagggaagcccttggccaggctggtggctccactggctcctgatacccaagtgctggtcatgccgctagcggacaaggaggctggggccgtggcagctgtcatcttggtgcactgtggccagctgagtgataatgaggaatggagcctgcaggcggtggagaagcataccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggggaactctacgacctggatgcctcttccctgcagctcaaagtgctccaatacctgcagcaggagacccgggcatcccgctgctgcctcctgctggtgtcggaggacaatctccagctttcttgcaaggtcatcggagacaaagtgctcggggaagaggtcagctttcccttgacaggatgcctgggccaggtggtggaagacaagaagtccatccagctgaaggacctcacctccgaggatgtacaacagctgcagagcatgttgggctgtgagctgcaggccatgctctgtgtccctgtcatcagccgggccactgaccaggtggtggccttggcctgcgccttcaacaagctagaaggagacttgttcaccgacgaggacgagcatgtgatccagcactgcttccactacaccagcaccgtgctcaccagcaccctggccttccagaaggaacagaaactcaagtgtgagtgccaggctcttctccaagtggcaaagaacctcttcacccacctggatgacgtctctgtcctgctccaggagatcatcacggaggccagaaacctcagcaacgcagagatctgctctgtgttcctgctggatcagaatgagctggtggccaaggtgttcgacgggggcgtggtggatgatgagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccaggaggtcatcggtgtggccgagctggtgaacaagatcaatgggccatggttcagcaagttcgacgaggacctggcgacggccttctccatctactgcggcatcagcatcgcccattctctcctatacaaaaaagtgaatgaggctcagtatcgcagccacctggccaatgagatgatgatgtaccacatgaaggtctccgacgatgagtataccaaacttctccatgatgggatccagcctgtggctgccattgactccaattttgcaagtttcacctatacccctcgttccctgcccgaggatgacacgtccatggccatcctgagcatgctgcaggacatgaatttcatcaacaactacaaaattgactgcccgaccctggcccggttctgtttgatggtgaagaagggctaccgggatcccccctaccacaactggatgcacgccttttctgtctcccacttctgctacctgctctacaagaacctggagctcaccaactacctcgaggacatcgagatctttgccttgtttatttcctgcatgtgtcatgacctggaccacagaggcacaaacaactctttccaggtggcctcgaaatctgtgctggctgcgctctacagctctgagggctccgtcatggagaggcaccactttgctcaggccatcgccatcctcaacacccacggctgcaacatctttgatcatttccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctccgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctacc

SEQ ID NO: 975 - DNA, 2840 bp, Homo sapiens
agttgtccccggccttcgcgggtgcccgcagaacccgtcctcctcgtccaccccggagaggtcagagtcctcgccctgcactcccgggacgccgcatctgcgccgtcggacatccagcacccccggagtccaccggcaactcggttcttccaggtgatggtgtgcagccaccgccgcccctggcgtgcaggtgtgggctctccacattgggccggggaggggacttcgggcaacgcgctggaagcctcggcagtcgtggaaaccaagccccacactcccgggaagcctccaaattccgcgccctccgttactaggggcctccgaaaaccgtttccagactggatttgctctgagaggggcactgggcgatctgcaggtctggatgaaggagccctgggctttaaactgagcaggcagaaatgggcccctgctaggggctctgtggcttacgcgggggtcccgggagtgttgtgccccgggatgcctccggccctgcccagcaggcctctggtcccaccaggctgcttccagccctgggtagaatgagttacttcctgtcttactgcaaagctcatggcggcgcgctgctcaccggctaccaggccctgcgcgccgagggcttcctgtgcgacgtgacactggagaccgagggcagcgaattcccggcgcacaggtcgctcctggcgtgctccagtgactacttcagggccctgttcaagagccacacccaggaatcccgggcgcgcgtgatccacctgcacgtgccatcggcagccggcctgcagcgcctgctggacttcatctacactgcctggctgtcgctttccatggacactgtagaggacactctggaggccgccagctacctgcaggtcactgaggccctggggctctgtgggcgctacttggagcgccagctggctccagagaactgctgcttcgccgccaacgtggcagcgcgctttggcctggctcacacgctggacgcggccgagcgctgcatcgtgagccacttgcaggagctgctggcgcggggcgcgggccccgcgggactcctggagctcaaccctacatcgctgagggctgtactgggtgcccccgacgtggcgcgggtgcccgaggcccggctactgggcctggcgttagcttggttgcggcaggagcccacaactgagcgcctggcacactgtacagagttgctggagcgtgtccgctttggcctggttcccgccgacgtactgcggcgcgtgtactcgggctctggcctcgtgctgcccgcccgggtcaagggcctcatcatccaggccctcaactaccacacgacgccctcccgccagccgctcatgcagggcgagcagaccagcatccggagcccccagacccgcatcttgttggtgggggggcgcagggcacgggaggtggtgattgaggaggtcgcggccccgcagagggcagctaggggccaggtcgccgccccagagcccgaggaagaagaggaagagttggaggaagaggaggaggaggaggagtgggagctcacccagaacgtggtggccttcgatgtgtacaatcaccgctggcgcagccttacgcagctacccacaccactgctggggcacagcgtgtgcaccgcgggcaacttcctgtttgtcctgggtggggagagcccttccggcagtgcatcctctcccctggccgacgactcgcgggtggtcacggcccaagttcaccgttacgacccgcgcttccacgcttggacggaagtgcccgccatgcgggaagcgcgggcccacttctggtgcggcgcggtgggcgagaggctcctggccgtcgggggcctgggtgcgggcggtgaggtgctggcctcggtggagatgtacgacctgcgtcgggaccgctggacggcggctggggcactaccgcgggctctgcacggtcacgcgggggccgtcggggaccgcggtgttgtgtacatctcggggggcaaggcagggagaggcgagggcggagcgagcagcctccgggacttatacgtcctgggccctgaggagcaggtttggagcaagaaggcacccatgggcaccgcacgtttcgggcaccacatggcagtgctgcgcggcgctgtgtttgcttttctggggcgatacgagcccttctctgagatcgagcgctacgaccccggcgccgaccagtggactcggttgcggccgctgccctacgaccgcttctgctatgggctggccgtggtcgaggagacagcgttgctgctgggcggcctcaagtggcgggactcgcgccaggtgcctacccgcaacgtagtgggctacgacctcgacctggaccgttgggaggacatcggctgcgcgttgccctgggcctggagcggcctgcggtgcgcagtgctgcagctggccgagggtggggacgacgagagggagggagaggttggagaggcgctagatttggtgctgggctgaatgggtcagtccggtttccttccgcaatggaggagaaagtcgcgcttggttagtcttacagagcaacggatgggctttttctaagaaagggattctgggagcagagtggcttctgaaggttaacaggcaaacaaggccttgagcaaagagaaacatttctccttgagctgagaatgggagacagcggggcggggggtcaaatagaaggctatatgaatcaacttcagtgagctggtgaaagaaaatttttagaaaggctcacgcaaggctagagaaggactttcacaaataaaatatgaccttattttccctcttacagttaaagtgtttccctaggtgcaaaacagtgattacttatgtgcc

SEQ ID NO: 976 - DNA, 2944 bp, Homo sapiens
caagagctttcaaatagaactatggtggagaaaagtagtattgatgaaaattccatttctttagaaaaagaagtccgacatgtacaggaacaaaacttagacattttaaaaactgatcttcctcttaaatccttttctgaagaaatctatagtgaatcatgtgccctacttccaacctcatctgcagatatagaagaaactgatctttctgagaaaagttgtcctctagaaaatggaggcagaagttccatctcacatttgaaaaaagcagcaagtgaggaaaagcctttaggggttggtgaaatggaagaagaatgcactctagaaccagagttggcagcatttccaaagcaggatggtgggacacaggaatatacagatgccactttggaagaccacagaggtgatgttcaggaagctgacacactccatagacagctctccctgagtcagtgcttcccactcttgatgactgaagaacaacagaatccaggtgaacaaataagtacaaacattcatgcctctggagaagaaaaatgttatgaagaagttcaagttcagaatgaagcttctttctccactttagaaggagaaatgatagaaactagtttttctcaaaatattcctaaattagatgaggcacataccactgaggcagcagaatctgagacctccctaacacaatatttacttgctgctggaaagcgtgaggttcctgaaactaaagacaccagagaccaggcaaagcttgtccagagtgaatcaatcacttcaatggaggtggaagaagtaactttcaacactgtgtatgaatactacaaccagaaacaggaatcactaggtcgtccactttctcctgagtctgacatttccattggtgtgggaagtacaaccagtgaagaaatatctgagttagatcagttttataccccaccatcatctgttgaatattttgaatctccaaagtcccctgacttatattttaatccttcagatataactaaacaatcctcaatacattcaggaggtgagacagttgaaagatattccacacctttaggggaagttgctgaaagatattcaacaccttccgaaggtgaggtaggagaaagatactccacacccccaggggagacactagagagatactccacacctccaggagagactctagagagatattccacacccccaggggaggcactagagagatattctattcctactggaggaccaaaccccactggtacttttaaaacatatccatcaaaaatagaaagggaagacggtacaccaaatgagcatttctacacacctacagaagagaggggttcagcttatgaaatatggcgttccgattcatttggtacacccaatgaagccattgagccaaaagacaatgaaatgcctccatcttttattgaacctctgaccaaaaggaaggtatatgaaaacacaacactaggcttcattgttgaagttgaaggtcttccagttcctggtgtgaaatggtatcgaaataaatctttactagagccagatgaaagaatcaaaatggaaagagtgggtaatgtgtgttcactggaaatttctaacattcaaaaaggagaagggggagagtacatgtgtcatgctgtaaacatcataggggaagcaaagagctttgcaaatgtagacataatgccccaggaagaaagagtggtggcactaccacctccagtaacacatcagcatgtcatggagtttgatttggaacacaccacatcatcaagaacaccttctcctcaagaaattgtcctggaagttgaattaagtgaaaaagacgttaaagaatttgagaagcaggtgaaaatagtgacagttcccgattttactcctgaccataaaagtatgattgtgagtctagatgttcttccatttaattttgtagatccaaatatggattcaagggagggagaagacaaagaactaaaaattgatttagaagtatttgaaatgcctcctcgctttataatgcctatttgtgattttaaaattccagaaaattcagatgctgtattcaaatgttcagtcatagggatcccgactcccgaagttaagtggtataaagaatatatgtgtattgagccagataatattaaatacgtgattagcgaggagaagggaagtcacactcttaaaattcgaaatgtctgtctttctgatagtgcaacatacaggtgcagagctgtgaattgtgtaggagaggctatctgtcggggattcctcaccatgggagattctgaaatatttgctgtgatagcaaagaaaagcaaagtgactttaagcagtttaatggaagaattggtcttaaagagcaactacacagacagtttttttgaatttcaggtggtggaagggcctcccaggtttatcaaaggtatttctgactgttatgcaccaataggtacagcagcatattttcagtgcttagttcgtggctctccaagacccacggtttactggtacaaagatggaaaattagtccaaggaagaaggttcactgttgaggaaagtggcacagggttccataacctgtttataacaagcttagtaaagagtgatgaaggagagtataggtgtgtagctacaaacaaatcaggaatggctgagagctttgcagcactcaccttaacttaaaatgtaatgttttagtgcctcagtaattattagcattgatctgagtgctttcatattttccaaattatgtggatctaataaacttccaaacaggtccaccatatttgaattcattaccttggagacccctaaagaaataatctctatgtagaaatctcatctttgtaatacatgtaaatattttgttatctgaactgtggaatcatcacttgtgtcaatcatgctgtgtaatatcaaacacaattaaatctctccttggctacct

SEQ ID NO: 977 - DNA, 3309 bp, Homo sapiens
cagcagcagcagcagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcctagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagtccgtaattgagcaggtctcgtgggatacctgagatgcacccgcttcccggcccatgcaggagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagtttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtaggtggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcac

SEQ ID NO: 978 - DNA, 2562 bp, Homo sapiens
cagcaaactaccttatattcatttttttcacactgtgctcaaacagatagcaccagagtattttgaaaagaatgaaccttatttggaagcagcttgtaatgatgttgatcgatggcctgccccagtgccagggaaaacattacacctgccaatcatgggggtggtaatgaaggtacggattcccacatgtcatgacaagcctgggacaactcaaatagtgcagttaactcagcaggtggacacaaatatatctgttattttacctactgttcatgaggtggatattttcaggtgtttctgcccagttttccttcatagtcagatgctctgggagctggtgctgttgggggagccccttgtggttatggcgccatcaccatcggaatcatcagagactgtattggcacttgttaactgtatttctccattaaagtacttcagtgatttccgaccttatttcactattcatgatagtgaattcaaagaatatactacccgtacccaagctccgccctcagttatattaggagtaaccaaccctttttttgctaagacactccagcactggccacacattattcgaataggagaccttaaacctacaggtgaaattcctaagcaggttaaagtgaaaaaactgaagaatctaaagactctggattccaaacctggagtttatacttcatataagccatatttaaatagagatgaagagatcataaaacaattacagaagggtgtacaacagaaacgtccttctgaggctcaaagtgttattcttcgacgctattttttggaactgacacaaagtttcatcattccattagaaagatatgtggcaagcttgatgcctttgcagaaaagtatttccccatggaagagtccacctcaattaagacagtttcttccagaagaatttatgaaaacacttgagaaaacaggacctcagctaacctctagaataaaaggcgattggattggactttaccggcatttcctaaagtctccaaattttgatggctggtttaagacccggaggaaggaaatgacccaaaaattggaggcactccatctagaagctctttgtgaagaggacttacttctctggatccagaaacacacagaagtagaaacagtagaccttgtcttgaagctgaaaaataagctgttgcaggctgatcgagagcacttacctgtgaaacctgacactatggaaaagttacggacacacatagatgccattatcttagcattgccagaggacttgcaaggcatactgctcaaaacgggcatgacatgatatttgccaagattttccagccaaaaaggattatgcatcatgaagcatactgacatttcaaccagacgcacaaaggagatctctcagtggcagcggagtggaaaattgccatgaatgctagttacagggtagaaagactgtattgtataaacagacctttttagtgcattactttttaaagtggatatctgtggtggttccactttaatactgaaacaccgaaaggcatttctatatttttaatcatgttctaaagtgctcttatgagagacttgtgagccaccgcacctggccagaagccactaactaaaataggcacacatgacacagcatgtggttaatagctgtgtcttgaattatcctctaaataaccaaatttagttgtatgtatttgtaaaggatatggcttcagaagctatcttttgttctctgtcgatataactcttaagggcattcctgacccaagaaagactccttgcgtttgtaactgtggtctaatacccaaatgtgccctgttcttatggatacagtctcttgaagcatacctcaaagtcatagagagaatatggcatttgaaagaaatcgtttgccttggatcatatgagttattttgtgaaacaacagctgacttttcagaaaaggagcaactacttttatatgctaaaagtatttcataactttctgggaaaccttatttaggtataaatggtcatcttattatttttcaaaaaggtatattttaataattgtacaatttatatacagtttgtgaccagaatttgtaagttgttggtgtcatatcaaggatcttttaaattatgccactacaggatgtatcatttcaagtctattttgcacagctaaacagtagcaaaagatgccaattagcatgataatggtgtcttcatttttactgtatttaactgaaacctaacacatgttgaaaaccatatcatacctagtttatctcttaatttcaaactatgtacttgtaaaaatgatgtaaatttgcactgggaacctgggaaagagtgactgataatttttggtgcgtgatttttagatttgtctttttttttttaagaagaatttgttactatgtaaaccctgacattaaatgttttatctctaccagcatcaggaggaatcactgctttaagggtattatgtaatgcctagtgccttctatttacagtgaaaaagaggttttgcgaaggcatttatggtcattaccaaaaactaaattaaaggccttggatttt

SEQ ID NO: 979 - DNA, 4406 bp, Homo sapiens
gcatgcgcgcccgcggcgctccatcccaaacacacacacatttttcccccggacttggaaagtcacccaaagccgccccaagtgcaggcaaacagaccttgctgactgaaggcaaagactcctccatcccacctgccctcccagctgccacggccatcgacccctcctttacaaggggctcctgcaactccccagcagcacgtgttggaatggacttcggaccctggcctcttgggatgcaaaggatgaagtgacacccccagctacatccgaggaggttctaggacctgctacgagagtttgggaccaaggagaagagaatggatcttggaacagctgagggcacccggtgcacggacccgcctgcaggcaagcccgccatggcgcccaaacgcaagggtggcctgaagctgaacgccatctgcgccaagctgagccgccaggtggtggtggagaagcgagctgatgccggctcccacacggagggcagcccatcgcagccccgggaccaagagcgcagtggccctgagtctggggcagcccgggccccccgcagcgaggaagacaagagacgggcagtgatcgagaagtgggtgaacggggagtacagcgaggagccggcacccacacccgtgttggggcggattgcccgcgagggcctggagctgcctcccgagggtgtctacatggtgcagccccaggggtgcagcgatgaggaagaccacgcggaggagccctccaaggacggcggtgccctggaggagaaggattcggacggggcagcctccaaggaggacagcggccccagcaccaggcaggcttcaggagaggcctcctcgctgcgggactacgcggcctccaccatgaccgagttcctcggcatgtttggctatgatgaccagaacacgcgggacgagctggccaggaagatcagctttgagaagctgcacgcgggctccaccccggaggcagccacctcctccatgctgcccacctccgaggataccctcagcaagcgggcgcggttctctaagtatgaggagtacatccgcaagctcaaggctggcgagcagctctcctggccggcccccagcaccaagaccgaggagcgggtgggcaaggaggtggtgggcaccctgcccggcctgcggctgcccagcagcacggcccacctggagaccaaggccaccatcctgcccctgccgtcgcacagcagtgtccagatgcagaacctggtagcccgggcctccaagtacgacttcttcatccaaaaactgaagaccggcgagaatctgcggccccagaacgggagcacctacaagaagccatccaagtacgacctggagaatgtcaagtacctgcacctcttcaaacccggggagggcagccccgacatgggcggggccatcgccttcaagacaggcaaggtggggcgcccttccaagtacgacgtccggggcatccagaagccaggccccgccaaggttccgcctacccccagcctggctcccgcacccctcgccagcgtgcccagtgcccccagcgcccccgggccagggccagagcctcctgcctccctgtccttcaacactcccgagtacctgaagtcaaccttctccaaaacagactccatcaccacggggaccgtctccactgtcaagaacggactgcccacagataaaccagccgtcactgaagatgtaaacatttaccagaaatatattgccaggttctcgggcagccagcactgtggccacatccactgtgcctaccagtaccgcgagcactaccactgccttgaccctgagtgtaactaccggaggttcacgagtaagcaggacgtgatccgccactacaacatgcacaagaagcgcgacaactccctgcagcacggcttcatgcgtttcagcccgctggacgactgcagcgtctactaccacggctgccacctcaatgggaagagcacccactatcactgcatgcaggtgggctgtaacaaggtgtacacgagcacgtctgacgtgatgacccacgagaacttccacaagaagaatacccagctcattaacgacggcttccagcgcttccgagccaccgaagactgtggcacagccgactgccagttctacggacagaagaccacgcacttccactgcaggcgccccggctgcacattcactttcaagaacaagtgtgacatcgagaagcacaagagctaccacatcaaggacgatgcctacgccaaggacggcttcaagaagttctacaagtacgaggagtgcaagtacgagggctgcgtgtacagcaaggctaccaaccacttccactgcatccgcgccggctgcggcttcaccttcacctccaccagccagatgacctctcacaagcgcaagcatgagcgccggcacatccgctcctcgggcgcgctggggctgccgccctcgctgctgggcgccaaggacacggagcacgaggagtccagcaacgacgaccttgttgacttctccgccctgagcagcaagaactccagcctgagcgcctcccctaccagccagcagtcctctgcgtccctggctgccgccactgccgccaccgaggctgggcccagtgccaccaaacctcccaacagcaagatctcggggctgctgccccagggcctgcctggctcgatccccctggccctggccctctccaactcgggcctgcccacccccacgccctacttccccatactggctggccgtgggagcacctccctgcctgtgggcacccccagcctcctgggtgccgtgtcgtctgggtcagcagcctcagccacccctgacacacccacgctggtcgcctcgggagctggagactcagcccccgtggctgccgcctctgtcccggcaccacccgcctccatcatggagaggatctctgcaagcaagggcctcatctcgcccatgatggccaggctggctgcagctgccctcaagccctctgccacctttgacccaggaagcgggcagcaggtcaccccagccaggttccccccggcccaagtgaagccggaacccggtgagagcaccggcgccccaggcccccacgaagcctcccaggaccgcagtctagacctgactgtgaaggagcccagcaacgaatcaaatggccacgcagtcccggcaaattcatctcttttatcctcgcttatgaataagatgtctcagggcaaccctggcctgggcagcctgctgaacatcaaggcggaagcggaggggagccccgctgcggagccctcgcccttcctaggcaaggccgtgaaggcgctggttcaggagaagttggcagagccctggaaggtgtacctgcgcaggtttggtacaaaggacttctgtgacggccagtgtgacttcctccacaaggcccacttccactgcgtggtggaggaatgcggcgcgctcttcagcaccttggacggggccatcaagcacgcaaacttccacttccggacagagggaggagcagcaaaaggaaacacagaggctgccttcccggcctcggccgccgagaccaaacctcccatggccccctcgtcccctccggtccctcctgtcaccacggccacggtgtcctctctggaggggcccgctcccagcccggcctccgtgccctccacccccaccctgctcgcctggaagcagctggcttccaccataccccagatgcctcagatcccagcgtcagtgcctcacctgcccgcctcgcccttggcaacgacttctctagagaacgccaagccccaggtcaaacccggattcctccagttccaggagaagtgagtccctcgatgagccgggagtcccgcgttcccctcgcgtctcgggagtaggtgctagcaagggcgctaggaggccctgttcctcactgcggatggtgctgctgtccccagcctctctggggcatggccatcgggtgatgtccttctagccaaagatgctgctgctcctacctcactgcctgtcccagagcaggccagcccgcgtgggccgatggtggcggcagtggctactgctcctgcagggcatgtggtgatcctgccagggccaggtggggtggactgggcgtggtggtcctcagaggacaactcccagcctgacaaggagggctgcgtctccctccgagcctccgtattggcctcctctgtggctcacacccatggctgaatctctgcagggcacgtgaagtcacgggtaggggccaggcccctccaggccgtcactggcctgcacagtggtctgagctcttgggtggaagggaccctcctcactggatggtggtggctccttgcagggagaacggtgactttgtattgtcatgtgtgcggcttcctgttctcaataaaagtaataaattggattatttat

SEQ ID NO: 980 - DNA, 3112 bp, Homo sapiens
attgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagaggatgtgttttggagatgcagacaaaatatctttgatgaaatgaagaagaaatttttacagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgtgggttctgccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatattccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggttcattctgggagcgctgctggtggtcattattatgcatgtataaagtcatcagtgatgagcagtggtacagcttcaatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtggatgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagc

SEQ ID NO: 981 - DNA, 3812 bp, Homo sapiens
agtgccccccgcgctccgctccggcagctccacgctcgcgcccgccatgccggagcagttcagcgtcgccgagttcctggccgtcaccgcggaggacctcagctccccggctggggccgccgccttcgccgccaagatgccccggtaccgaggggcggcgctggcgcgggaggagatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaatggccaagctggagaaggagcgcgatcgggccagggtgacaggagggatccctggggaggtggcccaggacatgcagagagagcggcgcatcttccagctgcacatgtgtgagtatctgctcaaagccggggagagccagatgaagcaaggtcctgacttccttcagagcctcatcaagttcttccacgcccagcacaactttttccaagatggctggaaggctgcccagagcctgttccccttcatcgagaagctggcggcctcagtacatgcactccatcaggcccaggaggacgagctacagaagctgacccagctccgggactccctccgagggacactgcagcttgagagcagagaggaacacctgagccggaagaactcaggatgtggctatagcatccaccagcaccaaggcaacaagcagtttgggacggagaaagtgggctttctatacaagaaaagtgacggaattcgaagagtctggcagaaaaggaagtgtggagtcaagtatggctgcctgaccatctcacacagcacgataaaccggcccccggtgaagctgaccctgctgacgtgccaagtgaggccaaaccctgaggagaaaaagtgcttcgacctggtgacccacaaccggacgtaccactttcaggcagaggacgagcacgagtgtgaggcgtgggtgtcagtgttgcagaacagcaaggacgaagccctgagcagcgccttcctcggggagcccagcgctggcccggggtcctgggggtccgccggccatgatggggagccgcacgacctcacaaagctgctcatcgcggaggtgaagagcaggcctgggaatagccagtgctgcgactgcggggctgcagaccccacgtggctcagcaccaacctgggcgtgctcacctgcatccagtgctcgggcgtccaccgcgaactgggcgtgcgcttttcgcgcatgcagtcactcaccttggacctgctgggcccctccgagttgttgctggccttgaacatgggaaacacgagcttcaatgaggtcatggaggcccagctaccctcacacggcggccctaaaccctcagctgagagtgacatgggcacccgcagggactacattatggccaagtatgtggagcataggtttgcacgccggtgcacacctgagcctcagcgactctggacagccatttgcaacagggacctcctgtcggtactggaggcctttgccaatgggcaggactttggacagccgctgccagggcctgatgcacaggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactagctccttgctggcccccacatgccccatgctaggccccaatgttcagagctgggacttgagctcacaaaactggggagctgagacatttgttctcttggatctcactctctctgtcccttgtgcctctgtagctggccttcttcctgccacaggccatgcctctaccaaggacacatggcctttccctgttagggctgatggcggttctttcctatctcattacccgctaggggcctgggagccctgtggctggatctgagtgctcctgagctggcttcagctgcagaactctcagtccctcatcagatcgagactctatttcccccgtcagtctgggggcttcacaagggcaggagagccctccatcactgacttccagatcagggaccctgccaagtagggactgtcttctcagccagccatttattagtctaatattccttcactaaattccaactctatgtctggacctgtgttaggcacttcagataccacacgagtaagacaagggccctgcaggggtggtcctttggtggaaagctggtcttaagggttgggcttgggaataggcagggtcagattccagggcatggctctggactcagctggtttatacctatatgaccattacagttgtctacagatcacatccattctggctggtcaacatgcatgctgtactggctgttaaataaaaatattctgaatgtcactccttttgagggacagcacagccttccctaggcattctcctatattcccccaatgagaaagcagatacacctaagccatcatcaaccactaacatctcaacttgccagttgctgggtgctgggccctggcaggaatgggccaagccaagcaggggagactagagagcaccaatggccaacacagctgcctggctggggaggctgtgctgtttcccctggagacctgactggtctgtggttcccacaggaacagggttgtcttttgagcccccagtgtctggtttcattcatctcagacttgttatttcactcatctctaataaaggattggggggtcagtt

SEQ ID NO: 982 - DNA, 3071 bp, Homo sapiens
tattaacattatagatactcctgggcatgtggacttcacaatagaagtggaaagggccctgagagtgttggatggtgcagtccttgttctctgtgctgttggaggggtacagtgccagaccatgactgtcaatcgtcagatgaagcgctacaacgttccgtttctaacttttattaacaaattggaccgaatgggctccaacccagccagggccctgcagcaaatgaggtctaaactaaatcataatgcagcgtttatgcagatacccatgggtttggagggtaattttaaaggtattgtagatcttattgaggaacgagccatctattttgatggagactttgggcacttcctgagggatttccttcctctgctatggaattgggatcgcaggtctggcagtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaagctagcaattcgaagagctactctgaaaagatcatttactcctgtatttttgggaagcgccttgaagaacaaaggagttcagcctcttttagatgctgttttagaatacctcccaaatccatctgaagtccagaactatgctattctcaataaagaggatgactcaaaagagaaaaccaaaatcctaatgaactccagtagagacaattcccacccatttgtaggcctggcttttaaactggaggtaggtcgatttggacaattaacttatgttcgcagttatcagggagagctaaagaagggtgacaccatctataacacaaggacaagaaagaaagtacggttgcaacggctggctcgcatgcatgccgacatgatggaggatgttgaggaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgtttggttattccactgaacttaggtcatgcacagagggaaagggagaatacacaatggagtatagcaggtatcagccatgtttaccatccacacaagaagacgtcattaataagtatttggaagctacaggtcaacttcctgttaaaaaaggaaaagccaagaactaactttgcttactgtgagttgactgactctaattgaatctgcgtggttttgatactttgatggattccagtggaataaattcaggctgctgaaacaagaaattctgagcccaggaagcgggctcttctttcttcaaaagaagcccttcttgttcatattcaggagcttctgttatattcaaaggtaattctatgtctatctcaactctattgattggttttatagttcattgaaaatcctcaaataaaatataattattactgaaatatgtttaatatttaaggggaaaagagactaatttcagttatacttttaagcttagaatgtatgttcatttccaaattttgtatcataagagttttcaacatagagaaaagctgaaaaaatgcaaagaataaccacatactttccatctaccttcctttgttaacgggttgtttatcatataataatttgttttgtcatatttgctttcactgtctattatctgtttaagtctcataactctatttttagtttgctgaagacttgaaagtgaatcgcatatatcatgacacttcttggagtgtcattaatgggcaggcttttctgttgaagagtggattccgtatgttcttcatagagagtgtttttcagattcttcattgggatattaaaatattagccaaatttctctctgttttatatatgtctgtttatttcagtttgtggtttctgcaaatttgtaactgcctctgttttaggagtataagtattacttccttgtggtctattgtgaagtaaaaagtagacccttgcatatactattcttgtttgtgttcatcttaatgtttttgtacagctaaatcaaatgtaatttatagagttagtttcatcaacctaatgaatgctagttaaatttgaattccttggaatttatcgtatattgtattcactgagattatgaagggacaaatgttaatcttttgtttccagaaaaagttgggctttcccaagcagttctattacccggttcagaattgcttcatccaaaaatcatctgatggtatagatggatcctagtccttttcattacctgatggtagaaataaaataattgatttt

SEQ ID NO: 983 - DNA, 3051 bp, Homo sapiens
tgccatctacatgcccgtgtccccattggctgtggcagcaatgctggcctgtgccaggatcggagctgtccacacagtcatctttgctggcttcagtgcagagtccttggctgggaggatcaatgatgccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggaaatggccaagaaggaggcccagtgagccgggtcccttagaggacatgctcttcatgctgtacacctcagggagcaccggaatgcccaagggcatcgtccatacccaggcaggctacctgctctatgccgccctgactcacaagcttgtgtttgaccaccagccaggtgacatctttggctgtgtggccgacatcggttggattacaggacacagctacgtggtgtatgggcctctctgcaatggtgccaccagcgtcctttttgagagcaccccagtttatcccaatgctggtcggtactgggagacagtagagaggttgaagatcaatcagttctatggcgccccaacggctgtccggctgttgctgaaatacggtgatgcctgggtgaagaagtatgatcgctcctccctgcggaccctggggtcagtgggagagcccatcaactgtgaggcctgggagtggcttcacagggtggtgggggacagcaggtgcacgctggtggacacctggtggcagacagaaacaggtggcatctgcatcgcaccacggccctcggaagaaggggcggaaatcctccctgccatggcgatgaggcccttctttggcatcgtccccgtcctcatggatgagaagggcagcgtcgtggagggcagcaacgtctccggggccctgtgcatctcccaggcctggccgggcatggccaggaccatctatggcgaccaccagcgatttgtggacgcctacttcaaggcctacccaggctattacttcactggagacggggcttaccgaactgagggcggctattaccagatcacagggcggatggatgatgtcatcaacatcagtggccaccggctggggaccgcagagattgaggacgccatcgccgaccaccctgcagtaccagaaagtgctgtcattggctacccccacgacatcaaaggagaagctgcctttgccttcattgtggtgaaagatagtgcgggtgactcagatgtggtggtgcaggagctcaagtccatggtggccaccaagatcgccaaatatgctgtgcctgatgagatcctggtggtgaaacgtcttccaaaaaccaggtctgggaaggtcatgcggcggctcctgaggaagatcatcactagtgaggcccaggagctgggagacactaccaccttggaggaccccagcatcatcgcagagatcctgagtgtctaccagaagtgcaaggacaagcaggctgctgctaagtgagctggcaccttgtggggctcttgggatgggcgggcacccaagccctggcttgtccttcccagaaggtacccctgaggttggcgtcttcctacgtcccagaagcagcccccaccccacacatgacccacaccgccctcacgtgaagctgggctgagagccctttctcccatccattggaggtcccaggagtgtcacccatggagaggctatgcgacatggctagggctggttctgccatctgagtttggtttcctggaatgaaaaggcattgccatctccattcctctgccctcttgagccagcacaggaaggtgaggccctgggatagcgcgcctgctcagataacacagagctagttagctagtagcaaccgtgttttctccagatctgtctagatacaaaggtcagaaatcttatttttatacttttatattgtggaagaacagcatgcaacactcacatgtagtgtgtggatttacttgaacatgttctttttaacatgtagttatgaaaatctccttttatgcctctactggtgaggaaacatgaggatcagaggccacatttttaattattgttagtgtatttggaagtctgaattggagatgtttgtacctctgtctaaacagttcccttgagaacttccaagcctccggcatcttttcctggtgagtgtttctcctgtgcttggttgtgtataatggagctaactcctaagcggtggggtgaatgtggccgccttagttctgaagctactccagttatgttctgtttcttcaagctgtgatccagaaagatttttgtgcccccagatgcctcttgataggagaggcaacatactccaaatagttgggttcttcagggaagctattagaaactcaggtgacttgttagagcactaacttggtcagagccaaatcctggcaaacgctgcctgaccttcactctgtggttggggcagtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttc

SEQ ID NO: 984 - DNA, 2651 bp, Homo sapiens
aagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatgtcatgtctcacaagagaacagcgagtacggatcttaagcaactgaaccaggtcaactttacccttcccaagaaggaaggactttcctttcttggtggccttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgttctcttctacagagaacctggcggctgggtcttggaaggagcctgctgaaggaggtgggctgtcttctgacaggcagctctccgaatcttccaccaaggactccttgaagtctatgaccctgccgtcctaccgacctgccccactggtcagtggggacctcagggaaaacatggcccccgcaaactcagaggccacaaaagaagctaaggagagcaagaagccagagagcaggaggtcctctttgctgtctctgatgacggggaagaaggatgtggctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgacttcatcctgtgaagccaatgaatgccacggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaaatcagcagaaaaaaaacaccgagacgtttctgtgacttcactttcacctgctccaggggtcaaggacttgccttgcctgataaccagccagcaggctccgaatcaccatctccctcacatgttatccggcaagagtgaattctaccaatggaagccaggttaatgattacaattaatcttttactgtacattcccaaggctttagttttaaatgccactgtgcctttaacaaggttgtaaatattttatgcccaccagagatgtggtcataagatctgatcctgagccagagattcagatggcacaggaagtattcgtgtattttaacactggggttttctttctttcatactgagattttttttcagtatgtatcctccagctcttaaagcttacctgagaaagctttaaatgagaaaaggaccatgcgattggtgctgtgttacatacacatactttcttggcttctgagtagctcaggtgtggcttttggctgcagatgttaaattttgataccatgtaaacctacccagcttctcagacttgggtcttgttttttgatgggaacagaggtgtttagagaaagcctctgagtatgcctttcagattttgaacaagcggccttttctaaacatcgacttctactactctctagccttaaaataccttctgcttagatccagggcccttctactggagataggaaaagtagaattcaggaattaaaagaattactctttattcaatttgaggaacttggtgaaagcccctcctcttatgacagccaggttcctgctggctagaccagcctattcagcgctttgctaggggattgggtggtccacgcactcgctaatacagttctccaggtgtggaatgatgtcaatacgattgcttggccttttccccctgtgcctttgctcggtgctctggtttcctcagcaacactccttgtaaggggcagagacagggtccaccaactccccaagatgaagaagccccttcaggccagtcgtggtggctcatgcctgtaatcccagcactttgcaaggccgaggagggtggatcacttgaggtcaggagttcgagaccagcctgaccaacatggcgaaaccccatctctactaaaaatacaaaaattagcttggcatggtggtgcgtgcctgtaatcccagctactcgggaggctggggcaggagaattgcttgaacttgggagatggaggctgcagcgagccaagatcgtgccactgcactccagcctgggcaagagtttttttaagactcttaaaaaaagagcctgggcaatttttttaagactctgtcttaaaaaaaact

SEQ ID NO: 985 - DNA, 2981 bp, Homo sapiens
aattagcagcgaagctcgcgggcgctggcgggacaggcgcgtgaggccacaacacatgcgtgtatcttgcttgggctatcttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcgggctgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatatggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttg

SEQ ID NO: 986 - DNA, 2625 bp, Homo sapiens
ctgagcagacggtgagtagggcgggcacattctccaggcccttcttcctagctctgtggttgacctctcagcaagtgctatccaggctgggccaaccagacccacaattaactgagcctcagtgaaagcgtccagtgcatcttgacctgagacagcaaggaattgcatttggggttattccaacgatgatggcagggaactggtggtatttagtgctgaggggcagtgatacagaaagatttgccctgtgggacagggtcctgcgcgagtcccatccccaaaagccagcagctcctgccatgaggaagacggggtttctgagcaggcttatgcctgcaggttcctgtggagccaccggctgtgacgggacacctctgggtctcagcattgccctggggaggctgggacatttagggacatggtagggttttaacatttgtttcccaaatgtcaaatcccgggcacaggggcaagaccctgtcccgaattcccaccccagtgaatggtgtcgctgccaaagccaacacaagatgacaaaagtggctgggtacggtggctcacgcctataatcccagcactttgggagaccgagacaggtggatcacctgaggtcaggagttcgagaccaggctggccaacatggtgaaaccccatctctactaaaaatgcaaaaattagctgggtgtggtggcgcgcacctgtagtcccagctactcaggaggctgaggtagaagaatagctggaacccaggaggcagagattgcagtcagccgagattgcgccactgcactccagcctgggagacagagcaagactgactcaaaagaaaaaaaatgacagaagcctgattatcagactgcccggaggagacaggctccagcagatagatgccagccaggcccagctgccacgatttgtcccaggtgaccaaaggcacgcagctccagcatgaatcgttctaacccaacagtgacaagaactgctgggccttaaccgtcatggaagactggggccgcttccaagtcacagacaggagacggggacaggaaagaactcattccacccaatcggacacctaataattgagtgtctacagcagcaatcaagtgacaagtgaggccctacctgacccagaaggtgcctgccggctaaacattctgcccccaccagaaactccagggggtccgcccgttatgccgtggcccacccacgcccctttggatcaccagcagtcacagacaacaggcaggcgaaactgaagaccccaactcagccccagcggaccctccagatctcatcctgcctcatcctgagtcccaatcttccaagggtgccagcccctccgttcatctctgaaacccagcatccttttcagctgcttgaaaacattgtatttttttttttaacgatgcagtatttgtgcgttccagaaaagggcccagctctgagcccctcacccttccacactcacgaactctcagccgaggaaggcaagaagcgcagggggtggcccgcgtggcgtcggtggcctccgctcctgctcgcagcccctgtggtcagagctggatacaagattcaagacccttctcttgcttgtcacccgctccaggttggagccacagacacccaccgccatcccggctgggtctgcgtcctttcctgtgcctttccctccagaatgcggcctcagacctagaagctcaacccccctatgagggccacgtcctggggtagctcctgacctccgaccttatgtccaaatttcacacccatggtttttcatttgacccgcccccttctcgctcataatgacacccagctcctttgagaggatcagagcccattgcacaagaagagccgctgccaaccatccttgtcctccgattgcaaaatgacaccccagtaatctagaacattctcaagcccctttaactcagatgtcaagccaccgggcaaaccccgtcaatacctcccaccaaggaatgagatatgtggacctcactgctcccccaacccagcgtcaggctgggacacgccaacgctgttccgggttggaacagcagaggctcagaaactggctctgaaataggcagacctagcaagaggaagatacagggtatcgggcgtttgagtgtttcagaagtcattcgggaagataaatccagtgcgctggccgcagccacctgcattcaaagcttggaccagcgggttcttgttcgggaggcaaatttccctaggaaaaagaagacagacttttctaatgtggtccaaatgcggatcactggtcagatggactctagaagcactgagctccctgtctctggaagtatttaagaaaaggctgggccaggcacgatggctcacgcctgtaatcccagactttgggaggccgaggcaggcggatcacctgaggtgaggagtttgagaacagcctggccaacatggtgaaacctcatctctactaaaaatacaaaaattagccaggcgtggtggcaggtgcctgtaatcccagctacttgggaggctgaggcatgagaatcacttaaacctgagaggcagaggttacagtgagccaagatcgtgccactgcattccagcctgggcgacagagcaagactctgtctc

SEQ ID NO: 987 - DNA, 2820 bp, Homo sapiens
aacaaaatgggggtggggacgtgcaagtttcagactccgactaactacgcggggactccgaggcgctcagaaaaatgaagccgacccggccctgccccgagggacgctccaagagggcggaggtgcagggagggccccgccacaattcgcggtaacgcaagccaggctcgggcggaagggcggccggagccgatcaaaggctggctccgggcaggggcagcgagggagcgagggggagctctccgcaggccggtgtcccggaggaggcataattggagcagggcttccaaggtcacggagagacgccgggcaagacctcttaaggatcctcttccgggcttgaaaggcaggcgtcctcccgaaccgcgcgacccagccaagaagagccggggcggggccggggccggggccgggggccgactcgggaaccttcggccgaggctcggcaatccccccatcctccgtccggggcctccagcccggggccgatccggaaacagccgagcggatccggaaacagccgagaggacccggaagcggtgcgctccgtcaccagggagtgcgggaatccgccgtttgcgctgaggcaatggcggcagctgcgccggtggccgcggacgacgatgagcggcggcggcggccgggggctgcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagccgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgc

SEQ ID NO: 988 - DNA, 2928 bp, Homo sapiens
tcaggacccaaagatcctttagtcagttgttgggtcttccaagagccagacattaatacagattgaactccatcagtcccctaattgtcagcctttacctccctcccagagcaaggagtttagggattctaaagcttagtgtccacacatcattctaccagaccttagagctttagaagctcaatctaaaatactgtaactcagcataaactattactatcactcctttgaactcagtctccatgagcagtgttttgttggaaatacatagaacggcttaatgcctagagggtggtggatagtgaaggacggtcaaggttatatttttgactgcttagggattctttggatacaagaaacagaaatgttcaagcggaataaaggagggagtggagttgtggtaaggatgcagggtatttcgcagaacccaggacgggaagtgcctttggttcttgggtggagctggaactgcagagctttgcacctagtcctttctcccgcttcacagtctgcttatggtatatgtggcccccaaataggcactctagtcctcaagtctacaccaccttccaactctggggatcaccatgaacaaattctcaatttcccatacttaattttttttttttttgagatggagtctcgctgtgtcgcccaggctggagtgcagtggtgcagtctcaactcaccacaacctccgcctcccaggttcaagcagttctctgcctcaacctcccgagtagctgggattacaggcgcctgccaccatgcccagctaatgttcatatttttagtagagacagggtttcaccgtcttggctaggctggtcttgaactcctgaccctcatgatccacccacctcggcctcccaaagtgctaagattacaggcgtgagccaccgcgcccggcccatacttcgtattcttaaaaaaaactacactcagcccagcacattgatcaagtatctatctctgagcagttggccttgccagggagagcagagatgtggcaggctccttcagctggagacagggagcttctcagagaagtgagcagagactccacagacaccctaaaaaggcttctactcaagaagtaaagccactactcctgcctttttgcttagtggacaggaaggcacaggagtttgtctgggacatcatagaaattcttaggtttaacttaattctggtcattgtcttctttatttcctgtttttcttccctttgtcagtcttcgcatccaagatttcttccctccctcttgtgggccagcctgtcctgttccagagctagcctgttcctgggtagccttccttagcctccattcagcctcaggtcttttgccttcttccgtgtttatttagagagcagaatctaataacgggttccactgtagccactatccatggacttctgggtcctcttcaggtttgagtgcttgaaaatgttcattctctgggcttgtggcctgtctcctccactctcctcctcaccctctcgctccttcctgtgtgagggccgctctgcagtaatgttctcaggcaagccttcctaggcacctcagaaactactttgccagagccagtaagaatatataatattggagcagttgccaggatagaaattaaatatagattccagtttaggatagagtttttaccgagagctctttagacagtatacctgtgtcttctctggcaattgctttcattttagtcctatataaaagctttccttttctgtttttttttaaaactatgcttttgcttgcctaaatcttttgatcttatatttctctcatctcagagcctgtcctgagttgtaaggtatttcatactgccttacttaaaagttttttaaactactagagtcatttgatacacacagaagttacctaataatccaaagatgtccatcaagggaggaagggtgggtcatcagactttgcctttgatgttgtagactaggctcctgagttaagcagcagagggacagcagtgccatgtgccttcactgtgtcccaggaaatctgggttggttccagtgggaaataccagtatttcttggttctggaaagtagcaaaagagtaggagatggggaaatagggatggggagagcaagccccgcatgtccatggcgagtcaggtggggagcacgggtggaagggccggctgttgacagacagactaagctgtgtggtgctcttgccgccccttcctgggtacagagcttgagaaaaatgcagccgaccactccctgtgtttgtacagagcaaagcccaaaagccaacctcagatctcctgatttggcagctgaagaaatcagcagagtcctgattgcctgattcagtcccaaaaatgaatgtcaggccccgccccctccccaccaacattgcctctcctacattctccttctgcccctaaatcagacaggaggccagagaggagtattgctcaatgcgtgctatgtgcaactcctcaggccttgtgccacctccatgctgagccctgaagcagggtgtcctgggtgcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactg

SEQ ID NO: 989 - DNA, 3178 bp, Homo sapiens
gaccactggtagcggcagcagctcgcgcccgcgccctcctcgtacccgtgcgcccccggagaccgatcccgccccgcggcccaggccgggcctgaacccagcgggtgccgcttctccacccgaggcttccacctccaacgagccatgttccaggctgcaggagccgcccaggccaccccctctcatgacgccaaaggcggcggcagcagcacggtgcagcgctccaagtccttcagcctgcgggcccaggtgaaggagacctgcgccgcctgccagaagaccgtgtaccccatggagcggctggtggccgacaagctcattttccacaactcttgcttctgctgcaagcactgtcacaccaagctcagcctgggcagctacgccgcgctgcacggggagttctactgcaaaccccacttccagcagctgtttaagagcaaaggcaactacgacgaggggtttggccgcaagcagcacaaggagctctgggcccacaaggaggtggaccccggcaccaagacggcctgaggcctctgtaaccttccaccccctctgcggaaggcctggagccggcagggggaaggtgggaaggaggtcgagctgggcttgcgtgggggccaggtgggaaggggatgaggcttgctcaggcgtaggggaccagggcagggctctgctccaggactccttccttcttccttctcccgcagccggtgagggtttggaaaccaggattggggtctgcccaccaccctgcttcctgcttcgttcagcctccctccccacctcaccccaggaccccctgggaggcccccaagcccagctcccctatctaggtgccttttctccagcaaggagtcagcatgcccccctcagggtcccaagctccctcactgccaccggagactgtgtggcccccacgtctccccatctacctctacccttaacctgtttctgagccacggagacagggaggaaggagcgcgacagtgccacctgttgggcatcataaatgcccctgcagcccatgggggaggagatggggaagtggagccaccctgcctctgcagggcaaggcagggcctgccccagtggggcttgggaccatctcgaaccaccagcgtggagaagcagaagcaaaagcactcgccaggctgcagcctcaggcactggcaggggctggtgcggccccactcccctcccccgctcccatttgtgcccatcctgttgtgaccaaccccgttttaaacatgtttcaatagatccagattctctattgtgtggcctgctgggggatctgtcacaggaagggtgcagactcaccatggggcgggcatggggggacagggccagccccgactacctcggccctgatgggggcagggagctagaagtgggtgtcagttccctgacacaccattgagaaatgggagggctcctcttcacagcgagggcttcatgctgtcacacccacagtggttttggaactgaaactccacctcacccctcagttctgggttggttcagacccaccaacttaccatatgcaccccattgtgaagaggcctgagagcgggagggccaggctgccagtgggtgatggcgcctgtcctcgctgcacttcagtgcctggggtgcaagctgccgcgttccctggctggttccagctgtctagctccctcccttcttcccagccctttgacctggaagtaagttagcgaagaatggcggtaaccagcagacccagcaagtgctgcccaaggttttagtgacccctggattgtcccccctcatcattacccctcgctgctgtcatcatccccttgccttttcaagctctgcggaggtgcagtcacagctactgtctcaggaaatccaaagagaaactacctctgcttctctgaaaacccagggacaatgagggatgagttcacagcagagcaaaccaggcaagttgggaggacctgagggcgccccggtgggacacaggcagaagtctgggttgtcctgctccagattcaacttcctgatgtctccagacatgggatcgatgagaacagagactcctggagggtttgctgccaccacaccatacaactgcctgagttcctaagtggcctccccgtggaacagggcagggagctgggccacaggctccagtgtcacataagtcactatgctgaggcaggcactgctcctcgagggagcagagcgaatactcagcagagatggtgccccggcctggatcctcccaagtgtgaagtgagcgcctcagagcctctcagggcaggccaacttcctgcaccagaggtctcagatggcaaggatcatcttggttcggttaagcaacagtagcagatgaccacaagggggtactggagaggtggctcttggagacacctgacccctgccctgcaaagatggggctgaaggaagtcctctgggccaggaagaccctaccaaatatcatgaaagctccgggaactcagccactggtgacgttcaggttgtgagggccagcagtgccaccctggtaaatcagccctgttgggaccaccccagtggagctcctggaggggcaactggaggaaaggggcagacacctctggactgacaatggtatcagccagatcaccccaggacccctctacttggagtcaagttctcttctgcttgaaaggcccaggctcgttgccaggcaccatacctggcccctgctaagcaaaaacctacctccaccccccacaactgaaagcactgccacaggacccctctgatataaatgatcccttttattgtaagtaatgcgcaacactggcctggctttgcactgcaagccctcggtcaagatatagtcaaataactatggctgcaggttccacagttccacaataaccatggctgcacgatccacaattcagacacagacatagagctggggtgggtggaaggggcaggagggtggcagagtgcggactgtccccagccctggcctctccatgcagagttggcccaggcagacacaccccatggaatgatgagaaagtgacggcacggccccttcccacagcaagcctggggctgccaggaactgcccttcagaacctttgggcccaggtcaccctgaagccccacaactttttatctggattagttattaaaaaacaataaattaagcaac

SEQ ID NO: 990 - DNA, 3350 bp, Homo sapiens
attaagatgctcaacactcaaatcggggtattgatctccacggaagccccaaaccctcgccatcgagagacccccatggcccggggtgatggctgtggggcttggtgctcccagagagctcagtggctacagaatgggtggggattctgcgtgtctcccggagcctgaacccctttcctggttatggccggtagctgtctccagggctaacgtgggcagcgcaggggggcggaaaccgggttttagccaaatgcctcgacatcgccgcgcctccgcctcctcgtcgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcagggcgtaaaagcggcttgcattcaattagcagcgaagctcgcgggcgctggcgggacaggcgcgtgaggccacaacacatgcgtgtatcttgcttgggctatcttccctgctctgccacgccgggtctggagaaggggtttcagccccaggacatttactgagagtcggcgaatattgggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccggagcccgtgcccttttctaaacgcgtctgtatgcagtcaataaaacaatcgatttg

SEQ ID NO: 991 - DNA, 2814 bp, Homo sapiens
agctgagtgaggacctgctgtcccaggcagtgatgatggtggagaacagccggcccacattggcgatcaacctgaccggagcccgccagtactggttggagggcatgctgcggcatgagataggtcagggtgtgggtatccgggcagatgggtaggcatgaaaggggcctgggagctgggaggggtgggaaggaggggccccaataactcccctttttgtttctcccccttccctcctgaggtcggggctttcccttcctgagcagccacctcccgccctctgcttacagaggtaggccagaacatgcctgcccatgctctgggctcgctctcatctcttggtcctttcgggtatatttttctctctccacttcctctccgacttctcccaacagtgcgggcaaggctggtcaggccctgaccggccagagaaagaaccctcagggtcccaccaggccagccaccacgctggccctccagggtggatggaaggccaggtcctgggaatggacttgacttgaggacacatggcacctggtttaggaggggactggccagtttgggcaggggggtgcagggcactaaccactattcctatctgtctgtccctcttcctcgagaatcctgttgctctgggcaagagtgatttttaccgggggcatcagcatgactgttcaagatgatatgggcacccaggatgttgggcagggtggtatatgtattcttgtgcccaggagggctgggggcaatgtcagtttgggagagttcgtgcacgtgtgtgggtgcgtgggtgtagggtggggggcggatgggtgggagaggattcatgtatgtgagcctctgtggatccttgggtgcgagtccacaggaggaggagcttcacgctgcctggggctgggagagcctgtgtgcgagcctgagttcaggagcatgaggatggaagtgtcgcggccagagccccggccagatggaacagggccagggctgggctcgcaggcgggtccccgaacgccccgcccagcgccgcctcccctcgccttccccgcaggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacatacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgac

SEQ ID NO: 992 - DNA, 2953 bp, Homo sapiens
gacggcgggctctgcgctccgcccctcaagtccccggcagcggttggcgagtggggaccgaacccccggttctccatgatcccgctggccggggccgtttccccagagcgaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctgcatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacagcatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctcatctctcatgcttcaatttttcttttcttactgttaataggaaaaaaatcaacatctgtaaattaagaatacagcaattatctgtacagtactgcatatttgtaatacccttgtatatatgttacttgaatacagaaatgttcatttgtgatgctttgcacttgggggtggggggtgggagggaaatcaattgcaacaaagagtgtgagatgtgagattgtatagagatgaagtgtcatcacatcatgtgcatggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttac

SEQ ID NO: 993 - DNA, 2581 bp, Homo sapiens
atatttaattacaagtgtgcccctggtagtctttaactgaagggcactgactgggtcactggtgaagttccccgcaggaactgagtcagaccccatctcagggccctgcacaagataggtgcctgctctaaggcgtggaccctcgccacagccctggcccgtcttgacgggcgagggttactgtacttgtcccaaccatacagatgagaaagctgagactcagggccagcaacccgggtcccagcggagcgcccggcacacgccgacacttcagcaccagtggcggtggccaccactgtgcgcggagatggctgcgacgcgtgcgcagtctagtgcttttttccagatctcgatcccaaactccctcctgccagaatctggacccgaatccacccattgcccgttttctgctgccgctggagagaatctctgaggtccccaggagagcctgcctgcacggaagagacgcctcctcggtatggccgcccccggagaggagcgattaagtgcagacctccatgttgctcttgagcctgagcggcttcagggagccatgtttgttactggcgggcgccgacctcactgagcatgtgcagccctggccgggcggcctcaaagttctgacatcacagggcggttcctgaagtggacgtagttgtaagagctagttattttagacaatgcctctgtgatcagggactctaatctggaaataggtagtcggagaggtcggtgatgcagtctctggatcagagacctgagctatatggggttagagaggggccctgggcaggcgagtctctggggagtgtgatgagaatccttgtgtaagatgctgggaggaggtggggtcagggctggggtccgtgggccgacgggttgggggatggccagcgtcagggatcagtagtagagattctatgtgccctgatcgccagtggaggttttaaatacagagtattcatgagtttagcaatgtttttcgcctctcattatttaaataatttgaagttttccccaataactagtgtcttagaagtcatgaaaatttcagaaaatgacaggtcttctgagttcgtgatgggagttgggcagcagtcgcatacgagcacctggagagtccttgccagttctttggggatggggagctcttaagactgccctgagaccgccctttgacctcattgtggtcctttctagattaaatgctgttttccatgaccgtctctgttcttcccatacgcgaatggcaggcattcagatctccaagaatagaggactaggagagactccaccacctatgtcctcacagttaattatcgatttgtgtcagttgcccattttctcacttcctgtttgtgtgtcaaggggtattaataaatctttgcctatttaaagatattagccttggattttcaaatattgcatattttgacatgtaaaaatttgttagttttattttttcaaccgatctgacctgtatagttgggcttgaggaagcttcctcattctacatgttactatggattttctaatattaacacagggttgtattttttccatataactttctattgaatttctttttccatatgataggtggtgaaggtttagcccagtaaagcagagaggttaagaggttagattgggggctctggagccagacctgtgtagatctgagtcctggctctggcacttgaaagccgtgtgaccttggttaagatacttagtccctctctgccaaatggagaaataagggcacctaccccatagggtagttgtgtgattacacaagttaatacacttcaatcagtagcaagaaagtgaatgtcaagctgtatttgttcaggcagccatatggtagccccacgtccttagtaaactgaggtattgaagtatcttctttttctttcagaaaatatttgtcaagcaccttctgtgttcaaagaactgttctagagctttgcatgctatggaggtctagaaattcacattatggtggcaggtgacagacaatacaaggagataaagcaatttcatatagtgataagctagggaggagtgctaaaaggagccaaggtgtagtggtgactggaaggtgaccagggaaaccactgtagggtttctaagtgatgagatctgtgacaaatccctgtggtcagcagcaggcattggatatgtaactttattctgtcccattgatcttgtagtcaaccctggtctgttctgtattgttttaattacataatctttgtaataatctttaatacctggtggagtgctctgtttacttatttctgcataattaaccacccctaagcttaacttactcatggttctgcagggtgactgctctccatggttctaggtggttctgcatggggcctctcacatgtgctacagtcaaacattagccggggccacagtcatctgaaactcacttacatggctgacaattgatgttggctgttgcctggagaagacatgtgtggcgtggtggaatggaatggtgactagattcaagaaagagcttcccaggaggaaggctaccaagagaccgaagtagaggcttcagtttctt

SEQ ID NO: 994 - DNA, 2914 bp, Homo sapiens
atctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttttctgtttctgtttctgtttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtgtacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcccgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctgg

SEQ ID NO: 995 - DNA, 2383 bp, Homo sapiens
agcagggatggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagcctttcatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactttgctcctactattcaggaaattaaatctggcaccgtgacccccggacgcagtggcctgataagatgtgaaggtgcaggtgtgccgcctccagcctttgaatggtacaaaggagagaagaagctcttcaatggccaacaaggaattattattcaaaattttagcacaagatccattctcactgttaccaacgtgacacaggagcacttcggcaattatacttgtgtggctgccaacaagctaggcacaaccaatgcgagcctgcctcttaaccctccaagtacagcccagtatggaattaccgggagcgctgatgttcttttctcctgctggtaccttgtgttgacactgtcctctttcaccagcatattctacctgaagaatgccattctacaataaattcaaagacccataaaaggcttttaaggattttctgaaagtgctgatggctggatccaatctggtacagtttgttaaaagcagcgtgggatataatcagcagtgcttacatggggatgatcgccttctgtagaattgctcattatgtaaatactttaattctactcttttttgattagctacattaccttgtgaagcagtacacattgtcctttttttaagacgtgaaagctctgaaattacttttagaggatattaattgtgatttcatgtttgtaatctacaacttttcaaaagcattcagtcatggtctgctaggttgcaggctgtagtttacaaaaacgaatattgcagtgaatatgtgattctttaaggctgcaatacaagcattcagttccctgtttcaataagagtcaatccacatttacaaagatgcatttttttcttttttgataaaaaagcaaataatattgccttcagattatttcttcaaaatataacacatatctagatttttctgctcgcatgatattcaggtttcaggaatgagccttgtaatataactggctgtgcagctctgcttctctttcctgtaagttcagcatgggtgtgccttcatacaataatatttttctctttgtctccaactaatataaaatgttttgctaaatcttacaatttgaaagtaaaaataaaccagagtgatcaagttaaaccatacactatctctaagtaacgaaggagctattggactgtaaaaatctcttcctgcactgacaatggggtttgagaattttgccccacactaactcagttcttgtgatgagagacaatttaataacagtatagtaaatataccatatgatttctttagttgtagctaaatgttagatccaccgtgggaaatcattccctttaaaatgacagcacagtccactcaaaggattgcctagcaatacagcatcttttcctttcactagtccaagccgaaaattttaagatgatttgtcagaaagggcacaaagtcctatcacctaatattacaagagttggtaagcgctcatcattaattttattttgtggcagctaagttagtatgacagaggcagtgctcctgtggacaggagcattttgcatattttccatctgaaagtatcactcagttgatagtctggaatgcatgttatatattttaaaacttccaaaatatattataacaaacattctatatcggtatgtagcagaccaatctctaaaatagctaattcttcaataaaatctttctatatagccatttcagtgcaaacaagt

SEQ ID NO: 996 - DNA, 3342 bp, Homo sapiens
tgtagggtgctggctgaatagactctgtccagccctgttctgtagtctcaagctgcctgcgatggcctgaaattccacctttcatcccctatggatgacagagagcttacagatgaccctactgaatgcaagcacctttggtgaggagcatcacagggctccttctggagcatttggtggggacagctgcagagaagaggcctggaactcgggcagcactgcagtgccaggaggcaggcggggaaccgaggcaaaggctgcccatctccccctgccaggcctgtgtgaccattatcaccaacagctggtgggtggccgggccaggatgcagcggggccttctgatgcccaatcagcacggctgccttcctgacccagtcaaggcctctgtctgaaatgagtcgctccaggttctcagcatacacttccatcgcgtctgtcgggtattgttccttaactgtcccatctgtgcagagtccattgccccaactagactgtgagctcctcctctgagccttccaagtcccccctccgccttcgccacctcccgctcgtgcccagcacaagtgagcctggtgtggaaaccactccattgcccggtggaatggattctgtaatcagtggttcctggccttgcctgcagaatagaaccaccagagtcctttaaaaagtattgctgcttggttcccacctcagaggttctgagttaattggactggagcgcagtcggacatcaagaaatgttgaaaagctccttgggttctcctgacagcaggaaccactggcctggcaccacctgggtgcttcctctgtgccctcgctggggtaggcattggagcaccagagatgaatagccccaagtgctccctctttggggttcccaaggcaccctgtgcctgcttccctcagaggaccttccaatccatttgccccgcaaccctggctgctccgacaggggagacttgtctcccttgttcccctcaggatccatagagtggacagtaaaggtgctcagtacatgttggctgagctgaactgcatacatgtggcccccaggttcctggtctttatggacgaagggcacaaggtggaggggggatggggggatgctgctggaggtctcagtgggtgcagacagccctgccttgaggatggcttgacctgggattgacaaagtgtgtctgctgaaatgctgaggtccccacgtgtgaatgggtgaggctgatgtggatgtctgtgtgtgccagcaggtgggtgggggatgtgggtgtcagtgtatgccagtgggcactgtgaatgtctaggcatgtgctggtctctgtgtgtttgtgtgttcctcagcaggaatgagtgtctttgtgtatcacctggtgacttgtcagtgtctgtgtctgtgtgtgcctgtgagccagcatctctgtatcagtgttgctcatgctgtgtctttgtgcgccatggtgtgtcagtgtctgtgtgttgatgggtggcccatgagtgacccccgccaggggagaccaggctggctggatccagcacatctccccagtggcagcctcgccctctgggtcagggtgactgaggcattttgtggccttaaaacggggtgttcagggtcagccctcagggtgctggggcccttccatcccttgtccccttcaggttggtgaaaaggactccgggggccaggtgctgtatagcagcttatggaagtctcagctgggctatcctgcccttgggagcacagacaggctcctagggtgctgagtgaagcctgaagaccaagccccctcctcctggaatgctccttccacccctacctctcagagatgggcctgacacctctttctcattcattctccttttccctgtgctctgggaaagcccctggctcaggctgtcagagtgaggatggacctcaaaagtttgatcccctcgtgcagatgaagaagctgaagcccagagtggggaaggggagtggcccaaggtcacacagctagtttgagtagagccagtcttgggagagccaagtactacagccctgggggtgtcacaccgcttgtcactgcccctgaggtctcctgccaaacaactgcagggagtttggctaacagtcctgtgtccagggtgccggtggggatgttatagatgttgctgggatcctgccctcggctccaaattctggcctctcatcccaggctgcagacccttctgccccatgacaggcctgggtgccacacagaggtggccaccctcccaccacagtgtctgcagctgctgcccttctcccaggcccccagacagaagagaccctgtttcccctcctctcccctgtgacttcacaagagcttaggctaggagtgaaggtcagcatgttctcatgtgctcatcctcttggtttccccaaagaccgggagggtcacggatggggcgtgcagaatccttgtgttttttctcgctgggcagcttgaggggctggggagtattcccagggtctttgctctggagagtccctgcagagccactggctgaggttgggttcagggttcagcggagtcctccatgcttccaaaggccgggaagcacccgcctctctatcgagtcagtgctgtgcgtgtgtgtctgagaatgtgtgtgatgtgtggagtgtgcgtgtgtttgtgtatgtgtgtgtgtgtgttggggcagaaggaccactctttcctggggatcccttgacccttataactagaagggaccttagggagcatctaagctggtgcccccattgtacaggcgaggtccagagggatggcatctgcccaccccaccccttcccctcttgttgcctgcactcatttcccagggaccctcctaggataggaatgccctccttcctggccccctcccgccatcctcccagccacccacataatcaccatctcagcccaactctggtggccctctaggtctccatgcattcttcctgccctagagtagccagctcaccaaggcctttatccccagcccaggagaaggttcagggagggaaggggctgcaccagccctgagacctcaaagacttgggagaaaagccaaaactcctcatgcccaggcccacatgtctgaccaccccagcccaccccgccaccaaggtaaaagcacaacaggagacccccttattaatgggtgaaatgattggggttgtttttttagtcacacagccccatcctcacccctttgccttgctgtctgtctccaccccagcctctgttccccatttgcctctctttcacctccaagcccccaaatgtaacctctagttgcggacgcggttgttctatcaataaagctgcagtgttctagc

SEQ ID NO: 997 - DNA, 2759 bp, Homo sapiens
ctctgccagccctgagctgggaagaagcagctacctcggaggcagggcgcgcaggcgggcggcgatgagagggggcgcagccgcagccccgcgctggggagcccaccgctaaccctgcaccccacccacccctgcgagcatcctcttcctcctaggctctgaaggcccggggagcgtgagcgatgcccagctgcacccgggcagggctcgcctttgtttgccagtaaggaggagaggctgtctcagctgcagaggggtcatccctgcttcaagccagtgcctcttcccagctcccatggggaccaccgaagccacgctccggatggaaaacgtggacgtgaaggaggaatggcaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggagggtactacggcgaaggcctcaacgccatcatcgtcttcgcagcctgcttccttccagacagcagcctccccgactaccactacatcatggagaacctcttcctgtacgtcatcagcagcttagagctcctggtggctgaggactacatgatcgtgtacctgaacggtgccacgccccggcggaggatgcctggaatcggctggctgaagaagtgctaccagatgatcgaccggaggttgcggaaaaacctgaagtccttgatcatcgtccacccctcgtggttcattcggactgtgctggccatctctcgccctttcatcagcgtcaagttcatcaacaagatccagtacgtgcacagcttggaagacctggagcaactcatccctatggaacacgtccagatcccagactgcgtcctgcaatacgaagaggaaagactgaaggccaggagggagagcgcgaggccccagccggagtttgtgctgcccaggtctgaagagaagccagaggtggcaccagtggaaaacaggtctgctctggtctcagaagatcaggaaacaagcatgtcctgaggcgacgtgagcataacaaaggacatggaagaagattccagatgccagaaaacctctgtcagacgcccactggccccagatctcatcctgcctcatcctgagtcccaatcttccaagggtgccagcccctccgttcatctctgaaacccagcatccttttcagctgcttgaaaacattgtattttttttttttaacgatgcagtatttgtgcgttccagaaaagggcccagctctgagcccctcacccttccacactcacgaactctcagccgaggaaggcaagaagcgcagggggtggcccgcgtggcgtcggtggcctccgctcctgctcgcagcccctgtggtcagagctggatacaagattcaagacccttctcttgcttgtcacccgctccaggttggagccacagacacccaccgccaccccggctgggtctgcgtcctttcctgtgcctttccctccagaatgcggcctcagacctagaagctcaacccccctatgagggccacgtcctggggtagctcctgacctccgaccttatgtccaaatttcacacccatggtttttcatttgacccgcccccttctcgctcataatgacacccagctcctttgagaggatcagagcccattgcacaagaagagccgctgccaaccatccttgtcctccgattgcaaaatgacaccccagtaatctagaacattctcaagcccctttaactcagatgtcaagccaccgggcaaaccccgtcaatacctcccaccaaggaatgagatatgtggacctcactgctcccccaacccagcgtcaggctgggacatgccaacgctgttccgggttggaacagcagaggctcagaaactggctctgaaataggcagacctagcaagaggaagatacagggtatcgggcgtttgagtgtttcagaagtcattcgggaagataaatccagtgcgctggcctcagccacctgcattcaaagcttggaccagcgggttcttgttcgggaggcaaatttccctaggaaaaagaagacagacttttctaatgtggtccaaatgcggatcactggtcagatggactctagaagcactgagctccctgtctctggaagtatttaagaaaaggctgggccaggcacgatggctcacgcctgtaatcccagactttgggaggccgaggcaggcggatcacctgaggtgaggagtttgagaacagcctggccaacatggtgaaacctcatctctactaaaaatacaaaaattagccaggcgtggtggcaggtgcctgttatcccagctacttgggaggctgaggcatgagaatcacttaaacctgagaggcagaggttacagtgagccaagatcgtgccactgcattccagcctgggcgacagagcaagactctgtctc

SEQ ID NO: 998 - DNA, 3457 bp, Homo sapiens
aatgttctgaccggtttggtgtttgtcatttcactttattaagtaaagaggaaatcgggaaaggaggaatagagagggtccccgagttcattcaagagcagaccgagagatgctccgatcccgagtcgggccggtggcggggtcaggccggcgcccgaggggggcgaacgcggacgccaggtcgcgcggtttaaatctcccgcctcccgcagcgggagcctgacacctccacgcactggtgcggaggggcactggctgccggagggccgggagtcggcgcggggctcgcgggcggtggccggaacgggtgccgggacggatcaccgtacggccgaacgcgacccgaggaggcggaagagcggcgccgtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgtactcctctgtctcgtctgaagcaagaagtagcaacattcagtcaaagggcagtatctgataccttgatgacaattaatcggatggagcaggcacgcacagaatacagaggagctctactgtggatgaaagatgtatcccaagagctggacccagacaccttaaagcaaatggaaaagtttagaaaagtacagatgcaagtgagaaatagcaaagcttcttttgacaagttaaagatggatgtttgtcagaaagtggatttacttggagctagtcgctgcaatatgctatctcattcgctcactacctaccagagaacactgcttggattctggaagaaaacagctcgaatgatgtcccaaattcatgaagcctgtattggctttcatccgtatgattttgtagctctcaagcaactacaagacacgccaagcaagattagtgaagacaataaagatgaacaaataggcggttttcttactgaacagctcaataagctagttttgtctgatgaggaagcaagctttgagagtgaacaagcaaacaaagatcacaatgaaaaacattctcaaatgagagaatttggagcacctcagttttctaactctgaaaatgttgcaaaagatctacctgtagattcattggaaggagaagattttgagaaggaattctcatttctgaacaacctcctaagttctggttcttcaagtactagtgaatttacccaagaatgccagactgcctttgggagccccagtgccagtctcacatcccaggagccttccatggggtctgagcccctcgctcattcttctcgattccttccttcacaactctttgaccttggctttcatgtggctggagcgttcaacaactgggtctcccaagaggaatcagaactttgtctttcacacactgataaccagccagtgccttcacagagtccaaagaaattaacaagatcccccaacaatggcaaccaagacatgtcagcctggttcaatctgtttgcagacttggatccactttcaaacccagatgctattggacactcagatgatgaacttcttaatgcttgactgaagttataatgtcacttcagtggccttgagacatcaattttgcaacgtatttccttcgtggaaaggatttagattgtaacccgcacacaaaagcacggtgtttgtgaatataacacctgtcagccaactttagacagatggtaaagaccacatttgaataagtacacatctttcatatcttggatttgcagctgttggtactatgtggaaaatattagaaacttctatgtggaaaatattagaaactacagagtttgcgatatttagatactgaaatttatgtcaaaataacggctaggaataattctgtcaatatggagttgagcttatttctttggaaacccttttaagttgccttgctggctgtgagaattttatatgtggataacaaagatagatagatagcatgtaaattgggttgtggtttggggtcagtttttaaatgaaatagtagcgaggaggattttctgttttggaaaacaccattagaaccagaccagctttgttttgggttagagagagtaagatttgagaactcagtttgctttaatgaaatcacagagaaacttggtacttgtttttcttcatttggaggctaaaatgtaatgttttttcattcatacaaaataatggacactccctaattccattattaaatcttgaaggggaagtagcaggataattaatttgctaagcccatcctctgcagaaacagaaaaatctatcttcccatctcctaaaactcagaatgcacagtaatacttaaggcttgtacaagtgtcttcagacccactttttcatacacttgctatatagtagtatgcagtatttatattattcctgaaaataaaatgaggggagaatattccctaagcaactggcaatagtattcctgaaatacctagaaatttctatctgaattagggagacacttatgaacaccttatccttacatatatttgcatacttatctcatattttgtgacataattatttaacccagaatactttctggcagacatacagaaagctctgtgtgatcaataagggagtgtctcatttttctacttccctctttctgtgggtgacatgatctgaggttctatttgattactaagcaaaatctgttacccctacagggtttagaacctaagtattagagaggaaggctatttaatggaagttagtgtaagctgataaaaacgtagctaccgtacacacacatcaatcactcaatttcctgtccttttaaattgcccaccctttaattttgaagcaatttcccaagtgtgtgtttgttttatatttgtcatccagtccattgcatttccataagaagacattttgactggctgggtgcggtggctcacgcttgtaatcccagcactttgggaggctgaggcaggcggatcacgaggtcaggagatggagaccatcctggctaacatggtgaaaccccgtctctactaaaaatacaaaaaattagccaggcgtggtggcacgtgcctgtagtcccagctactccggaggctgaggcaggagaatggcgtgaacccgggaggcggaggttgcagtgagctgagatggcgccactgcactccagcctaggcaacagagcaagactccgtctc

SEQ ID NO: 999 - DNA, 2860 bp, Homo sapiens
tttttcaaaaaagctgctcagcggggacaaatacaggttctcgtaagtattattcgtcagtgaaatctccaagtcataagacgaagaggacttcctgctcactgtaagagtcagaacaccccacaggcctgactcccttcctgtctggcttgggtggcctttacaagtaccctgtctaagctcgggagggacccgcccgtttctcagctactcccttgagcccctcagccagcctggtgtgcgtttgcgttttcatttctgggaagctgcagcaccctagtcctgtctagagagaatgaacgtcttctgggctggggtgcctgggtgttcttgctgtgagggagctgcgtgtgaactcggcctgtcccgacacggggggcccagcgtgttctgtcacccacagggccccggagctgcagttctacaccagcgccgctgcggtggccatgctcgtcccggcccgggttttctttacggacgtcccagtgatcgggaggagcgggaagagcttcagctacaaccaggacgtggtgctgctgcttctgacagacggagtcctgttccaccttcagagcgtcacggcgtacgccctcatggggaaaatctccccggtgactttcagcgtcgccagcaccgtgaaacatgccttgtccatctggctcagcgtaatcgttttcggcaacaagatcaccagcttgtcggccgttggcacagccctggtgaccgttggggtcctgctctacaacaaagccaggcaacaccagcaggaggcgctgcagagcctggctgcagccactggccgggccccagacgacacagtagagccgctgcttccacaggaccccaggcagcatccctgagagcaggaagctgccagctgctgctgtcctcgtgacactgcatcccccagaaatgggcagggacgccctcctccatggccctgctggggtgcaggacatggggagctaagttggccattgcctgcggctttctcggtttgtcggtgaagaccagcagaaactcaaactggggattccaggtatcagcttcctggagtagagaccagaccagtagctgactgtgtccgccgagcccatccccgtgtaatgtgaaaacagcctctgaggctcccatgctgggggtgcccacttcctctctgggcgacaccccagggtccaccgggagccagaggtgggtccagtgccaacgagagccgctccctgccacagccaagagagccctcggcttcccacaccagccatcgaaggccctgaggccctggaccggcggcagactggccctgggcatgaggccacagagcagggccgaagggaggggacagagggccctggaaggaagggtctcctgctgccacggtgggcactcagaacttctccccacctgacccagggctgtgggcatcctcagactatcccagaggcatcgcaagcctcaagctgcagcattgcacggcactcaagggctatgaccacggaggccgttcagtcgcttctgtttagaggaaggccccctacctcttccacaccctgccctcctatcccttccacaccctgggctgcgtgagctccccgcaaccccagggcaccctgccctcctacctgtgggagtttccagccctgaggttgaggacaaacctctcgtgtttaacttgggaggagatgcgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttgctgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggctccagtggtcctgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtgcagtggcatgatcttggctcactgcagcctcgacttcctgggctcaaatgatcctcccacctcagcctcccatgtggctggaaccacaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccccggatttccatttctttttttctgctttcctca

SEQ ID NO: 1000 - DNA, 3680 bp, Homo sapiens
agacagagaaggccatcgagctgtcccggaggcaggctgaggaggaggacctgcagcgggaacagctgcagatgttgcgtgaacgggagttggaacgagaaagggagcagtttcgggtggcatccctgcacacacggactcggtccctggacttcagagaaatcggcccttttcagctggagcccagcagagagcctcgcacccaccttgcttatgctttggatctaggctcttccccagttccaagcagcacagctcccaagaccccttcacttagctcaactcaacccaccagagtgtggtctgggcccccagccgttggccaggagcgcttaccccagagcagcatgccacagcaacatgaggggccctccttaaacccctttgatgaggaagacctctccagccccatggaagaggccactactggtcctcctgctgcaggggtttccttagacccttcagcccgcatcctgaaagagtacaatcctttcgaggaagaggacgaggaggaggaagcagtggcagggaatccattcattcagccagacagcccagctcctaaccccttcagtgaggaagacgaacatccccagcagaggctctcaagccctctggttcctggtaacccctttgaggaacccacctgtatcaacccctttgagatggacagtgacagtgggccagaggctgaggagcccatagaggaagagctcctcctgcagcagatcgataacatcaaggcatacatctttgatgccaagcagtgcggccgcctggatgaggtagaggtgctgacagagaatctgcgggagctgaagcacaccctggccaagcagaaggggggcactgactgaccagcagtggagagggcacctttgggcccaggggtctggcaggagccagtggagcaggacagagggcaggcaggatggatggggaaggtggcagggtgagaactcagatgcacacaggtgaggggcaggaatctgctgttttgtgttgcgcactttgaggtatttccactacagttgaataataaaatagaaactagaacagggagaatcagcattcagttgctgcttttcctgtttattattactatcttttgtaatcggaggtttaccccttttgaagggactttacatttttactaccgagatataactaaatgcagctctgttgggcccagggcagaaatggctgctgtgtacctcttgggtccatttgctactgcctagtcttggttccttatgcagtattatagggcagcctttttagagcccttcctttagccaagacagagaagatagattccactgagctctattctgctctgacagaagtccatccctagtaggctgtgagttccatttcacctggggccgcctctcccctgctctgcacttcctgtctgtacaatagaagggggaggtgctgctatgaaggggagagtttagacccaggagagcccagcacctctttttaaggtggggtgatgggaatatttcaccagggtctattttctcagtttaagttcttttttgtctctttcaggaagttaagctcccagtgcagggtatcaatgtgaatctggtcctgagctttctagaaaataagagtggtgagccactgtgcccgccctgatgagatattttattaccaatgttagtattgagaaactgaaatgtttgaagaagcacaacccaggatcgtgctggtagcaccacagtacttaaactgttggtcaattaaggccagaaagggaaattgttaatttagctctggtgctttggtttacaggaacataactcttaactgacatctgacatcatgatagccatatgtgctcagctctgggtagagtttctgcagttactcatctgaactaatgaacaataactgaccactagtcactttatgccgtgtaactagctctaggccatactttcactggttactggtgtgaaagctgaaattcattttgttacattctggtgaagacccctcttgataatgggaatgttttaactctcttgatgaaaaaataatctgtatttgtgttgatgttcacatttctgtagcacatttcttatccttttggttgaatgaaaagatcttgtataggggtgtggagatggggagtgggtaaaagtgtgtgaaggacgctttgcatttgggatctgttcacaaacagccatatgagtgtgttaatgaatgtcagccagttaccaaccctgctggttgttatgggttgttttgagaagttggcaaccaggcatctaagatgttgcctggtacaggcctcttttcttccctgaggcccatgacatttctctgttactctagagggtttctcagatggccagtaggctcctccctgcttagggtctcatttctctgaaaagaggatgaactgaaaagcaggtagttccagaagctaattgctgctttccatcataattatttttcttgtgagaacatttctcttttaattagctagtgattttgattaagactaattcactaaacatacccttccctcaaatcacctcaggtagcaatctgtaagtaactaaaagcattgaaaaacacacaagaaacatttttaaaaactatttttaaaggcctggccgggtgcagtggctcactcctgtaatcccagcactttgggaggccgagacgggtggatcacctgaggtcaggaatttgagactagcatggccaacatggtgaaaccccgtgtctactaaaaatacaaaaattagctgggcgtggtggcagacgcctgtaatcccagctactcagggaggctgaggcacgagaatcgcttgaacctgggaggcggaggttgcagtgagccaagattgcgccactgcactccaacctgggtgacaagagcaagactccgtctcacaaaaaacaaacaaaactgactgattgaatatactaaaccaaactaaaatcatattcttttgattaagtttatccatggctgtattcttctatgaattcttccatttaattcttccacgattatcttctcctgtaaatacatcacaggagttagaattctctacccatcagctgtaccatgtcgcagaattcatgcaggcacaaagttggagttacagagatgggttgacagcaggcaaacttggcctatgtattataaccacaacttcaagttcttacctcatgtgaatattcaccctttctttagtcttccaaggcaaacagccccgtctcatcaccagatgagcaaggtcttgatatggcatagcagatctccctagacacagatcatgagaaaagatggaagagacttagggattcaggcatcagatgaagttggcttttcccttttatgccttgtttgtatttaccctgtctaatacactaaggatacttactcattgtacttgcagctcaatatgtctttgctgttcagatactaaaatgtacctctgagtcattgtgagctgtgtggtaggttggacattggcatagttggtgatgggactcaaaatgaaaaggtggtctctttaccaggtcacagactgtagcagattgtgcttgttatctgacaatgactgtcactttgagggtcgttgatttgcatgcactactctggggccttgtattggagccttttttaaaaaaaataaaatctgagatag

SEQ ID NO: 1001 - DNA, 2781 bp, Homo sapiens
atacaaccaaactaagcttcgtaagcaaaggagaaataaaatcctcttcagacaagcaaatgctgagggaattcactgccaccaggcctcccttgcaagagctcctgaaggaagcactaaatatggaaaggaaaaattatttccagccactcctaaaacatgctgaagtataaagaccagtgacactatgaaacaactacatcaacaagtctgcaaaataaccagctagcacaatgatgacgggatcaaattcacacataacaatattaactttaaatgtaaatgggctaaatgcccccagttaaaagacacagaatggcaagctggataaagagtcaagacctatcagtgtgttgtattcaagagactcatctcatatgcaaagacacatataggctcaaaataaagggatggcagaaaatttaccaaacaaatggaaagcagaaaaaagcagaggttgcaatactagtttctgacaaaacagactttaaaccaacaaagatcaaaaaacacaaagaagggcattacataatggtaaaggattcaattcaacaagaagagctaactattctaaatatatatgcacccaataccggagcacccagactcataaaacaagttcttagagaccgacaaagagacttagattcccacacaataacagtgggagactttaacatgccgctttcaatattagatcatcaagacagaaaattaacaagaatattcaggacttgaactcacctctggatcaagcagacctgataattatctacagaactctccaccaaaaaacaacagaatgtacattcttctcggtgccgcaatgcactgactctaaaattgatcacataattggaagtaaaacactcttcagtaaatgcagaagaactgaaatcataaatcacactctctcagaccacagcacaatcaaattagaacacaagattaagaaactcactcaaaaccacacaactacatggaaattgaacaaccttctcctgaatgactcctgagtaaacaattaaggcagaaatcaaattgttttttgaaaccaaggagaacaaagagtcaacataccagaatctctgtgatgcagctaaagcaatgttaaaaggaagatttatagcactaaatacccacatcagaaggctagaaagatctcaaatagacacccagcatcacaactaaaaaaatgagaaccaagagcaaacaaacccaaagctagcagaagacaagaaataaccaagatcagagtggatagagacacaaataacccttcaaaaaaatcaatgaatccaggagctggtttttgaaaaaactaataaaatagattgctaactagactaatgaagaaaagagagaagaatcaaatagacacaataaaaaatggtaaaggggatatcaccccgaccccacagaaatacaaccaaccatcagagactactataaacacttctatgcaaataagctagaaatatagaagaaatggatacattcctggacacatacaccctcccaagactgaaccaggaagttgaacccctgaatagaccaataacgagttctgaaattaggcaataataagctaccaacaacaacaaaaaaaaaagcccaggaccagatggatttacagctgaattctaccacgggtacaaagagaagctggtaccatttcttctggatctattccaaacaattgaaaaggagggactcctcaccaactcattttatgaggccagcatcatcctgatatgaaacctggcagagatacaacaaaaaaagaaaacttcagggcaatgtccctgatgaacatcgatgcaaaaattttcaataaaatactggcaaactgaatccaggagcacatcaaaatgcttatccactaatatcaaatcagctttatccctgggatgcaaggttgattcaacatatgcaagtcaataaatgtaattcatcacataaacagaactaaagacaaaaaccacatgattatctcaatagatgcagaaaaggactttgataaaattcaacatcccttcatgttaaaaactctcaataaactaggttttgatggaacatatctcaaaatagtaagagccacatgacaaacccacagccaatatcagactgaataggcaaaacctggaatctttccccttgaaaaccagcacaagacaaggatgtcctctatcaccacttctattcaacatggtattggaagttctggccagggcaatcagtcaagagaaagaaataaagggtattcaaataggaagagaggaaatcaaactgtctctgtttgcagatgacatgaccctatatctagaaaactccattgtctcagcccaaaagcttcttaagctgataagcaaattcagcaatgtctcagcatacaaaatcaatatgcaaaaatcacaagcattcctatatgccaacaataggcaagcagaaagccaaatcataaactcccattcacaaatgctacaaagagaataaaatacctaggaatacagataacaagggaagtgaaggacctcttcaaggagactacaaaccactgctcaagtaaataagagaggacacaaacaaatggaaatacattccatgatcatggatgggaagaatcaatatcgtgaaaatggccatgctgctcaaagtaatttatggattcaatgctattcccattaaactaccattgacattcttcacagaattagaaaaaactactttaatgttcatatggaaccaaaaaaagcccaaatagccaagacaatcctatgc

SEQ ID NO: 1002 - DNA, 3841 bp, Homo sapiens
tatttgtatttttgacagagatgggatttcaccgtgttggccaggatggtctcgaactcctaacctcgtgatccgcctgcctcggccatccacagtgctgggattacaggcatgcgccacggcgcccggcctcctacagtgctgggattacaggctgagcccccacgcccagcttcccatagtgctgggattacaggcgtgagcccccgtgcctggcctcccacagtgctgggattctagcacccgacctcccacagtgctgggatgacaggccgagcccccgtgcccagcctcctacctgtggtggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttgctgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagccggcggattcccatgcccggtgcagcctgttgccagccagcctttgagacccagagctccagggcttgtcagaggcagcatggggctccagtggtcccgagtctcatttccctgcctgctctttaggcctttggcacccatggtcacttcactggttttccatttggcttctcacctgggaaatacaaaaatagcccctcctgaagataaaatcgttcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtacagtggcatgatcttggctcactgcagcctcgacttcctgggctcaagtgatccacctcagcctcccatgtggctggaaccacaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccctgggtttccatttctttttttctgctttcctcaaaaactaatagaagaccggctgcggtagctcgggcctctaatcccagcactttgggaggctgcagatggcggatcacaaggccaggagttcgagaccagcctggccggcatggtgaaaccctgtctctaccaaaaatacgaaaattagctgggtgtgatggtgggtgcctgtggtctcagctactcgggaggctgaggcaggagaattgtttgggccccagaggcggaggttgcagtgagccgagatcgtgccattgcactccagcctgggcaacagggcaagattccgtctcaaaaacaaacactattagaaaatgctctggaggtggcggggagttgttgatttgtgaggacagattgaaagcaactcccagggtggccttgtccacctccccatcgagaatatggctgccggcctctttgaagattgtggtctggcataaggagaggtgcaggcgcctggttctgagcaccttggaatttccagccgcacagaatctggtgccctcccctccaccctcacaaggagctgccatcctgtttggattttctgtttgtggaccagaaacaaacgtttttccaaaggattagcaaataggttgatttcctgtgtaacgctgctctggggcctcttcctcatcctggcagaaggagcctggagcccatgaggcagccagcactgtgcccttgctcagtcgtgctgtcccctccctctccctcagtctcttctccatgcccaagtcagtttccagccgctggtcttcatggcattcccagcacagctggacaccaagaggcaaaacccaaggcctggcttggccgtgttaacgattgtacagacatttttttaaataactttgtgtaatacttttctagaatagtaagttcttgttgaactgtcacagatgagcttctaggaacacaccgggtgtggttacttccactgggtgtgtccatggtcgtggtctgtgcctttgtaaacaaacagaacacttgaaccaccttccgaattgggtcatcggcttctttacattgatacttagagatttgcagctctctaactttcaaggaaacttcccctactgagaggcataaaaaggttaaaaaagaaaatccgagagtcccaattccctgtataacagcattaaaataatctgcctgcctggaaagatgagaacactgttgcacaacccaaaatgtgtttttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacgggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatctgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcgctcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccatggatgcctcctggttatttttgtccaaacgaagcagccgtggtagtagctgtctatgattcttgctcagcaaagtaaaataaatgttaaatatgg

SEQ ID NO: 1003 - DNA, 2758 bp, Homo sapiens
agttcaaatgaaatccccacagcagagagcttttgggtctagcagtggagcgataaacttctgcactggaggggcctctcctcccctcgttctgcacatggagctctaatccccacgcctgggatgagtgcagaatatgccccgcagggtacttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacgatcgccttttgcctcctcgtcggagcactcctcggagaacgggagcttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgcctcttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaacaaacaaacagaagtaacgaagctaagaatatgagagtgcttgtcaccagcacacctgttttttttctttttctttttcttttttctttttcctttttttttttttcctttatgttctcaccgtttgaatgcatgatctgtatggggcaatactattgcattttacgcaaactttgagcctttctcttgtgcaataatttacatgttgtgtatgtttttttttaaacttagacagcatgtatggtatgttatggctattttaaattgtccctaattcgttgctgagcaaacatgttgctgtttccagttccgttctgagagaaaaagagagagagagagaaaaagaccatgctgcatacattctgtaatacatatcatgtacagttttattttataacgtgaggaggaaaaacagtctttggattaaccctctatagacagaatagatagccctg

SEQ ID NO: 1004 - DNA, 3187 bp, Homo sapiens
acttaaaaatgtaaaaaggcagatctgccagcagcttcgtacttgagaccagacaacccacacatgctgtgtgtgcctcacattaagtggtgactcgggactgtgctggctctgtggggctagaaccctaaggagtaccgccggaagaaagcccagcattactatggctgggggacagctgttagatggtcctaggacatcagccatggagaacacagagggtcaggacaaagctaaaatgcccatagaactgccactggttgccagggtagttccatggttggaaattcaaggcccgtctctttgccctagctatctccatttgacatttccaaagagggatgggtggatggaaccccttaactccagagctgggaatcccaaagccctctcaagtgtctaaccaacctctctgccaggaagttcttccttaggtctatcttaaatttattttgctcatacagaagccagtttcctctaatccagggtttagcaaacttttactgtgaggagccaaataaacattttaggatttgcaagccatctgatctccaccagctactcagctctgccgtagctcgaagcagccacagagagtgtgtaaatgaattcatggctatgctccagaaaaactatttctggacacacatgtgaattctgtatacttttcacatgtcacaaaatattattctctctttctctttttttttttttggagatggagttttgctctgctgcccaggctggaatgcagtggctcagtctcagctcactgcaacctcttcatcccaggttcaagcaattctcctgcctcagcctcccaagtagctgtgactacaggcatgtgccaccgcacctggttaatttttgtatttttggtagagataaggttttgccatgttggccaggctggtctcaaacttctgacctcaggtgatccgcccgcctcggcctcccaaaatgctgggattacaggtgtgagccaccgcacctggccataaaatattattagtttaattttctaaaaccatttaaaagtgcaaaaactgctctttgcttgccaactgcgcaaaaccaggcagtggggcagatttggcctgagggtcacagtttgccaacccctgctcaagcctgctcactctcaacgctggctgcacgttgcaataatccaggaacattcacaggcctggggcccacccacaaagcttctgttttgtttggtctgggcttcatagtttttctcccaggtaacttcaggtgcagctggggcggagagtctctgctctccccttccatctgtagcagtgtggctggtgttaaatccacctattccacctctcacagctttggcaaccttaggaaagtttcttaaggtctctgtgccttgattttttcatctgtaaaatgggaataataactctcccttcatagggttgttgtgagtagtgaatgcatacttcttttttttttttttttcttttgagacagagtttcactcttgttgcccaggctggagtgcagtggcacgatctcggctcactgcgacctctgcctcctgggtacaagtgattctcccgcctcagcctctcgcgtacctgggattataggcaagcatcaccacgcccggttactgtttgtatttttagtagagatggggtttcaccatgttggccaggctggtctcaaactcctgacctcaggtgatccccccgtctcagcctcccaaagtgctgggattacaggcatgagccagcatgcctggcctgtgaacgcagaattcttataaggtgtttagaacagtgcctagcacctaataaacctccagtgttagctaatttgttattctaggagaattttagatgtcggttctttgacaatgacccatcacatactctgagatcatttctaagtcaccattcaagctccttccccaaagtgtgttccatagaacactgggaccatgagatgctctattagaaagggtcagggtacggttccatggtcagagaggtttggaaaactgttctggcctcagcccttggcagcatgtgcagattccaggcaccgaggcagggctggaggagtaagtggctttgcaataaaatgggtgctggagtctaaaatgataccctgggtggagtgggggagctgagcaggaggccaggtggcaaccagtagctgctgggcccgtggcctgaaccctcctgcactcctccagctggagtctcaccgcggatcccaggaatacctgctgttcccacagggctgcctttccgtagtttgtctggagacaccaagagtggtttccatgcctgctgggaataggctgagcatgcaatgacatgagggccaaggcttgtgggaaaatgacagcttcacagccccttgaggagtgaccaagccacaaagtaaatcctaaagccacaaccccttctaccactgagctgctggaggtgggtccttatttcaagccatattcaacccacccaacaaaacctaacattgaggtggtgggcacacggcccctgccgtggggctcactctgcagctggagagacagcatacctgaaacctgcaaggaaccggtttataaaacaacagaacagccaggaaaatggtgctaggagagacagtggagaggccagagaagcaaaccactgtggctcctcactgggggtttcacggggttggactgagccctgtcacctctgtgatagtcttcactctgacaggcaatggtgactgtgtgtgtttcctggggaggaggttagcagggacggttgcctttcctgggaagggcggtttgcagaaccaggggtttatattgcagggagtgtattttctgaattctaagtcagaacaagcagtctgatacaggatccatggctgggtcacttctgggtgcaagaggctttctagaccttagacactcaagattacggtcccgggccagtaacagcacctgggagcttggtagaaatgcagaatcttagcctaggcaacatagggagacctcatctctgcaaaaaataacaaaattagccgggcatggtggtgcacacctgtagtcccagctattctccaggctgaggtgggaggatcgcttgagcccaagaggttgaggctgcagtgagccatgatcgcaccactgcactccagcttaggcaatacagcgagaccttgtctc

SEQ ID NO: 1005 - DNA, 2622 bp, Homo sapiens
ctttgattttccctctctgtccccatcccctctgttgcttacatggcttcttagctctcacttggactcttaattgccccttgacagttttctctgtctagtttcttcccttctaagctgactccaatgaatgacctctatatctgcaggaagtctggttctgatcctgatagttaggatcagaattgttctgtactgtataggaatagctcctgttgctaatgggataaagttcagagccctgcgttggtacttggtgttctttctgttctggctcagcccacctttcagcctttctgactgctctccatgtggcgtccatgctgagcagactggaagatttgctttccctgaattcattctatgcatctccacctctgtgcctttgttcatgtttcctaccagctggggtgtccctgcttcctctgaattggatgtatttatcctctgaacctccgctagctttacctctcatgtcccttttgttctttcttttcaggatctgattttgtcctcaccatgctgagatcccagatttcagggatggtttcattcctctttccctgtagcacaaagccatgttagtaaacagttgctcaggaaatatttgtagcataggtgaatcaggcccacctggtaaaatgtaaggatatcagcactttcacttttatggctccctctggttctcaccagggtgttttttttcacttcagcatactgcattttcttttgagcagtccttaacttccagaaaggtacctgaagagaaagtatcttctttcgtctatccagtggggagacttggcaaacatacaagctttgcccaaggcctgggaccgaatttcaaaagacgaacaccaagatcttgtacaaggtactggtttgtgttcttcctttgtgtctcctctcctcctttctctccctgtggctcgcctctttggaagcattaggaaggtgcccttgctgtgcctctgtgtgttttatgttctcgggagaggtgataatgccattttttctgtcttcctatttcagatatcctattgaatgtttccttcttcctggaagagtaaggaagctatgcgtatctggagaccacgggcaccacagttgaagactgacattctgaaccctgatgtttctaaagaaacgtcagtatttcagtctgacatatttgaaacatcagtgccttgaaccttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttgacagaaaatatattttaaaaattttgaccaattgcaatagttatcctcaagccaatttccagaacctgccaccagggggaggtggtgcagcatgaatcattctgaatgctttgtctttgaagtgttcccctattgctgttaccatctcagaggaagtaactgggcatggtgagactcctaaaatgacaggagtttttttggccaaagctggcatctgacttgccacattcctctgagtctggagtagccgcaggggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataactttttttcttataagtgataagcttttataaagatcataggaaaactagaaaaaatgtaaaatgtagaaaattgtaaaacaaacttcattagagatattttgatagataccttttcagtgtctatttacaaattttttcttttaatatagatagggtctcactatattgcccagctcactcctgagctcaagggatcctcccaccatagcctcccaaaatattggaaatacaggcatgagccactgctcctgaccaattcacaattttttttaaagaacaaacgtgctatcatcgatacatactgttaggttgtctttttttaaaaaacctaatgtaatttgttcatctttttatatctgtaaatatagctcaacacagttatattctttttgtgaatgtattatatctacaatttaccttttttcttagattttacatgcattttcccaaatctttgtgtttgcctatctgtaaaggtaatacattctgattacaaaaaatgaaaatgttacatagaaatgtaccgttatccatctaccagataactattattaataatgtgtatttatttttccaggaattaaaaaacatctatcatataagtattgcaaataaaacttaaaaagc

SEQ ID NO: 1006 - DNA, 2661 bp, Homo sapiens
atgggttcagacaagtatataataacatgtattcaccattatagtatcatatggagtattttcactgccctaaaaatccttccgggctttgcctgttcattcctctcttactcctaattcctggcaaccactgatacttttgccttttctagaatatcatatatttagaatcatacagtagatagccttttcagatagacttctttcacttagtaatatgcacttaagttttctccaggtctttttttggcttgatagctcatttctttttagtgctgaatcatatttcattatcttaatgaaccacagtttatttagccattcacctacagaaggacatttggttgcttccaagttttggcaattatggataaagctgctatcaacatccatatacaggttttcatgtagacgtaagttttcaactcctttgtgtaaataccaaagagtgtgtttgctgggttatatggcaaaaacatgtttgcttttgtaagaaaccaacaaaatgtcttccaaagtggctgtatgattttgcattcccaccagctgtcactgctaattgggcagacctcctttagagatgtcgccaaagatagtgtaatgctcttcactgtaggcatttatgatctatacaagaatagcagtggattctgggtcagtgcctttattttatcctgccaagttcaagagaaaggttttttcttattctaagggaagactgttatggtaaagtaaaaggaagaaatatataattactcttctattgaggagggagaagaaggacacactgtgatgtaaatggcagaaattcaataatttaattcaaactaaagagaacgggaatgtattgaattcaggaatggaatgtaacgggaaactccactggtggtcttcaggcatggctgaatcccgtgtctcaaatgatatcttcaggaatatgttcctcccatccctcagctctgtgttccttggtgtggtctttactttttccacttggtaatatgaatgtcctccaatatcctcccctactgccagagataccaagaaaggagagcttctctgatagttccatcaaaactcccagggatgactctgattggtcagcctgcatcacatgccaattttctcggtcaaggaagtgggaccatgtgattgacatgagtataagacaatctgttcctgaaagaaaagggtgctgggggaaaaggcaacagatgtccaccacagcatgttttttcactttactggttattatctctttttagactccctcagcactggacagctgagaccacgaaggacttgggaccctttctagtacttttctcaggagatgaattaagctctatagccacaaagtttcctgagatccttctgcaagcagcttccaagatggccaggaccctgccccctaaataattcctctgggctgtctttcagtctgttcggaacagcagtgataagatccccagctctgaccctatgcctggttgccatggagtcgtggccccctcttctgatgacatcttcaagttggccgaagccaacgcctgctgggccctggaggacctgcggtgcatggaggaagacacattcatcaggaccgtggaactgctgggagctgtccagggtttcaaccggcctcagctgatgaccctgaaggagaaagcaatacaggtttgggacatgccatcttactggagagaacaccatatcgtctccctggggcgcattgctctggctcttaatgagagtgagctggagcagctggacctcagctccatagacactgtggcttccccaagctggcaaacagaatggaccccgggacaggctgaatccattttgcaagggtacctggatgattcaggatacagtatccaggacctgaagagctttcatttggtaggacttggtgcaaccctgtgtgctataaacatcactgaaatcccacttataaagatctcagaattcagggtggtagtggccagaattgggaccctgctctgcagcacacatgtcttagccgagtttaagaggaaggctgaagttgtgtttggggatcccactgagtggaccagttctgtcttgcaggagcttgggaccattgcagctggattaactaaggcagagctccggatgcttgacaaggatttgatgccatatttccagccatcagcaataaaatgccttcctgatgagatattcaaagagctgtccgcggagcagatcgcctccctgggtccggagaacgccgcggcggtgacccacgcccagcgccggcggctcagtccactgcagctgcagagcctccagcaggcgctagatggcgccaagactcactcctggcaggacgcgcccgctagcgccggtcccactagaacctcatcctcgcgttctcccgcaggagctctccagtcgtggggtctttggcttggttgtcccctgctggttctaatggccaagctcctgtggtgagtggcctgagcacatcgtcctgtgttgccccaagcagctggccaacgtgtgtagagacaggatgctccagatggtgggacaccgttccctggatccagaccctcatctagggcaaggaaaccctggggccttgatggtgaaaatgcaccccaaatgaaaaataattattaaaaatgatcttgc

SEQ ID NO: 1007 - DNA, 2468 bp, Homo sapiens
atttaacttcgcggcggcggcggcgactgcggcgccgcgggctggaggccggcgtcggggaaggtcctggtgccggattccgcacgaggtgttgacgggcggcttctgccaacttctccccagcgcgcgccgagcccgcgcggccccggggctgcacgtcccagatacttctgcggcgcaaggctacaactgagacccggaggagactagaccccatggcttcctggacgagcccctggtgggtgctgatagggatggtcttcatgcaccctcccctcccgcagaccacagctgagaaatctcctggagcctatttccttcccgagtttgcactttctcctcagggaagttttctggaagacacaacaggggagcagttcctcacttatcgctatgatgaccagacctcaagaaacactcgttcagatgaagacaaagatggcaactgggatgcttggggcgactggagtgactgctcccggacctgtgggggaggagcatcatattctctgcggagatgtttgactggaaggaattgtgaagggcagaacattcggtacaagacatgcagcaatcatgactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcacctaaggtactggatggaactcgttgcaacacggactccttggacatgtgtatcagtggcatctgtcaggcagtgggctgcgatcggcaactgggaagcaatgccaaggaggacaactgtggagtctgtgccggcgatggctccacctgcaggcttgtacggggacaatcaaagtcacacgtttctcctgaaaaaagagaagaaaatgtaattgctgttcctttgggaagtcgaagtgtgagaattacagtgaaaggacctgcccacctctcctccgctgctgatacccaggcaaacagggtctggagtggacctccagcaaactccaacagacctgcagctgagcgtcctgacttgtagaaggaaaactaacaaacagaaaggacatccacaccaaaaccccatctgtacgtcaccatcatcaaagaccaaaggtagataaaaccacaaagatggggaaaaaacaggagaaaaactggaaactctaaaaatcagagcacctctcctcctccaaaggaacacagctcctcaccagcaacggaacaaagctggatggagaatgactttgacgagttgagagaagaaggcttcagacaatcaaactactccgagctaaaggaggaagtccgaacccatggcaaagaagttaaaaaccttgaaaacaaattagacgaatggctaactagaataaccaatgcagagaagtccttaaagaacctgatggagctgaaaaccaaggcacgagaacgtgacgaatgcacaagcctcagtagccaattcgatcaactggaagaaagggtgtccgtgatggaagatcaaatgaatgaaatgaagcgaaaagagaagtttagagaaaaaaagaataaaaagaaatggacaaagcatccaagaaatatgggactatgtgaaaagaccaaatctacgtctgattggtgtacctgaaagtgacggggagaatggaaccaagttggaaaacactctgcagggtattatccaggtgaacttccccaatctagcaaggcaggccaacattcaaattcaggaaatacagagaatgccacaaagatactcctcgagaagagcaactgcaacacacataattgtcagattcaccaaagttgaaatgaaggaaaaattgttaagggcagccagagagaaaggtcgggttacccacaaagggaagcccatcaggctaacagcagatctcttggcagaaactctacaagccagaagagagtgggggccaatattcaaaattcttaaagaaaagaattttcaacctagaatttcatatccagccaaactaagcttcataagtgaaggagaaataaaatcctttacagataagcaaatgctgagagattttgtcaccaccaggcctgccctaaaagagctcctgaaggaagagctcaacatgcaaaggaacaactggtaccagccactgcaaaaacatgccaaattgtaaagactgtcgaggctaggaagaaactgcatcaactaatgggcaaaataaccagctaacatcataatgacaggatcaaattcacacataacaatattaaccttaaatgtaaatgggctaaataccccacttaaaagacacagactggcaaattggataaagagtcaagacctatcagtgtgctgtattcaggaaacccatctcacgtgcagagacacacataggctcaaaataaagggatggaggaagacctaccaagc

SEQ ID NO: 1008 - DNA, 3036 bp, Homo sapiens
gtgtcggtgcgcggtgctccgtggctgcgctgctggaacccgctggaagagatacaggtttgctctggagcagcagcagctggcggagcaatggagatgcaatcctattatgccaagcttttgggggagctgaatgaacagagaaagagggactttttctgtgactgcagcatcattgtggaagggcggatcttcaaggcccacaggaacattttgtttgctaacagcggctacttccgagccctgctcattcactatatccaggacagcgggcggcatagcaccgcctccttggacattgtcacctctgatgccttctccatcatcttagatttcctctattctgggaagttggatttgtgtggggagaatgtgattgaagtgatgtcggctgccagctacctgcagatgaatgacgtggtgaacttctgcaagacatacattaggtcatccctcgacatttgccgaaagatggagaaggaggctgctgtggctgcagcagtggcggcggcagcggcggcggctgcagcggcggcagcagcggcggctcatcaggttgacagtgaaagccccagttcaggccgggaggggacctcctgtggtaccaagagcttggtctcctctccagccgagggagaaaagagcgtggagtgcctgagagagtccccttgcggtgactgcggagactgccaccccttggaactggtggtgagagacagccttggcggtggctcggctgacagcaacctctctactccacccaaacggatagagcccaaggtggaatttgatgctgatgaagtggaggtggacgttggtgaacagctgcagcagtatgctgccccgctgaacctggcccacgtggaggaggccttgccaagcggccaggcggttgacttggcttacagcaactaccacgtgaagcagttcctggaggcgctcttgcgcaacagcgctgccccgagcaaggatgatgcagaccatcacttttctaggagtttggaaggaagaccagaaggtgcaggagtagccatgagttccatgatggatgtccaggctgactggtatggagaggactcaggtgatgtgctggtggtccccatcaagctccacaagtgtcctttctgcccttacactgccaaacagaagggcatcctcaagcggcacatccgttcacacacaggcgagcggccctacccctgtgagacctgcggcaagaggttcactcgacaagagcacctgcggagccacgcactgagtgtccacagatccaaccgtccaatcatctgcaagggctgcaggagaacattcacgagtcacctgtcccaggggctgcggcgcttcgggctgtgtgacagctgcacctgcgttacagacacacccgatgatgatgatgatttgatgcccatcaaccttagcttggtggaggcttcatctgaaagccaagaaaagagcgacacagacaatgactggccaatctatgtggagtcggagatcgggtctcattatgttgcccaggctagtctggaactcctggccttaagccaacctcctgcctcagcctcccaaagtgctggcattacagacggagtctcactctgttgcccaggccggagtacagtggcatgatctcagctctctgcaacctccacctcctgggttcaagacaatcctccaaacacagactgtttgacttagaatcttcccttttttactccattcaagagcagcattcataaatttccagaatggagatctcctctcatcagtctcacctcctgcagcaactgaacgagcagcgcaggcaagatgtattttgtgactgcagtattctagttgaagggaaggtcttcaaagcacatcgaaatgtattattcgctagtagcggctactttaaaatgcttctttctcagaattcaaaggagacgagtcagccaaccacagctacatttcaggctttctcccctgacacttttacagttatcttggacttcgtatattctggcaaactgtctcttactggtcagaatgtcatagaagtgatgtcggctgctagcttccttcagatgactgatgtcataagtgtatgtaagacttttattaaatcttccttagacattagtgagaaagaaaaagatcgctatttcagtctctcagataaagatgccaattctaatggtgtagaacgttcctctttttatagtggtggctggcaagaaggaagcagttctccacgttctcacctaagcccagagcaaggaacaggtataataagtggaaaatcttggaataagtataattatcatccagcctcccagaagaatactcaacaacccttggccaagcatgaaccaaggaaagagtccattaaaaagaccaaacatttgagattgtcacagccttctgaagttactcattataagtcaagcaaacgagaagtacgaacatctgattcttccagccatgtttcccagtctgaagaacaagcacagattgatgctgaaatggactctactcctgttggctatcagtacggtcaaggatctgatgtcacatccaaaagctttccagatgatctgcctcggatgcgattcaagtgcccgtactgcacacatgtggtgaagcggaaggcagacctaaagcgccaccttcgttgtcatacaggagaaaggccctatccatgtcaagcttgtggaaaaagatttagcaggctagaccatctaagtagccattttcgaacaattcaccaggcatgtaaactcatctgcagaaaatgtaaacgtcatgtgacagatctaacagggcaagtggtacaggagggaaccaggcgctacagactgtgtaatgagtgtcttgcagaatttggcatagacagcctccccattgacttggaagctgaacaacatcttatgtccccatcagatggagataaggattccagatggcacttgagtgaagatgagaatagatcctatgtggagattgtagaagatgggtctgctgatctggtcatccaacaggttgatgatagtgaag

SEQ ID NO: 1009 - DNA, 2914 bp, Homo sapiens
aaaatccgatctcaaataggaaagaagtctcattggccttttggtcttctacctgtgtcctgaattgagtttgttaatcctcattcggagctgatcacctgcctttccagaccggagacgggcggcaagtttgaagtcgacacccagaggccagtttgtcccccttcccgcgcgcgggcggcccgagcctcggcggcggcggtagcggcggcggcgacgctgacacctcccaccatggacagcttcgacttagccctgctccaggaatgggacctcgagtcactgtggggtgaagacatcttaaaccagaggaatgactctctagttgtggaatttcagtcatcagccagcagatgcaggagtgtctatgaaccagatagaaatgcattacggaggaaagaacgagaaagaagaaatcaagaaactcaacaggatgatggcacgtttaattctagttactctctcttcagtgagccctacaagactaacaagggggatgaactctccaaccggatccagaacactttaggcaattatgatgaaatgaaagactttttaactgatagatccaatcagagtcatctcgttggagttcccaaacctggggttcctcagactcctgtgaacaagatcgatgaacattttgttgcagattcaagagcccagaaccagccctcgtctatctgtagcactacaacttccacaccagcagctgtccccgtgcagcagagtaagagaggcactatgggctggcagaaggctgggcacccaccctctgacggccaacagagagcaacacaacagggctctctcaggaccttgcttggagatggtgttggcagacagcagcctcgggccaaacaagtgtgcaatgtggaggtgggccttcagacccaggagaggccacctgccatggcggccaagcacagcagcagcggacactgtgttcagaactttcctccatccctagcttcaaaacccagcctggtccagcagaaaccgaccgcgtatgtgaggccaatggacggccaagatcaggcccctgatgagtctcctaagctgaagtcgtcttcggaaaccagcgtgcactgcacatcatacaggggagtccctgccagcaagccggagcctgccagagccaaggccaagctctccaagttcagcatccccaagcagggggaggagagtagatctggagaaaccaacagctgtgttgaagaaataatccgggagatgacctggcttccaccactttctgctattcaagcacctggcaaagtggaaccaaccaaatttccatttccaaataaggactctcagcttgtatcctctggacacaataatccaaagaaaggtgatgcagagccagagagtccagacaatggcacatcgaatacatcaatgctggaagatgaccttaagctaagcagtgatgaagaggagaatgaacagcaggcagctcagagaacggctctccgcgctctctctgacagcgccgtggtccagcagcccaactgcagaacctcggtgccttccagcaagggcagcagcagcagcagcagcagcggcagcagcagctcctccagcgactcagagagcagctccggatctgactcggagaccgagagcagctccagcgagagtgagggcagcaagcccccccacttctccagccccgaggctgaaccggcatcctctaacaagtggcagctggataaatggctaaacaaagttaatccccacaagcctcctattctgatccaaaatgaaagccacgggtcagagagcaatcagtactacaacccggtgaaagaggacgtccaggactgtgggaaagtccccgacgtttgccagcccagcctgagagagaaggagatcaagagcacttgcaaggaggagcaaaggccaaggacagccaacaaggcccctgggagtaaaggcgtgaagcagaagtccccgcccgcggccgtggccgtggcggtgagcgcagccgccccgccacccgcagtgccctgtgcgcccgcggagaacgcgcccgcgcctgcccggaggtccgcgggcaagaagcccaccaggcgcaccgagaggacctcagccggggacggcgccaactgccaccggcccgaggagcccgcggccgcggacgcgctggggacgagcgtggtggtccccccggagcccaccaaaaccaggccctgtggcaacaacagagcgagccaccgcaaggagctgcgctcctccgtgacctgcgagaagcgccgcacgcgggggctaagcaggatcgtccccaaatccaaggagttcattgagacagagtcgtcatcttcatcctcctcctcggactccgacctggagtccgagcaggaggagtaccctctgtccaaagcacagaccgtggctgcctctgcctcctccgggaatgatcagaggctgaaggaggccgctgccaacgggggcagtggtcctagggcccctgtaggctccatcaacgccaggaccaccagtgacatcgccaaggagctggaggagcagttctacacactggtccccttggccggaacgaacttctctcccctctaaaggacagtgatgagatcaggtctctctgggtcaaaatcgacctgaccctcctgtccaggatcccagaacacctgccccaggagccaggggtattgagcgcccctgccaccaaggactctgagagcgcaccgcccagccacacctcggacacacctgcagaaaaggctttgccaaaatccaagaggaaacgcaagtgtgacaacgaagacgactacagggagatcaagaagtcccagggagagaaagacagctcttcaagactggccacctccaccagtaatactttgtctgcaaaccactgcaacatgaacatcaacagtgtggcaataccaat

SEQ ID NO: 1010 - DNA, 2583 bp, Homo sapiens
cttcaacctgctgccacatgccagtattagccccaggaatcctgcccctgtccctgagttaacccagtcctcacttggttattactcctcactgcagggcccatgagccccactccctagccccagacccaatccccatttccatatcacccgcttacctccatcttcacccagaacccatgtgtcttgctctcacatgccctctctcttccccaaacctcagaggccaccccagccctccagccacccaagtgcactcactggccatggacaggagcatggcaagggcagcaaagatcccagccaggccctggccgctgaggaagagggtgctgtaggcggagggcatggtgcccagctgcccgaagaggctgccctgtaggactgcactgaaggctgtggaggacagggatgggggctgctgctcaactaggcaagactcagaggctccctggaggaggtgccggcaggatacacaggggactctggacaaggttgcgcaggtgtgagcttccctagggactctgagcactcgggggcaacacccgctattcagtcctcttctgaggtgcagccattggtctgtggggctgttgaccaggaggcctgctcctaggtcaccggacaagtgactcttcccctccctgtgggcctcagtttcttcaccagggatatgagcgaccatgatgctgtctgcccttctcggatatgctgggccctttcaatgatgaggccaggctgaagccctgcataggctggctggagagggggtggaggtgctcacagttgatgaagcagacggaggccatggtgatggagaagaagggtccggggctcatgtccaccttgaccagcgctgctgtcagggcaaagagcagcagtatggccagcaggctgcccagagtgcgcaccgtctccgggacgctgctcagaagcaggcagagtgcatcagtggggcccaggccagagggggctggggaaggaggctcgacacctggggctgggcagtagggctggggggcagggggcgcaggggagggcctcaatgaagctgcctcggcagagggcgcaggagccagggcaggcctctcaccactggtacaggaaggagttgaggagggtgaagagcagcaggggcagctgggacagcagcgtcacccaattgttgaagttgaaggcatcctcgggacccgtgtggttggtgctcaggatcctggctgtgctgttgccggccccggccagtcgcgcctggaagtactgccaggtggggaggtggtggagggtcagcacctctcagccttcccccgctgccttccccctcacttgtgattgctttctaatgtctgtggggacttgtctgccttgtccttgttctgtttccagcagccggcacacagtcggagctccatgaatgtgtgctgagttaaatggctgaagtctgggacacagcctaagcattaagagcccccagcaagagcctcgatccagccttggacggcccctcctcttcagtgccctggttccagcccccatccccactcctgcagcagctgctacattcattcattccacgggtatttattgagcgcctactgtcagccaggctttggcctaggtgctgaacaactgcattctctctagagcacatagcctgccactcctctgcttaacctcctcactcctcaacaccccgattcatgcctccctattgcctgcagggcaaagccccaaatggaacagctcttcagaatcagatcctagtctccctttgtgccccatcttctgctccatcctgctaagctccaggcagccctggctgtggatctccctctaaacaggctgatcgtctcttgcctgcctgcctttggcatggctgtcgcctcggcctggaatgccctactgaccacacccctccacatgcactttgcctaccctactcccaatttacaaatctcctcttccatgaagcagaaggaactttctccctcccctggggacccactgcactctgctgcaagcctggaatgtcacgcatcatgttacattattaatagctctttggccccctcttgctctcaagcccaggggctgattcatctctgggtttccagggcccagcacagagccagtacccaagaagcatttgcaaagttgttgcagtgaatacagatgaataacccggtcccaaagacaatgcaaaccccacatttctgccttccctgaagagcctccctgctgtttcctcctgtgtccccagtgcctgctccacagtagatgcacattaaaagtttgttgaatgaggctgggcacggtggctcacgcctgtaatcccagcactttgggaggccgaggcgggaggatcacgaggtcaggagatcgagaccatcctggctaacacggtgaaaccccgtctctactaaaaatacaaaaaaaaatagccgcgcgtggcggcgggcgcctgtagtcccagctactcgggagggtgaggcaggagaatggcgtgaacccgggaggcggagcttgcagtgagccgagatggcgccactgcactccagcctgggcgaaagagccagactctgtctc

SEQ ID NO: 1011 - DNA, 3600 bp, Homo sapiens
acatacgcatgcacaggcacctgtgtacacacatgcagatacacccacagcatcccatctgtgccacacacagacgtaggtacatggagacagatgcacacacaggtctgtgcacacacatacatacacatgcacaggcacctatgtacacacatgcagatacacccacagcatcccatctgtgccacacacagacataggtacatgaagacagatgcacacacaggtctatgcacacacgtatgcatgcacaggcacctgtgtacacacatgcagatgcacccgcagtatcccatctgtgccacacacagacatacgtacatggagacagatgcacatacaggtctatgcacacatgtacacatgcacaggcacctgtgtacacacatgcagatgcacccgcagtatcccatctgtgccacacacagacatacgtacatggagacagatgcacatacaggtctatgcacacatgtacacatgcacaggcacctgtgcacacatatgcagatgcacccgcagtatcccatctgtgccacacacagacatacgtacatggagacagatgtacacacaggtctatgcacacatgtacacatgcacaggcacctgtgtacacacatgcagatgcacccgcagtatcccatctgtgccacacacagacatacgtacatggagacagatgcacacacaggtctatgcacacatgtacacatgcacaggcacctgtgcacacatatgcagatgcacccgcagtatcgcatctgtgccacacacagacatacgtacatggagacagatgtacatacaggtctatgcgcacacgtacacatgcacaggcacctgtgcacacatacatacagatgcacctgcaacatcccgtctgtgctgccctattaggtttgtggccatttggggaatcttcctaaaaccctaaaagctagggcaggtctgcttgagcaggagcagcagggtctgggggacccctgagggcaggacagtcagggacccacagttgagctgggcccgctgagccctggatccttcttggtgtcttatcctggccagcaagcaagtgtgagctcctgtgggtctccagaggcccatgaggaccagtgggccaggtgggaacaaggcttggcgtcctcttcaggggggaacaccagggcaggcctgaggaggcctgtgtccccagcctgtcattgctgtggctccgcttctcagggagcctaggaagaaggtgtggcaagagcccgaggcgctggctgcacctggcggggcctgtgggcgtcagtttagacccatccattctcactgcagcattccagggtttgcccttatgctcggctgtgtgagggtgaggatgatgctgtgggggcatgcatgctgggtgtgtttcagccttctcttccaccaggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcgcccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccattctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctcctcatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcggtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacatcgattccctt

SEQ ID NO: 1012 - DNA, 3374 bp, Homo sapiens
aacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatgacactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaatgtcaacttttgctgacttattatgagatgaaaaaccaaaggagagtgggcctaactcatgtgagcttgataactgatgaactcattgggagcattttaaacttttctacataaataataaatgagcactaatg

SEQ ID NO: 1013 - DNA, 3168 bp, Homo sapiens
tactgtaccctcccggcagcctccggcagaacacgcagcagcagcagcagttagcgctgatgcaactatcgttgctgttgccaccgcctccccactgacggggcgtgcacctggggggtacttgcagtttccaggggcaacaagcatctctctaccaccctctcctgcgcccctgagagaggctggctccaagcttgatatagaagactatcatatgaaccagaaagggtaactgaaaccaaggaaatgactccagtatcaagctaaagacatgccttaaaggatgaggaggagcagaaatcttaccagcaaggcaagaaagaagccgtacgtgaacagcctctgctttaggcccagaaggaaaagaagcttacaggagacaatcagtcttacactcttccatggtcacaaacaagaggtccctggatctacagtatctaggcccgcatgcaatatgactttgcaactcatcccatcagaggatggaaactatttcttcacccccttgaacctgggctggctttgtaatttgttttggccaatagaatgtggtggaagtgatggtgttaccggaaagagttcccaatccagactcgtgcgagaaagaatttgagaaatgaaagaaccagagcattatagcagaacgaatcctggaatgggaatggaatgcctggatttgtggcacagttgggaagcgtcctggccatgccatgttaaagctgtctccaaggcagtgattcttacccttggctacacattggagtcatttgggaagctagaaaaaaaaaaatgcccaggacctgggcaagacggctgaataagaacagctctggtctgcagttcctagcaagatcaacgcagaagggaagctggcagcctgggctcttggagattgtatctggtgccggagaggactggctcccacactcagtgagggaggaattttactgacccagcatccagatgaactttggtgaggagaggagacggagtttcactgttgttgcccaggctggagtgcagtggcgtgatttcagctcacggctacctctgcctcccgggttcaagcaattctcctgcctcagcctcccaagtagctgggattacagatcatgaactggcagccatgtggaaagaagactagactgcgaatcacttaggatcccgccctcggtttagtctagaatactctgcgaatcagctttttggccctaggtaggaaagagacaaatggaagcaaaatagcaaaatggtgaagaggagggttctagaggcagacagccctgcagtcctgagtcctgagtccaccgtttaacagagtgacttttctcagcctgtggattataatgaaacttgcctgttataggatccagttttttaggtggtagcaacatgctcaaggaagatgcagccccttcctccagcctgagagaataaagcatcattggcttatgccaaccatggcaatcccattccccttttctcatgattgatttgggaatgggcaagtgacccagttctaaccaatgagacgaaagaaaaagtctgttggtcagcttatctcagaagatttttgtttcctgctataaagagaaacagtaagttccttcctgcctgacttaaatgcaattgtgtgcaaacatgttacttggagctacagcaacgattctgtgaccatgaggcaataagccaaggacaaaggatagaatagtgaaaagacagagtattggattttttttatgatatcattgaactgctggaccaatgtggaaccatctacttttagtctttcatgatttgtgagatgattaaacatttcttttttttagccattatttcttttctgttacttgcaactgaagacatcctacataatacaaacactatccaacttggattgtaatttatctattttcagatctgtgtgttctgtcttactgatttttgtattcttagcactgagtataaggctgctacttagtaagacttcaataaatgactgtttaaaaaggtcttagaggatttaaaaaaaattctgaagttgctgaaatatgaagaccaggaaccaatttcaggttctataaatttctcgcttccttcacttctggagtagtcttcatttctgtctgattctacctttactaaaatgaatgaatgattgaggaatatgaaaaatggctggtatagtggctactgctgagaagtatctcttggaaattcccggaaattccatcagtcacattcagacctaactctctgatgatcaatgtttctgaactcaaaccagtgtacataagcagtggactatttaaagtggtattagcctagaatatctaggacacatgttttatgcattcagtaagcgtttgtttaatgtctgttatctaccaggcacattattatgcattgggcatatagagatgaccaaccacacggcctcaatccttgaaaagcttacagtaaccaaatagggttaacggcctaaagagaggtaattacaagtcttacacccagtcttcttagcatagtatggtgctacatctgagttaattaagataacaaaattcctagatatatatctttgatgaaacggtttccatgaaaactttccaagtttggtccctccccggctgagttcattttggaaggtgactttctgctctcatcacctaaggtccttaacacgtatcctgtgttctccggaggcaccccttgcccagagtgtgccctctgcatggttcccccagaacacctatttcaaaggaaaagaagttggatcattcagtgaagatttggggggccacttttctacgtgggaggattatgagtattaccttcctcccctatgtattagtaaatataaagaaaacataaattaaccccctttctggctgggcacggtggctcacgcctgtcatcccgcactatgggaatccgaagtgggcggatcacttgaggtcagcagtttgagaccagcctggccaacatggcaaaaccccgtctctactaaaatataaaaattagccagatgtggttgcacacatctctagtcccagctactcgggaggctgaggcacaagaactgcttgagcctgggagcaagggttgcagtgagctgagattgtgccattgcactccagcctgggtgacagagcaagactctgtctc

SEQ ID NO: 1014 - DNA, 2115 bp, Homo sapiens
tatcatctttaccaagtgcaagttccgactggcatcagcagcatcccctgagcagcgctatttctctctctttctctctgcctctttccgtttctccctccttcctggatctcttctcttccagttgctctgccaacacgattggaccaagccactgaccctcagttagtccaagaatgccaggcccatggcaagggagctgaccagaagatgtcagagaggcctctgtctcccaggtgctcctgaccctgtgcatgtcagcagcagggtgcaaataacgaatgaggagccagggacaggggacatttctgtgctgctacttcaccttccactttggcagcccctgctttggtctgagccttggcctagggaagaggcaaggaaggacttcagtattatctttactgggaagacatcacctggctctcccttcccacagttccatctccagtggttcagccagtggtctgatcgctttgcagctgtgagaagaaaggctacacctcctgcatgtggctggagcagggcatgtgtgggcagctgggaggtgctccttgaggctccttctcccccactgggctggtgtccagaggcttcctgtccttttccaggtctccagagggacctgcctgccctgcctgctcccctgccagtagaaagccaggcaggagaaagaatagcaattacattccaccatggagatgctcctgaccttttcatctgaatcctagtagcagaaatgtaacacagggggaaaaaaggaaagagagttgcatctaccctggaagcagaatttgttttccatttaccctcaaattcaaatgagtcacaatcatagtcataggtctagtccactaccagagccctgagtgctgtcaagagaaagcatctatctccaccctcctttgtcaaccttcatcaagggtcaacgtgaaatgcagagtgcatctaggagattctacctccagccatctccatggctccatccccaccatccttcctgagaactccatagacggctggggccaacagcctagtccctgttccctctgcagaatccggtgccattgctatgcagatgactttgtcactgggctgtccagacctctttgggaatgatttcatcaacatctcagctgtctctcatcattctccttcctcatctcttcagcagtcatccttgaaagaaacagacttaagcaaagcctcacggagacagcccaaaatgccagccaacctcagcctccagcttgtcagatctgggagggacaaagagtcgagctgatgggcctggctggaattaagaagagggacatacaaatgaccttggccttggcatccatctccccatctgttcttacatctacagatgcacgattttagccaggcaggcaaatgtgtgcctagaaattgatactaggtaagcagaggctatggggagagatggtctaatggagggttctaggaacctttcatcctaaggagaccttaggtgctgtctggtgcagtctcccatcctaagcaggagtctctgttggcacctctgctctggagttgttcaccactatgggagacaaggagaaacatcttaggtgaggttgaggagaaggattcacagtcttgccttcactccccaaacatcagacatcattccttgtcacccactcagaatgagccccccttggggaagaaaccacaccatttccagcaaagttcatggagcatccggtacttttaagaacacttgcccctttggatatgaatatgtgtacatgtgtgtgagcacatgtatgtgtgtgtgtgtgtctgccccaggtgtaggcggaaagctcaaaaggatttcttgtcctttgtaggaggatttttgaagtgttccccttgctcatccattcatcctgcagcttcaggacatttcaacacttacttgctttttatgctgagagctggtgggtggaaggagagggcgcttgtccataggaaatcagggtggtcgcctgccgaggcctggaccttggaacagggcatcatgtgacatcgcagaggacagatggtggaaaagacatgagcaacctaatgggaagaggaaaatgggaaacaatgcattggaagaggaag

SEQ ID NO: 1015 - DNA, 2481 bp, Homo sapiens
aaagaatgaggtcacagcccatgagctgggaaaggaggcagtgctcttgggaggaacagcagtggccccaggcttcaagtggaagccagcagagccccaaccaatgggtgtgttccagaaagaatattggaatacataccgggtactacaagaacagctgggctggaacactcacaaagaaacccagcctgtatatgaaagagctgtgcatgatcaacagatgttagccctttctgagcagaaaagaatcaaacactggaagatggcatctaaactcatcctgcctgagtccctgagtttgttgacatttgaagatgtggctgtgtatttttctgaggaagagtggcaattattgaatcctcttgagaagactctctacaatgatgtaatgcaggatatctatgagactgtcatctctctagggttaaagctaaaaaatgacactggaaatgatcatcctatatctgtttctacatcagaaatacaaacatcaggatgcgaagtatcaaaaaagaccagaatgaaaattgcccagaaaacaatgggcagggaaaatcctggtgatacacacagtgtacagaaatggcatcgagcttttccaaggaagaaaagaaagaaacctgcaacttgtaaacaagagcttccaaaacttatggatcttcatgggaaaggccccacaggggagaaaccttttaagtgtcaggaatgtgggaaaagcttcagagttagctctgatcttattaaacaccacagaattcacactggagagaaaccctataaatgtcaacaatgtgacaggaggtttagatggagttcagatcttaataagcacttcatgacccatcaaggaataaaaccatatagatgctcatggtgtgggaaaagctttagtcgtaacacaaatctacacacacaccaaagaattcacacaggagagaagccctttaaatgtgatgaatgtggaaaaagattcattcagaactcccaccttattaaacaccagagaactcacacaggtgagcagccttatacgtgtagcttatgcaagagaaactttagtaggcgatcgagccttcttagacaccagaaactccacagaagaagggaagcatgtctagtgtctccaaactgaggaaagttaccatgtagagcttgactttagaagtggtgaaagaatacaaaattatgaggcacccaatgataggaatctgtgattaataaaacatttgggaagggtacatgttacacttcacaaaaaggaatctaagctgtctgttttattcagcattgcatcttctgtgcctagcacaagagttgatacataaggagtactttataaataaaaaaatgaaagtgtagtgatgagattcctttagctatctatctatatgtatatatctggttattcaaagcttccccacccccagtcatctaaatttttcaggtatcaagtgctcaacagacatatgatagtcaaggctcttagtctcattttttactctttgtcaagagaaatggaaaataagagtacttgggccctcttaagggagctcagagagaattactaaattagggacagtttcaatagttatcattctgtctacatgaacaatcaagaccaggactcagggaactttactctgtaacagaaagagaggattcagtgtttgccctgggagaattgtcccattcttgttgcttctctcctgagtacccactaccacaatgtcttctgtcaaggaattacaagtagcaagggaaggtctgaatgtaaggacaggcctagggaccttgcaagcacttgatatctctcctcttgctgactttgtcaacatagacatatagtgaaatgatgagggaggcagtcttggccctcatccaggtatctggtttttttttgtagaaagcacagataagtggtaaatggtctttttctgactttcattatgtggactggatggaggctttcaaactggtgccatactgctgcaggacctaaagggagccccatctttatggctgatcaactacaaccctatatgcctgaatactctgcaagaaggcctggagattttgcaaaactgatttattgagaatggcaaggagagccttgtgaacttttagctttggtgcacagctgataccaggagggaacatcctgaagtgtcagagaaaagtaaggcatatggctcacagtgatgatgccagtcagagccaggccagatggaaattgttttctgatgttactggttttcttttccctattagccaaagtgactatctcttaagagaagataatgtgacgtcaagggaagttggaaggcatggatttatatctatgtcagatcctggtttataatgttggccaaggcttatttatatatgtttatttagtattccataaaattgtacttcgtaatgaaaatgacacattttatcttaaatttagacaataaacaaaactttgttaccaaatcactc

SEQ ID NO: 1016 - DNA, 3088 bp, Homo sapiens
ataacggccgccatcttaacagcgcgttcccgttggcgtctgaggaacagcatctctgccttcctgttcacggtgaccttcgcttggtgtcctcctggcctcagcaacctgacaattctgtcgtgtcccgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatggtaagattcagaaggtataatttattgtcttccatgttagaggaagattggaaattccttaaaatggaaaagcagcacaataaccttgagacatttgagactagtgtttttcacccaaaaataatctgtctcttggagagactatggatcatgagtttgacaaacactctaaacatccctcagaatatatttgtttacatatttccttcaacattcccatatgtatctcagatgtttttgataaataattcactcttgggccgttatcagctaagctctatttagaagccctctgaaagtaaagaatataacagaacttcctgcagtcactttgttccacttgaaaacactcaggtctgaaccatgccttgcaatgaaaatggcaggaacaaacagtttcaattatactaacttattttccatgtgtaacagaattcagagtaaaagggagaatctcaatgaaataaatttggaaaacttctatgaaccatcattaattttcaccaacaggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttcccaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtctg

SEQ ID NO: 1017 - DNA, 4510 bp, Homo sapiens
aaacttcgggcggcggctgaggcggcggccgaggagcggcggactcggggcgcggggagtcgaggcatttgcacctgggcttcggagcgtagcgccagggcctgagcctttgaagcaggaggaggggaggagagagtggggctcctctatcgggaccccctccccatgtggatctgcccaggcggcggcggcggcggcggcggcggaggaggaggaggcgaccgagaagatgcccgccctgcgtcccgctctgctgtgggcgctgctggcgctctggctgtgctgggcggcccccgcgcatgcattgcagtgtcgagatggctatgaaccctgtgtaaataaaggaatgtgtgttacctaccacagtggcacaggatactgcaaatgtccagaaggcttcttgggggaatattgtcaacatcgagacccctgtgagaagaaccgctgccagaatggtgggacttgtgtggcccaggccatgctggggaaagccacgtgccggtgtgcctcagggtttacaggagaggactgccagtactcgacacctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatctctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagactgtatgtgccctgtgcacactcgccttgtgtcaatggaggctcctgtcggcagactggtgacttcacttttgagtgcaactgccttccagacggttacctggcacgctggccacattctgcctcactcttatcagagtctgagctactggcagtgctttcagctctgagttgaggcacctcgaaccttgtttttgtggtgaaggatcctaaagtgctgtggggagtgatcacatttttcacaacagtaagtccctgactccacctcttctgccacaaacgtcagcatggtggtatcagccggccattggtccagtgagaaggcagagatgaacattctagaaatcaaccagacattgcgcccccagctgccagagaacaaacagcagttgagaaacctcaaagagaaatgttttctaactcaactggccggcttcctggccaaccgacagaagaagtacaagtatgaagagtgtaaagacctcataaaatttatgctgaggaatgagcgacagttcaaggaggagaagcttgcagagcagctcaagcaagctgaggagctcaggcaatataaagtcctggttcactctcaggaacgagagctgacgcagttaaaggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaagactgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccggcgagaaggcagcgataaacattctagaaatcaatgagaaattgcgcccccagctggcagagaagaaacagcagttcagaaacctcaaagagaaatgttttctaactcaactggccggcttcctggccaaccagcagaacaaatacaaatatgaggagtgcaaagacctcataaaatttatgctgaggaatgagcgacagttcaaggaggagaagcttgcagagcagctcaagcaagctgaggagctcaggcaatataaagtcctggttcactctcaggaacgagagctgatgcagttaaaggagaagttacgggaagggagagatgcctcccgctcattgaatgagcatctccaggccctccttactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtgcggaaatcatctgcccccagggaggtgcagaagactgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgttctaaacattctcccagtccctggccccacctcttctgccacaaacgtcagcatggtggtatcagccggccctttgtccagcgagaaggcagagatgaacattctagaaatcaatgagaaattgcacccccagctggcagagaagaaacagcagttcagaaacctcaaagagaaatgttttctaactcaactggccggcttcctggccaaccgacagaagaaatacaaatatgaagagtgcaaagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttggcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtctagcaggactcactggatagatgttattcaactccttcaggttgtcttgaactgactgactcatgccagccctacagaagtgccttttacgtattggagcaacagcgtgttggcttggctgttaacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaagcatgttggcttttctcttgacgtgggagaaattgaaaagaaggggaaggggaagaaaagaaggggaagaagatc

SEQ ID NO: 1018 - DNA, 2884 bp, Homo sapiens
aaaagtggaaaactatcggcggtggcccaggctcggtggctcactcctggaatcccagcactttgggaggccaaggtggggggatcacgaggtcaggggatcgagaccatcctggctaacaggtgaaaccctgtctctactaaaaatacaaaaaaattagccaggcgtggtggaggcgcctgtagtcgcagctactcgggaggctgaggcaggagaatggcgtgaacccaggaggcggagcctgcagtgagccgagattgctgcactgcactccagcctgggcgacagaggaagactccgtctcaaaaaaaaaaaaaaaaaaaagaaagaaaactacaggcggggacggcttctcgtaacagagtatgcaagaggaggagacctgcacaactggatacacccagaaatgtccctggctcaacaagccttccagcatgaccctgtgtcttccccctccacgcagagcaccagcaacagtagtgcagacccagaaacctccctggctcaacaaggcccccagcatgaccccatggccttcccctccacccagagcacctgtagcagtggtggagtcccagaaatgtccctggctcaacaagccttccagtatcagcctgtggccttcttctccacccagagcaccagcagcagtggtggagacccagaaacatcccaggctcaacaagccgcccagcatgaccctgtggcctacccctatacccagagcaacagcagcagtggtgcagacccagaaacctctggctcaccacctccccagcaacaccctgtggccttctccaccaagagcaccagtagcagtggcagagacccagaaatgtccctgacacagcaacaaccatcccaggaagccagtgtcattcaggctgggcagcccaaggctttgacttcagccttgccaataaggaggctgtgactgccgcagggctgccaggggatgcacttccattgtattaaaatgtttttgcctgtgtccaccgccgaaaaggaggaataagatgaccccaacatagttgcacggctgaagacaaaaatcaagttggtggggtcaatattgttaccatagtcactacacttagagtagttttatagtcagtgtagacaggtggcaccatgcagcagggatcagcctccaccacacctgaccaggagctccagaactgtaaaatcctggacaccattggccgtggcacgttcagtgaggtccaggatcacatgctgattgggacccaaatggccatcaaaatcatccccaaggctggctcccttggcatcactctccagagagtgataagtattttaaagttactctgtcacttcaatattgtacggttgtatcaagtgattgacacccccaacaccagttatttatttagtaacggagtatgcaagaggaggacacccacgcaaccaatacaccaccatggcctcatgagggaggagaaggcctagaccatgttcaggcagattctgtcggccatgcagtagtgccatagcaaattgcgcagagacctgaacccagaaaacatcatccttgatgaggacggtaacgttaagatcgcagacttcggctttggtaccacattccatgatgggcagaagctgacagccctttgtagcacttaacccctacatggccctggaacgtttcctaggccagggctaccaatgtgccaccatggatattcagagcctcagagtaattttataccacatggtggctggggttctgcccttctgctcatgcagcattagggtcctctcagcaaaaatttaaagtggaagctatttttccccagtctacttttcctgaggtcttaaaagcctcattaaaaaactatcaacagtagaccccagggagcagaccacactagaagaagttatgagggacccgtgggtgaacagtggtcaggagttgcctctgacaacatgaagaacaaatcctggaccacctgaatcccaaaacaacccagcttttggtggccatgggattccaggctgagaacctatctgtggcaatcaaagaaaaattattcagttatcccatggccacctaccttgttttggaacaaacaaaacagaagaagcggtccactatcagaccacagacccttcctcctggggatcccacttgtcctctctacattgaagtttccaccttccctctttcactgaagcgggctcatagcattcagcagaagactgtgggtgccaagtctgggcagggcctttgcccttgggagtcctgttttagacccagctccaccacgtggccctggcctcttctctgccctgtctgtgcttgcagccatggtgcccagtctggccccaccaggagacaccagaacgactgtccatgtgtctactccttggcaccttccccgcatggtgggtagatgggcagggaggggtgggaatctgtgtaaccgtggaagggaacggccctcagacccagagggtttggagcctggggtattgtcaccgacagtggccttagcctagctagcacagttagtgctgtgcatcacagcatagcttttagaggcaggatttgtagtcagtatagttgggaggcaccatggagcagggatcaccctccacctcacttgacaaggagatacaaaactatcagttcatagacaccatctgatagggaactggctcagcataggccaactgggacccaggttgccatcttgaagactttccatcacccaaatatcattcagctcttccaggtggtgagggagtaaaccagaggaggagagttgcaccaccagatataccactatggccacatcgaggaggaagaggaggcccggaccatgttcaggcagattctgtcagccctgcagtactgccactt

SEQ ID NO: 1019 - DNA, 2843 bp, Homo sapiens
ctgagcagccgcctctgagcacgatgggaaaatccttcctccctcggacatggcgctcacctgcccggccgcagcagccggctccggcgccgcggttcgcgggtccgggcggaagagcagctccagcttcaaacgtggggtggaaggaggcggcggagacccactgagtctacatgagcccataaaaattgttatcacgatgagcagtaccccaaactccatgacagatttggaaagctccctccacctgagggtggttggcacagagaagaccagtgtaaagtctgacgctgagcccactaacccaggggcggccggttctccaaatgcgatcattgtatttttctactgcagtgcagtgactatattcttcacaataatcaaactggtcagttatcgcctacacctcatgtttgacaaaggagaagtaattcagcaaaagccctccagaaaggaagaaaagccaaataaagacaaggaggccaaaggtgaacacataactaatcacagaaatccaagcaataataggcagattcacaatggcaaaaaggaagaggccagtcgaaacctctccacgcctcccctccgctgcagctccagagggcaaagcataacctctcatcactcttctgggccattggagttgtcagcacaggaaactgtagaagatctcaaaggtgtcattctattagaagaccatcccatagcaccagtgtcatctacctcacctggtatcaaagtggaaagcttacctgcgtctcaagcacacatgctggaaaccacgaccaagtcagtaatacctgtaaaaccagttgccacagaaactctcatcaatggtaaaggaaaggaaagaggaggcaaggggcagcctcctttgcgccacagatccgagggtggcttagtggataagggacccttgaagaagttgccccacctgtctttgtctcagtatgacttactagaaacagacgtttctttccagccgtgggggagtgagaattcagtcctgattccagaacctgtcagttgtccccggggctccataagggaacgggtacaaagcaagtcacctcaggacagcctgagcagcagctgccctcaatgtgacaccatcgtggccaagcctgtggaggagccagcagacacatcctgtcaggtagatacctcctgccagggggacctgcccttgcaccaggaagtggactcctcagatagtgaggtagctgttactctcatcgatactcctcttctgcctcgtcatggccagctgccagtactccctgctaaagagtgttcagcctgaccccgcctcaccaatacacggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacacgctgttttttggtggttctgctgtgtctgggataacctcggctgtttacagtgtggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaaggacggcacccacacacaaagaggatgatttcccttaactcaaaccatgcaagttactgcagttcatctcatgggaggggctgaaatacacgctagtaactcctctgcccttcagccttcaaagtaagagtcagctttttctccccatttgggacatcaagcctagcatctcggggacctgcttcacaagttacagttcgtcctgacatatgtggctccttggcagatggcttggggttcttcgtttcacgtgtttgctcagctctttgccattcctcgtatcctttctgcttctattttcaccctccagctgagattcacattttacggaagcaagcttttcattgacccctggcaataaaaagattttaaagtc

SEQ ID NO: 1020 - DNA, 2618 bp, Homo sapiens
cctctccgcccccaccccctgtcggcgtctgggcctcgtccccttctctctgtctcccttgcctcccccatcacgtcccctgacaccgacaccccattgctcccacagtctccccagtctccactttggtccccagcgctgtctgcccgaggatttgcctgaaggctgcccccaactctgcacccgcccccccagatcctatggacatgtccctggacaaggcagaggcggcactggtggccaaggagctgcggacgcttctggaagaggcagtgccactatctcgcgccctccccaaggtcacgctacccaactatgacaacgtcccaggcaatctcatgcttagcgcactgggcttgcgcctgggagaccgcgtgctgctggatggccagaagacgggcacactgcggttctgtgggaccacggagtttgccagcggccagtgggtgggcgtggagctggacgaacctgagggcaagaacgatggcagcgttgggggcgttcggtacttcatctgccctcccaagcagggtctctttgcctccgtgtccaagatctccaaggcagtggacgcacccccctcctctgtcacctccacaccccggaccccccggatggacttctcccgtgtcaccggcaaaggccgcagggaacacaaaggcaagaagaagaccccatcatccccatctctgggcagcttgcagcagcgtgacggggccaaggctgaggttggagaccaggtccttgtcgcgggccagaagcaggggatcgtgcgcttctacgggaagacagactttgccccaggttactggtatggcattgagctggaccagcccacaggcaagcatgatggctctgtcttcggtgtccggtacttcacttgccccccgaggcatggggtcttcgcaccagcatcccgtattcagaggattggcggatccactgattcccccggggacagcgttggagccaaaaaagtgcatcaagtgacaatgacgcagcccaaacgcaccttcaccacagtccggaccccaaaggacattgcatcagagaactccatttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttagccagccctcgatcattgaggccccattattaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatcacccaaccctggatcagaaacctccccattaacaaacactgccccttaagtcctcttgaaataaacataggtcacacccccaaagcaaaagagtaacagacattcatgtcattgttccccatttaacatcagtcctctcaagatgtcgtgaccccatggtcaccctgaagcccttagattccaacccctcaatcagagacttccttcattaacaaagacccttgttcttatccctcaagaagaaacccaccataaccagcccactgtcacccctaatttacagacaccaaaacagtcctggaagtgctaattacaggaccccccaagtcttcctaccctctgcaccctcaagaaacccccagtgccttgtatgaagcccaccccacatggcccacagctcctgtgctggccagactcccagaaaattctctattttttaagtaacgacttccccctttgggggaccccaaaatttggaggccccattctaggactctggggatcccaaaccctagagtacacacgtcccaaactcccctgtgccctcaagtcctacagcccctagaagaccccaatgccgtaactcctaggacccccaaatcatggaatcccaaatccccagggaatcccaaatttgaaaatccaatcccaagtccccaggaaacccaatcatgaggtccttgtgcctggtatggaggagactgcagtcaggatatgcattccaggctcccagacacctcaagccctattcacaggcaccaggaaaccccacacaggaattcccatccctggaaactggagaatttcaatgccccgagtccatgggtttcaagacaccaaattccaagagccccagccctaagggaaccccaaatcctaaagcctccatctctaataaatggaaggccccaaggccctgaggggatctcaaatcctggaaccccgatttcaatctacgttctagtcactggcctcaaaggaccccacagcacctgggccagaccaacagctcgagggagaacctgaaggcccagggggtccagggcggacctggggccccgaccaccaaggacagctcacgactgccccttcactgcatgtccccaaactcagcatgactcctgtcctcttcaataaagacgtttctatggc

SEQ ID NO: 1021 - DNA, 2606 bp, Homo sapiens
agttggtctccatcgctttacataaaaatggctgagtgtcttgtcatgctagcactgcattaagtgatgcatacagatcttgatgtggaagaaatggaggactcagaaccaaggatttccaagtgatttcttccaaagcacaggaatctcactctgttaaagctggtctgttctaactgaggctggagtacaatggcgcaatcttggctcaccacaacctccgcctcccgggttcaagcagttcttctttctcagcctcccgagtagctgggattacagatgacagtcatgtccctttccagggacctcaaggacgactttcacagtgacacggtactctccatcttaaatgagcagcgcattcggggcattttatgcgatgtcactatcattgtggaagataccaaatttaaagcccatagcaatgttctggcagcttcaagcctgtattttaaaaatatcttttggagccatacaatctgtatttccagccacgtcctggagctggacgatctcaaagctgaagtgtttactgaaatacttaattatatctacagttccacagtcgttgtcaagagacaggaaacagtcactgatctcgcagctgcaggaaaaaagctgggaatatcgttcttggaagaccttactgatcgcaacttctcaaattccccgggtccctatgtattctgtattactgaaaagggagtggttaaagaagaaaaaaaatgaaaaaaggcatgaagaaccagccatcactaatgggccaaggatcacaaatgcattttccatcatcgaaacagaaaatagtaataacatgttttccccgctggacttgagggcaagtttcaaaaaggtctccgactccatgagaacagctagcctttgcctggagaggacggacgtctgccacgaggcagagcctgtccgcacacttgccgagcactcatacgctgtttcttccgtagctgaagcttacagaagtcagcctgtacgtgaacatgatggcagttcacctggtaacacagggaaagaaaattgtgaagcccttgcagcgaaaccgaaaacatgccggaagccaaagacattctccataccacaggattcggattcagccacagaaaatataccaccccctccagtatccaacttagaggttaatcaagaaagaagtccacaaccagctgctgttctcactcgttcaaaatctccaaacaatgaaggagatgtccatttttccagggaagatgaaaatcaatcttctgatgttcccgggccgccagccgcagaggttccacctctggtgtacaattgtagctgctgttccaaagcctttgacagcagcactctgctcagtgcccacatgcagcttcacaagccaacccaggagcctttagtgtgcaagtattgcaacaaacaattcaccaccctgaacaggttggatcggcatgaacagatctgcatgaggtcaagccacatgcccattcctggaggaaaccaacgctttttagaaaactatcctaccattggacaaaatggaggttcattcacaggtccagaacctttattatctgaaaataggattggtgaattttccagtaccggaagtactttgccagacacggaccacatggttaaatttgttaatgggcaaatgctctacagttgcgttgtgtgcaaacgtagttatgtgaccttatctagcctccgaagacatgcaaatgttcactcctggagaagaacatatccttgccattactgcaacaaagtatttgcattggctgagtacaggacaaggcatgaaatttggcatacgggagaaagacgatatcagtgcattttctgtcttgaaactttcatgacctactatatactcaaaaatcatcagaagtctttccatgccatcgatcatagactttccatcagtaaaaaaacagcaaatggaggcttgaagcctagtgtctatccgtataaactttataggctactgcctatgaaatgcaagagagccccttataagagctaccgaaattcttcctatgaaaatgcacgagaaaacagtcaaatgaatgagtctgcacctggtacctatgttgttcagaatccacacagctctgaattaccaacgctgaatttccaggatactgtaaacaccctgaccaacagtccagccatcccattggaaacatctgcatgtcaggacatacccacttctgccaatgtacaaaatgcagagggtaccaaatggggagaggaggcattgaaaatggatcttgacaataacttttattcaactgaggtgtcagtttcttccactgaaaatgctgtcagttctgacctccgggcaggggatgtacctgttttatctttgagtaatagcagtgagaatgccgcctctgtgatcagctacagtggctctgcaccctcggtcattgtacacagcagccagttctcatcggtgatcatgcacagcaatgccattgctgccatgaccagcagcaaccacagagccttttcagacccagctgtcagtcagtccctgaaagatgacagtaagcccgagccagataaagtgggtaggtttgcaagcagacccaaaagcattaagg

SEQ ID NO: 1022 - DNA, 2951 bp, Homo sapiens
gcaattttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggtgttctcattccttctccagggagagtcgctgcagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatgttaaagacctccgtgcctgtggactcatttttccctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtgattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctataagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgacagagagctgtatcaccggctgaagcacttcatggagcaacgtgtgtaccctgcagagccagagctgcagagtcgccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggctgtttcctgccgtccttttccctttaaccatgtcccagtaagaaggctaaataaagggcagggacattgccagcagataacccagactgaggtgaggaataaacacatccaaggaaaatg

SEQ ID NO: 1023 - DNA, 3493 bp, Homo sapiens
ccagcggatgagctgccgcggacggggcgcgggcggacgatggaactccacatcctggagcaccggctgcaagttgccagcgtcgccaaggagagtatcccgctgttcacctacgggcctgatcaaacttgccttcctgttctccaagaccaggtgcaagttcttcagtctgactgagacaccagaggattacactatcattgtcgatgaggaaggattcctagagctgccctcctcggagcacctgagtgtggcggatgccacctggctggccctgaacgtggtgtccggcggtggcagcttctccagctcccagcctattggcatgaccaagatcgccaagtcagtcatcgccccactggctgaccagaacatatccgtgttcatgctgtccacgtatcagacagacttcatcctggtgctcaagcgggacctgccctttgtcacccacacgttgtcatcagagttcaccatcctgtggtcagtggctagactgtagcagccgagaacctcggcatcaccagtggcttcgtgaagcccaagctggtccagatgccggtcatccacccactgtccagcccgagcaacaggttctgtgtcaccagcctggaccccgacacgctgcctgctgttgccacactcctcatggatgtcatgtcctacttcaatgggtgaggatacaactagaagccagcagtctacaggctggaagaaggccctcaccagaacccaacccttggacttcagcctccagaactattcattcagcttttccagaccaggcatcaccgagcggagagaggggaaacaccctggcttctctttggcacatcagcccctagttcttgagagagaagggcagggtggtctactcaccatgtctgtatcctgccgttcttcatttgactcatcctggatttctaactcttcttcctcgtcctcttccataaggctgagtctgatgtaggggcaaagagactggcttttcaaactgttctttgaggacccctgagagtttctcagacacccggggtgggggaagtggggagcagtaagtacagcatagtagtttcccgattgtgctgacaggaagtgctctgtggctaaaacaagtccaaaaagcacccacagagaggcaatgggtgagacaggaatcccctcacagtgggcgacagatctgaagtgaagacaggagatgatgagaaaagctcaccgcatcagctggttgcccaggccaggacctgaagggttgtgtggagtctggaaatattgtggacccaagaaccttgacctctcggtgcctgcgacgggctgactgctgggaatgaagcaggatcaatgatgggataaaaatcaagggtaagaagaggatgtaaggcagctggtgttaatggggagaaaagctcagagagatgcattttaaagctaaacaatggagaagggtttgagaagaacccaacaatgtgggagtgctacagcagggaaccatgaaacagaaacagcaagatggaggcagccagacaccaaactgggaactcagacacccagattccctccatggcctcacccctgggcaaaatccaactctgagccatcttcttcctccatctctttcaacccccacaggggctgcctgctcttcacagctgtggaggtgagggtgggcgtgggcgggatgctgttcagctgcagactttcttcctgggacgaggagacgtcctctctgttaggcttggcaggccctgccaagcagatgcatacattaaccacagcccagggcctgcgacaggtgtgctctctttccaagacctgcccaggatttagtaagggaaagtcaatcaggaagagaatggaaaacttatacagcttcattctgttgccctcaaatgggcatagccctatgtactaaatacatagccctatgtaccaaaaagtaaggcttagagaattgtagctaggccttgtccaagaagaacttgctacacagcctagaaaacaagatggaaagatatataaatatacatttcacagataaactgtaacaggtgaacaggtgaacacaaacatgagggagggttggagtctctaagattgagaggtctgagttagccaatgaagacatctgagatcctatccaagatttctgtggtcagaaaaagctgtaaatggcaatagagttttggtaccagaggctagagtggacaaatgagggccagggaggaaccggaaaatgggagacaggattttctaaaagctagaaaaaaaatgaagtgattgcaatgccagtataactgatatgatatgaagggggacttatctcctgcagagattggagaaggtagaggaggagaaagaatccaaagattctcactgcctgagaaaacccaggcaatactattttaaagcatcagtcaaattgacattaacatctgttaactgtaaacagtcacactcccattaccccccttctccactaaaaacaataatcccaaagtgagcgctcagcctatgggtttaagcagagggctacagaaaacagggaagagacatacccctgggcttggattcccagagaggaaaccttggggccccagatgtgtcctcctgatctccctgagctattaatggtgtgatgcccgagggctgggcccttgagtctctcctcttctccatcttcactggcttccccagccactcacgttcatgtccttaaatatcacctatactctgccacatcccaaagggatctcaagccttcagctctcccctgaactccatcttaacagcccccatggtttgttcaacatctccacctgtaatcctgtggccaacaccaatgccccaaccttcccccacagctatcttcactctctgccttccccatctcagatactgtcaactccatccttctgtcaggccaaaatccttggagccatcctcaactgctctttttgtcttacatcctgtaccctctttggtctcatgtcctacaatctgcattctggccataatggtcttctctgctgttccttgaacattccaggaacattccccccatcccctcgtggcctcaggactggctgcttcctttggtatgctattctgatacacactaagcaccctccctcacctgttataaaaaattcgctgggaggccaataggctgaaatggctcctgcactttgggttcctaagtcagcaaactgaaactcaactcagagtgaaagtgttgtgtgtaacctaggagcaggaaacttcagcttaaccagtcagaaactaccgactaacctctaacaagagatttatggtcagttaacctctaaatatgaactttccactctaaccaatcaaatagtttctttgtcttgctcccagagacaccttgtaagtgtcccctctggtttcctcggtggtggcgccctgaactgctggcggtctgccactgcctgattgataaaattgctgaatgctcaaataaacctgttaaaattgt

SEQ ID NO: 1024 - DNA, 3029 bp, Homo sapiens
aacaatgggcggcgcgagcgtccaggcgctgggctctagctgaggccggcgcttagcggcccactgtccgcagcatgagcggggccggcgtccgccgcacgacggcggggctggggctgtgagggccgcggttccggactcgagttgccgcgtcgggctgggcgcgccgccgggtcccatggagctggaggggcagtggtggcgaggacagctggccgccgatattcaccaagcgcttcgctacaaggagctgaagttgccctcctataaaggccagtcccctcagttaagtctcagacggtattttgctgacttgattgccattgtgagcaatcgcttcacactctgcccttctgcccgccatcttgctgtctatttactggacctgtttatggaccgctatgacatctctatccagcagctgcatttagttgcgctttcctgcctgcttctagcaagtaaatttgaagaaaaagaagacagtgtgcctaagctggagcagctcaacagcctgggttgtatgactaatatgaatctagtattaacaaaacaaaatttgctacatatggaactattattattagaaacctttcagtggaacctctgccttccaacagccgcccatttcattgagtattatctctctgaagcagtacacgaaacagatcttcatgacggctggccaatgatttgcttggaaaagactaaactctacatggccaaatatgcagattacttcctggaagtatctttgcaagctgctgcatgtgtggcttcttcgaggattatacttcgtctttctccaacgtggcctacaagactacatcgtcttactgcctactcttgggatttcttagtgcagtgtattgaacgactgttgatcgctcatgataatgatgtgaaagaagcaaacaaacagagagggcaagcaggacctcagtcagcgcaactaagtgtattccagacagcctcccagccatcacggccagttcactttcagcaacctcagtatctccatcagacacatcagacctcactgcagtatcgccatcctacgtcagaacaaccaagctgtcagcagattgtatcgaccacacacacctcatcttacacactacagacatgtcctgctggcttccaaactagtgttcagggccttgggcacatgcagactggtgttgggatgtcactggcaataccagtagaagttaagccctgtctgagtgtttctcacaaccggagttatcagataaatgaacattacccttgtattactccatgttttgaaaggtgattatttgtgaagctgataaccgacccagactgctttgtgacatgaagctatgggtaagcgttttgtaaacttctgttcaaaaggaaagggatctaaatgacatcagaactcttcaggtaccagcaccaggaagactgaatatcctttttaatgcaccatgaatcctgggagactaagcaaattaacagtatgtcaaattctgttacaacaaatccctgtatgacaaaaatgttcaagtcctggctgatggtccaaatatttcaaaaatattcagtacaacagaaaatttggacagacttcaatttgccattttgagatttgacctgtggtagcatctgggcctaatgttggcttctaagtcaaagactaaatgtttatctcatctatggacttgccaaacagtcttttatgaaggaaagttacagtattaatttttgaaaaggttttttttattctgcaattttttatttttgttctacacatgaatttttgactaagtttaaactcatgaattgttatgctataccaatctgcagtaaaaaaaatttttttagatgattctatataacttcgtctcacaaatagtgtaggtatctgggtttatatactaaaattaagggtggagaagatcttattttttaaatcatggtcataatttttctttttttccctaagtgatcaacatcaaatttttagaattaaaatacatttaactcagggaatttgtactacttggaaacacttaactgtaatgcaacatgccttgggaatgttatagtgtgaactacctttataacataggttaaaatacgcttgctagggtgtgttttcaaatgagaacataatatagctcagaatgaagtggtagttcctgtgattcataatacatatgtaggttttgcatatctcagtgcaatccatgatttatactcagaatcgacattcttaaaaagttatttcaagggatggcataactgtaagaggtcagtgctagaatagagtcctgtaggtttattttggaagggactgtggccagggtagttctcaggttgtgctagagcagcactttgttatgtggaagacaggttttttaagcaacctttgaatccagctctagtcagtctaagcaggcaaaggtaactgatgactaaatttcagtagctactttcattggattgaccctacaactgccctgggacatttcactgtaccagtattaactgcaaacagcaataattgtcattacagcaagggcagtttgggggtaaagcattttggaggaataaccttaaaaagttaaaaagtcattgtaataactgataaactgtatacattgtgctcctttctgtgggatggggtggttggagaaccagaactatttttaaaacattaggtttcaatataaatacaactcacaactgctagctttggggggtgggggaacattgtgtgggttttgttttgtttaatttattgattagtctttaaagtaggctttttttttttttttttgagaatactggaccatcattaaatgtgtactgtgaagagattaatatgtatgaagggctttaccaaagtccactaaataaacactactcaagtacagactgcaaaccaaaatgtatctgtgttacgacattaattacaaatagcaagtatggtgctaaagtctacaccaatggaattagatgagtgctatgcacttaattttaaaataaaactagttttcagt

SEQ ID NO: 1025 - DNA, 2358 bp, Homo sapiens
ccaaagacaacaaaaggactgcctcaaacagcggtttgcaacttaaatatcactctgccagcacataaaaaggagacagagtcagatcaagatgatgagattgagaaaacagatagacgacagagctttgcatccttagctttacgtaagcgctacagctacttgactgagcctggaatgagtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttatccttcccttcaagtggaactggaaacccccacagggttgcactacacaccacctacccctttccagcaagatgattattttagtgatatctctagcatagaatctccccttagaacccctagtagactgagtgatgggctagtgccttcccaggggaacatagagcattccgcagatggacctccagtcgtaactgcagaagacgcttccttagaagacagcaaactggaagactcagtgcctttaacagaaatgcctgaagcagtggatgtagatgagagccagttggagaatgtatgtctgagttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcttgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgtaaacactacagtatactgcaacacaaaagattttatctgtaaacacaaagcccttcatctaatatttgttgctattgccaatttttcaatgaaatgacctaaaaacaac

SEQ ID NO: 1026 - DNA, 2625 bp, Homo sapiens
tacaaatgtgaagagtgtggcaaagcctttaatagttcaacaaaccttactgcacataagagaattcacaccagagagaaaccctacacatgtgaagatcgtggcagagcctttggattgtccacaagcctgaatgaatataagaaaattcatactggagataaaccctacaaatgtaaagaatgtgggaaagcctttatacattccttgcacctgaataaacatgagaaaattcatactggaaagaaaccctacaaatgtaagcaatgtggcaaagtcattacctcatcctcaagctttgctaaacataagaggattcatactggcgagaaaccctttgaatgtttagaatgtggtaaagcgtttactagttccacaacccttactaaacataggagaattcatactggagagaaaccctacacatgtgaagtatgtggcatagcctttagacagtccgcaatcctttatgtacataggagaattcatactggagagaaaccctacacatgtgaagaatgtggcaaaacctttagacagtccgcaaacctttatgtacataggagaattcatactggagagaaaccttacaaatgtgaagagtgtggcaaagcctttggacggtacacagacctgaatcaacacaagaaaattcatactggagagaaactttacaaatgtgaagagtgtggcaaagactttgtatggtacacggacctgaatcaacagaagaaaatttacactggggagaaaccttacaaatgtgaagagtgtggcaaagcctttgccccatcaacagacctgaatcaacacacgaaaattcttactggagagcaaagttacaaatgtgaagagtgtggcaaagcctttggatggtccatagccctgaatcaacacaagaaaattcatactggagaaaaaccttacaaatgtgaagagtgtggcaaagcctttagtaggtcaagaaaccttactacacataggagagttcacactagggagaaaccctacaaatgtgaagatcgtggcagatcctttggatggtccacaaacctgaacgaatataagaaaattcatactggagataaactctacaaatgtaaagaatgtgggaaagtgtttaaacagtcctcacacctgaatagacatgagaaaattcatactggaaagaaaccctacaaatgtaaggaatgtggcaaagtcattacgtcatcctcaagctttgctaaacataagaggattcatacaggtgagaaaccctttaaatgtttagaatgtggtaaagcgtttactagttccacaacccttactaaacataggagaattcatactggagagaaaccctacacatgtgaagaatgtggcaaagcctttagacagtcagcaatcctttatgtacataggagaattcatactggagagaaaccctacacatgtggagaatgtggcaaaacctttagacagtctgcaaatctttatgcgcataagaaaattcatactggagagaaaccctacacgtgtggagactgtggcaaaacctttagacagtctgcaaatctttatgcacataagaaaattcatactggagataaaaccatacaagtgtaaagaatgtggcaaagcctttaagtcatactacagcattcttaaacataagagaactcataccaggggaatgtcttacgaaggtgacgaatgtcgcggtttttaaatgctcctcaatcctttctaatcataagataattcataatgaagagaaactctaaaatgtgaaaaatgtgagaaggcttttaatcacacctcaatctgttgtagacataagagtaattatattgatgagaagccaaattaaaattaaaaatgtggcaaagacttccaattctagtcagttcttaatgtaattcctactgaagaaaacacctggaaatacaaaaaatgtggcaaaacttgtaaccaatgcttagcatttttgcacatgatagtatttatatgtgagactacttgtacaaacataaaaatatacaaaagctattgtctacttgaaatttatagttaataaaagcattataaatgtaatttctgttgaaagaccttttagaaaatataggccattaaagtgaatagtcttaagacagagaatacaaagataaagagggctctagtacctgtacttgtatcccagaacttactatatgcattttgtactagaggaaaactctgaagcagttgcttaaactttgttcaacatcagagaatttatattggagagaaatcctacaaatgtaataaatgtggaaaaacctctgttcagaaactgcaggttaagaaaccagaggccaggcgcggtggctcacgcctgtaatcccaacactttgggaggccaaggagggtggatcacctgaggtcgggagttcaaggacagcctgaccaatatggagaaacctcgtctgtactaaaaatacaaaaattagcaggacatggtggtgcatggctgtaatcccagctactcaggaggctgagacaggagaatggcttgaacccaggaggtggaggttgcggtgagctgagatcgtgccattgcactccagcctgggtaacaagagtgaaactctgtctcaaaacaag

SEQ ID NO: 1027 - DNA, 2783 bp, Homo sapiens
ctttatctgtttccacccaccctgggatcctttttacttgtagcccattcctgccctctaaaagaatccttccaacttcctataggggccatttcatgcagatatactcactttatatgtatgtttctaaaagctttagtgaaggctgaatccaagtttcatgtagtaggacagagaacagaaggccgaatccaagtttcatgtggtaggacagagaacggcaatctacaaaactacaccaagcctaagatggcccatgtgccactttgttcattcatttatttattcagcagatatttattgaaccacttggtctggtttggttttgaacacgcactaattcatttaattacaacaactttgcgatgtagttattgttataatcctcatcctaaaggtgtgagaaacagagttattaagtaagttgccagaagccatacaagtacaaagtgtcaaggggagactttaagccaggtctctattccatgttttgtgtctgccatgttttcattcctgagcagaagagcttggggaaatgaacttttgctaagtaaacccagtatttaaattaagtcactatatctgtgtcttttaagagcccctcctttagcttacatggttagttgtatctttttttttttttttttttgagacagagtctcactatgttgcccaggcttgagcgcagtggcaccatctcggctcactacaacctccgcctcccagattcaagcgattttcctgcctcagcctcccaagtagctgggattacaggtgcccaccaccatgcctggcttaattttttgtatttttagtagagatgaggtttcaccatgttggccagactggtctcgaactcctgacctcaaatgatccgctgtcttgtcctcccaaagtgctgggattataggcgtgagccatcgcgccctgctgcatttcatttttttgtataaaatttggtttgttcgtttttgaggggaaccattcctttatgttgccccttactgatgcccaactaatgtgtttctggttactaacagaccttcatcccccaccctccctaaattcttcggtgtaatctaagcgttatctgcaccacttctgaataataaatgtgtttgaaatgcacacctacacaaccctgtcccacactggcctgtaggacctaatctaccttcatgtctttcagttgatttgtatttctgcaaaagatatttcaaggattatcaaggtatggaattttttttattttttatcttttaacaaacttgttcatttccttttctttccattgagcacctctgaacaatgtgattcttttttttaagtctttcacacttcaggaaaatactacattcacccacgttgtgattcatatcggacagtttcttactcaaagataacacaaataccaattcttattcatactttgaaactatattttaccctagactgccttggttcaaaggcctagtttcgacattactgtggcaaattatttaagctctctgttttcatttctttttctgtaaatgcaggatgaaaacaatatgtatctcctaggatggctgtgaggagtgagtgagacaggacatgaaaggtgtgtatgaactgtgataactgttgcccttgtgggcatgttatatagggctggctctaggaagaagcctgtgtcttttttcagaaatccctggagcaacttaaatgtctttagaaatgacaagtctctcagttatccagttagccgtaaacaggttctggaagacacacctagatagaactcggcccgtcagttctgagtgaggcacgtaccacttgggcttgggatgtccttaacccatttatgcctgaggttgcaattttttgaatttttccaatcacaccttggcgatgaccttgagcagtaggatataaataactcccacatgcttagtgttccaataatggaacactaggcataaacaggttttaattggctcctcagtcaaccatgaccaatatctctatctcagcttctgctgatgccctagctcagggctctgcattccgtgccagggacgcctcagccccttaacatggatgtgccacatgacaggcaataatatattggccccattagcccttcctggagcagtcataatgaattacagtcatgacaggcacatgtaagaaaccaaaatttgctaaatatgtacatgagtcttcatcacagcatcgtttatgaaaacaactaaatattcactaatggtgccagtggaataaatcagagaacatcccctgctacgtaactctctgcatacatcaaagagaatggtgtggctttgctttttcaacaatctactgagtggccatgggcatgtggatatggccatgaatgagcaagatcctctctgatcctgtagaagttaagttctaccagataacttgctgcttcaacaaaaagatttacctttttaaataaatgttgtagaatacttaaaaaaaacaaactagaatttgcctgtgtgcagccagtaacatgtctatttaacctggacaccttttgaggaatattctcagattgcccccatgctgtttataagacattgttccttatacacctgtttacgaatgaaaagaaacataaggagtgggtacaaatacttctatctatgaatgattaaaaaggctagagtacgaatacttcttgaacctttggtactaaatgcttttcatgttctatataaatgtagaaaacattttacaaatcctgtaaataaactgtttattttttatagaaagcc

SEQ ID NO: 1028 - DNA, 3237 bp, Homo sapiens
gctgagctgagcacctcctccctgagacagcagcggtctaacccccggcgcgggggggacccagccagggggctgtcctagtagattccggcattgcctccaccccgctgtggcggagacgcagagggcgggtcgcgctcgagggtcagggaggagagtgacccggccctggtccagggccctccctgcccgccttggggccagaactccagccctggggagtgggcagggcctgttttccgtgcctcacgccctgcttttcgcctccttcagcgctgtctgctagctgcttttcctgctctctctccctggaggcgaacccttgtgctcgagatggcagccaccctgctcatggctgggtctcaggcacctgtgacgtttgaagatatggccatgtatctcacccgggaagattggagacctctggacgctgcgcagagggacctttaccgggatgttatgcaggagaattatggaaatgttgtctcactagattttgagatcaggagtgagaacgaggtaaatcccaagcaagagattagtgaagatgtacaatttgggactacatctgaaagacctgctgagaatgctgagggaaatcctgaaagtgaagagggctttgaaagcggagataggtcagaaagacaatggggagatttaacagcagaagagtgggtaagctatcctctccaaccagtcactgatctacttgtccacaaagaagtccacacaggcatccgctatcatatatgttctcattgtggaaaggccttcagtcagatctcagaccttaatcgacatcagaagacccacactggagacagaccctataaatgttatgaatgtggaaaaggcctcagtcgcagctcacaccttattcagcatcaaagaacacatactggggagaggccttatgactgtaacgagtgtgggaaaagttttggaagaagttctcacctgattcagcatcagacaatccacactggagagaagcctcacaaatgtaatgagtgtggaaaaagtttctgccgtctctctcacctaatccaacaccaaaggacccacagtggtgagaaaccctatgagtgtgaggagtgtgggaaaagcttcagccggagctctcacctagctcagcaccagaggacccacacgggtgagaaaccttatgaatgtaccgaatgtgagaagagtttcagcaggagctcagctcttattaaacataagagagttcatacggactaagctgtaattatgatggctgagaaatgattcatttgaagatacaattttatttgatatcaatgaacgccctcaagactgagctgcttttatcatactctcctagttgtgggccacgatttaaaccatcagagatgacaagccatttgaaattctgaccctcagctttgggaatgttatctcctccaaaatggtgatttttattcactcaatgggttacttcattaaaagcagccccacaagtaactggaaatctgaagaccaggggacaaatgctggtgaatgcttaggcctggaaatggagtaaatctttcaatgttattttctcccatccttggcccaaggaactatgctaagtgaaacgtgggactgtaatagggtggtaatggctgctttggaaaaaggcaactagagactctgcctaaattgccacacctattcacacaccatagtagttgggcacacacatcttcccttccaaagggctttttccttgagttgctcatgcatttgtatcttttccatcttcctgagggcaagattttgcacgatgaaggcaatgattgtaacttttctccttctcattgtttctaattagctcctttaaagcttgcatctttgtgaaggctaactgaagatacggttggaaaggaaaaatgagacacaggtttggggaccaaggacccatcaatgatggtgactttagcagaagatgcccacagttattactgccattaatcagatttatgaattttctttggggatcactatagggaatattgtatagaaaatatcttcaagaaaagataggaccatcagtgacagttaagtgtaaggagcaagtggaattgagtccttcagggaaggaaccacagagtcccttcccaaggaatgtaggtcgtttctgtgttctttcccttctaatctttaagatcaactcttcctatcctgctaactctaagatttgataagggccacatcccagtgtttatcttagcttgcatcagggcatgtgtatgtacagtaatgtgtattcctgtggtttttctaatagaaactgaatttacagagacttagcatgttcttgggtgatgtgagtcatgtgacagaagtacagacataactccaatgtgagaaatgtccttttttcattatggaaaataatttaaacactagtgctttagtgtgcactctcctgtaaggtctgtctttgtacagagctaagcacttgtttgtatgtgtttgtcaattgtggaagataatgaccagacaaataggtcgattgtcctattctcagaatgaattatcttctatggtaatgaagaactctttggcttagtcagaaggaattaacgaacctcggtaggaatgtatttccatcctcccaccctacagatataagaggttaaaataacagttcgcccaatttaagcccagtagtgtcagttttcctaatctcagtccaggtaggaattaagaaatatctcaagtgttgatgctatccaagcatgttggggtggaagggaattggtgcccagaaaatgggactggagtgaggaatatcttttcttttgagagtacccccagtttatttctactgtgctttattgctactgttctttattgtgaatgttgtaacattttaaaaatgttttgccatagctttttaggacttggtgttaaaggagccagtggtctctctgggtgggtactataatgagttattgtgacccacagctgtgtgggaccacatcacttgttaataacacaacctttaaagtaacccatcttccaggggggttccttcatgttgccactcctttttaaggacaaactcaggcaaggagcatgtttttttgttatttacaaaatctagcagactgtgggtatccatattttaattgtcgggtgacacatgttcttggtaactaaactcaaatatgtcttttctcatatatgttgctgatggttttaataaatgtcaaagttctcctgttg

SEQ ID NO: 1029 - DNA, 2377 bp, Homo sapiens
cgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtgaaaggtgtagcagtcactcggcctacacccacagcatcgaccttgtgaacccagcgacctgactgccttgggagaattgaagcgaatgagagtggggagtgtgagaggtgcgtttggtgcagcatttctggcatgggaacagaactggccaggaggaagtgacgtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggatgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatgg

SEQ ID NO: 1030 - DNA, 2657 bp, Homo sapiens
aagggcaagtaatccgcctgccggaggaagcaaaggaaatggagttggggaggagggtgcagagtcaggattctcgccgacctggtgccgtagatactaacattttggggtggaaaattctgcaagccagagctgtgagggcagaattggtggaaatcattttggaggaatcctgcattgtgtcaaatatgaagggtggaaggaagaaagcttttgcgtttgctctcagctggatcctttcttctcatcagttaaaatgtcattttttaggaaggctttccgtaatatcacaccctaacgttttctcccagatactttatatcacaccatcttatttaatctccttcacaacccttatcactctgataagatttatttgttcattgctttcagtacatggaaacgtaagccttatgaggatatagaatttttctactatcttattcattgttgtattcctgagtgcctatatcagtgctgggtagcaagtaagagctcgataataaatattttttgaatgagggagacaggtctgaagcctggagaatgagatgcagaagaggtgcaagacctgctgcgccctctgcaggcggcgggggggcggtgcaggtgctttaagaattaccgcgggactcggtagggggagcgtaggcgcttctcgccaagatagaagcgttcagactacaactcccagcagccacgaggagccctagggcttgatgggaacgggaaaccttctaacctttcacgtcccggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacaccgcttggaactacagcttctcccagctgcctcgatttctcagtggttcctggtcagagttcagcacccaacctgagaacttcttgaaaggctgtaagtgggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacaccggggtttcagtgtccatgtctctctcagcgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgaggctgcgaggtccgagccacatttgcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgat

SEQ ID NO: 1031 - DNA, 3817 bp, Homo sapiens
aatctagtaaaagaaagtctttgatataccaaagtgttggataacaaaggctagaaaattcagataatttataaaggttaactatacttgtgcttataaatgtgcagattctacaatatttttccatgtcattctaaaagaatcttcagaaagaaaaacttgaagaatactaatgtcttgggaaacatgagattaagtttagggaaaacacttgatagatgtggagaatctgaggactcagaattcagcaactaatcacaggtggttttctaatttggcctctggacatgtctcactgtttgtatttctctctcctgtcaaagtgaatgatatattcttgaaaacccccaatttcttgaaatgggtgttctgttcattcatgggcaggggtcaggattgaagttcatatatgaaacaactggggatgtagataggaaagaatgtctgctgcaggagtgtatgaagggggattgtcatttacaaaaaaaaaagtacctcatggatggaaggattcatgaatagataatggacataggaaaggaggtcaatggaggacacataacagacatgctatccaccatttatttgtgattttgtaagagggttctcttctttgtcttgttcagatattttcatgtgtgtgttttagtgagaatctgagtttttaatcagtaaagtcagatgttttgataacttgatgttttgatggtagactcttgagttcatcttgtccaaatcttctagcattttcaaggatgaagcctctgtgggatctttgggcttggggctgaatttctcaggcataaatacctaatggccttgtctaagagggaatagatctgttctgagtgtccccaaaaaagttgtcctaggaactgatgtggagaagttacagggagactgatttccattccttattggggaaaacgaagcactcagaacatacaaggataaatgggctgccaccagaggtgaggagtctcttgtcactggagaggttaagatagaggctcaagaacaatgcaaggaaaatggaggttttcaaacacaaagtggatggtggtatgagacaatgtttaatgtccttctaactccgagagtccttgattctggagaggcacaggatgaacatctgttgctactgctgagtatacacactcttgcctctgagatggcgtgaccagcagaaaagaaagctcagggctgtggcttcagaattcatggaaacagagccactgtcaagaaggaatctgctcagagcagattctgagttttcacactccacaaatcctcagatttagtgggaagctggaaaaaggaactcttaattccaattgaggagaaacaagaaaacattacaaatcagtttcccaagctgagaaggattagccttgaccccttgggtctgcctctgttgccctcaccagtttaccttctacaacagtttctcaggaacatgtgtatttccccattcagctttcagcattgctccacgccacagcataagcatagatcccaagtccacaggctccattttgcaggtcatcttctgatcctagcaaatgtcctttccccatagttgtcctatgcctttgggctttagtctatcccaggactaactgtggagaaatcattggtttgagagtcaagagagcattggtttgggagctttaatcctctttctgcttcacactaagtgtgtcatcttggctaaatcacttggtctttctgcattttgttttcttatttataggatgaggaaattagattaaatggttttgaggtcctttcttgttctgatatgtccagtactcactggaaaattggatctataactgatgggtttagtaatctgctcatttcttgctctgaaaattgtagtcagcaaaagagatcatggaagaaatcactgtaatggtagtaatagtaacacatgccatttgtattgtgccttaggtttaccaggtgtttccaaatacattagcatatttgatatgtgcaggactagataccttgggacctgccacactccactttcaagatatgtattagcttcattagaattaaagggacttgaactcaggacctgcagcctattctttatccacatgtctctggtagggctacatccagatcacaccatgacttcttatagagcaagagaaaataatattattatatcttcctttgcctaaaatctctccacttattcttttttatgattctgcaccagttcactgggttattctatgattccatatttttttttaaaaaaatcatatttaaaatgaacttacaatgtctgaattttcctggccttgagtcacagaagtaatatgtttcagatggctgcccaatatgtattatcatgtaatacatatctgtgtccttttctgggatgaggaaggcttcaacttctggcactgagaactttgtattacagacacaggtttagtttctagcttagtcatgcctttagagtttagtagcacaaatccatgcaacccaacagaatacatggtgagggcctagtatgtagaatttgaaagtagttcaaatttgaattagaagaatgaagctaggacttatttggaaaaggagatagaaaaaaaatgatcagaaactgtggggccttattacctttgcagtaagttatcttcttcatgatatatgtgaattattttatgtgcagattgtgttttgggattgtcagatctaaacttatattcttgctggctaatgtgctgatagccaggtctgaaacttgatgtgctatccagacacatatgatcagaaaagatctagagtgcaaagaggtgtctgaggagcaaaatgtggttttaatgttgtggaaagatcgcttgcaagtatataagactgtataaagaagaggactgtgtgcaagtggggtgaaaaaaaaggatacgcgaatgtgcatatgactgaatagggaggaaggtcagggctagaaaggaggctacataaaaaggggcaatggagagtgcacaggaaagacacaggggaaggtcaagtcgagcaaggtagaaacaggagtagctagagccattgggaatccattttgaaacaagaaggagttttgaaagggaataggaaagtaagtgtcttgaagtaaaagataaatatggatggagaaagaagagattctggatgatagagatgataaaaatatttattaagaaatgaagtcaggttcagtgtatgaaatggaaaggaatttttcagaattttaagaaaggggaagttcctcttggaaaagatatagcaaccattggggaatgaccttttcatttcagaagtggatgaggaaggtggtgtgagcatcaggtatattctggaccatttcaagtgctggtgagaagaaaggaactctttgcctgaactgggcttggttttccaagtgctgctttggaaatgaagacccagagatgcagagcttatggtagttcataaatcttcatgttctattatctttcatctgccaataaagttcattttcaataatgtccaccattgctgtgcccagaataaccacaggcaaacatcaaaacaatacgcataagttagacaagattaaatcttgtctgatatctgcacaaacagatatgcaccatgttggaaacatgtgttttcctagtcccatccaggcttcccacaagaaagccatgatgtgggtctaaaccatatgttttgagtaaaggagaatagaagaaggggagtgtccgcaaaatggaaagagatgaagatgttccaaggaaatatgctgaaacagaacagtgaatgttttgcccaaaactac

SEQ ID NO: 1032 - DNA, 2550 bp, Homo sapiens
ttttgtacaaatgggatctcactatgttgcctatgctggtcttgaacacctaggcccaacgatcctccagcctcgccttctaaagtgttgggattccaagagtgagccatggtgtctggcctcaaagatctttaatacctttatagagttgtgcaatcatcaccacaatccagttttgagacatttccattactccaaaaagatcattcatgccatttgcagttaaccaccactcccatctccaacctcagctactgttgatcttgctgtttgcacagatttgcctttatgggaagtttcatataaaaagaatcaaacaatatgtggccttttgcatctggcttctttcacttaatgcttttgaggtgtatgcatgttgtagtgagtatcaggtgtacgtcatgtatacgcaggaatatctgtccctttgctgtcggggaggacgccatcgcatggaggtcctgcattttgtttttctgtttctcagttgacggtcatgtggattgtttacaggtctgggctattatgaataatgccactatgaacatctgtgtccaggtttctgagtggacacacacggctaattttataataaaaaaaacaaaaccaaaggaccaaaatgaattctggaactgtttctggaatacgtttccttttaccaaaatgggaattctaatagcagggcaggaaatgtaaagtaggagagaaagaagtgggctcacagcagcctttcccctcctcggatttgggaacaaagaggcaggattgtcccactctagaagtggctcatattcgcacagttcatccaaagctacagaacacgctcaacatcccatctgccccgcggcacctctgatatcgatctcaatccaaacacccacccctctcttgagtctcttagttcaaggacagcaaattcaggacatcgcacttccctgcccctgatgcatttagtgagagcgggggtttgagtttggatgactgtggagaaaagccccaagcaccagtgtcaattcctgggctgagactttaaggtttagcaattcaagtgtttcagctaggtcccttcccagtgtacaaaggtcaaagtttgtagttatggaaggaaaaggatcagaaaaaaccatggaaaataggatctggttctataagcaggaaagagatgcaggaaacaatttagaggaaaagaggcaaaaagtatactggctctccaagctggggtgtcttattcaccaagaagtggcgagaagcagacagacagcacgttttgtcgggggacagtggtttttgtttttttgtttttttttgagacagagtctcactgtattgcccaggctggagtgtagtggtgcaatctcggctcccaggctcaagcgattctcatgcctctttctgaccctcaggttgccctagtgactctaggaacctttctccatacctcttgcgtgttatctatggaacatggactttgaacctctcttctttttcgtctccttgctttgatttaatccatcatttctaggtgcatgacaacactccctaacttaacccccctgctttcccattttaactaccatcacaataatcttaatactggcaggtatctagcgcttggcgattttcaaagagcttccactagttccttgctcggaatcttgtgatgcaggcaggatagctaggagtgtctccttttaaaggaaatcaaggtagaaaagttcagtgatgacccaatatcataaaaatcataaaatggtgagaccaggagcaggttataggtttctaccctggtgcggtcccaggatggggcctgtaagtcctgaagtttcaggcaaatgtgctgtgactggatgtgttaaattagactaacagggagtggggaagggctatgacaattcagagtaggtctgtagaatatgttcacaaaaccatggatttaagaacatgggagcttgtgaggagttttctaactcattttttaagttttctagatgtcttatccatacaatttttttttttttgaaatggagtcccactcttgtcacccaggctgtagtgcaatggcgcgatcttggctcactgcaacctccgcctcccagtttcaaatgattctccttcttcagcctcttgagtagctgggattacaggcatgtgccaccatgcctaatttttgtatttttagtagagactgggtttcaacatgttggccaggctgctgttgaactcctggtctcaggtgatccgcctgcctcagcctcccagagtgccgggattacaggtgtgggccacctcgcctggcccatacaattttttaaagggcattgagatcctaaaattgaaattgtagatagatatagctgtgggataaagaacttctgctgaatgatgatttgcaaaagtatgtcttcagtatagtactgagtactaattttatggggcaaataactctgtatttaatcttatgaccttgtataaaatcttgccctaaactaaattcaaatgtatagtcatttatacttaattacaaaatttggtgctatgttaatatttacc

SEQ ID NO: 1033 - DNA, 2915 bp, Homo sapiens
gtgcggagcgaacggcggcggcggcggcaccatccaggcgggcaccatgggcacgtccgcgctctgggcgctctggctgctgctcgcgctgtgctgggcgccccgggagagcggcgccaccggaaccgggagaaaagccaaatgtgaaccctcccaattccagtgcacaaatggtcgctgtattacgctgttgtggaaatgtgatggggatgaagactgtgttgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtccctctcgaacttgccgacctgaccaatttgaatgtgaggatggcagctgcatccatggcagcaggcagtgtaatggtatccgagactgtgtcgatggttccgatgaagtcaactgcaaaaatgtcaatcagtgcttgggccctggaaaattcaagtgcagaagtggagaatgcatagatatcagcaaagtatgtaaccaggagcaggactgcagggactggagtgatgagcccctgaaagagtgtcatataaacgaatgcttggtaaataatggtggatgttctcatatctgcaaagacctagttataggctacgagtgtgactgtgcagctgggtttgaactgatagataggaaaacctgtggagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctggctttgtttactggtcagactggggtgaaccagctaaaatagaaaaagcaggaatgaatggattcgatagacgtccactggtgacagcggatatccagtggcctaacggaattacacttgaccttataaaaagtcgcctctattggcttgattctaagttgcacatgttatccagcgtggacttgaatggccaagatcgtaggatagtactaaagtctctggagttcctagctcatcctcttgcactaacaatatttgaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtactgcaactactgtgacttacagtgagacaaaagatacgaacacaacagaaatttcagcaactagtggactagttcctggagggatcaatgtgaccacagcagtatcagaggtcagtgttcccccaaaagggacttctgccgcatgggccattcttcctctcttgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcaatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagctt

SEQ ID NO: 1034 - DNA, 827 bp, Homo sapiens
tcctatcatcgcaaaactcatgatgctccggctgctcagttccctcctccttgtggccgttgcctcaggctatggcccaccttcctctcgcccttccagccgcgttgtcaatggtgaggatgcggtcccctacagctggccctggcaggtttccctgcagtatgagaaaagtggaagcttctaccacacgtgtggcggtagcctcatcgcccccgactgggttgtgactgccggccactgcatctcgagctcctggacctaccaggtggtgttggacgagacaccctgctacatcaccggctggggccgtctctataccaacggacctctttgtgcatccactctggaaccgctcgtgtgtggcctgtggcaatgacatcgccctcatcaagctctcacgcagcgcccagctgggagacgccgtccagctcgcctcactccctcccgctggtgacatccttcccaacgagacaccctgctgccggtggtggactatgaacactgctccaggtggaactggtggggttcctccgtgaagaagaccatggtgtgtgctggaggggacgtccgctccggctgcaacggtgactctggaggacccctcaactgccccacagaggatggtggctggcaggtccatggcgtgaccagctttgtttctgcctttggctgcaacacccgcaggaagcccacggtgttcactcgagtctccgccttcatcgactggattgaggagaccatagcaagccactagaaccaaggcccagctggcagtgctgatcgatcccacatcctgaataaagaataaagatctctcagaaaattcc

SEQ ID NO: 1035 - DNA, 1996 bp, Homo sapiens
agtctagagacttagaagcatttattaacagtgaggctgctgaaggtttttaataacaaaattacaaatactctatctaattggtaagacgagaccttttgaggtgactataactgaagattgctttacagaagccaaaaaaggtttttgagtcatgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttccccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattgg

SEQ ID NO: 1036 - DNA, 1593 bp, Homo sapiens
atcatccaacaaccacatcccttctctacagaagcctctgagaggaaagttcttcaccatggactggacctggagggtcttctgcttgctggctgtagctccaggagctcactcccaggagcagctggtgcagtctggggctgaggtgaagaggcctggggcctcggtcaaaattacctgcaaggcacctggacacacctttagcagctaccattaccactgggtccgacaggcccctggacaagggcttgagtggctgggaataatcaaccctagaggtggtcaaacaacctacgcacagaagttgcagggccgagtcaccatgaccagtgacacgtccacggccacagtcaacatggagctgagcagcctgagatccgaggacacggccgtctattactgtgtgagcgcggcatattgtagtggtgactgctatcccgggatcttcgatctctggggccgtggcaccctggtcactgtctccgcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagtatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctccccc

SEQ ID NO: 1037 - DNA, 3400 bp, Homo sapiens
ctataattcacactggagagaaaccttacaagtgtaatgaatgtggcaaggtttttaatcgactgtcaacccttgcacgccatcgtaggcttcatactggagagaaaccttatgaatgtgaagaatgtgaaaaagttttcagtcgcaaatcacatcttgaaagacataagaggattcatactggagagaaaccatacaaatgtaaggtttgtgacaaggcttttgcatataattcatacctggcaaaacatagtataattcacactggagagaagccttacaagtgtaatgaatgtggcaaggtttttaatcaacagtcaactcttgcacgccatcatagacttcatactgcagagaaaccatacaaatgtgaagaatgtgacaaagttttcaggtgcaaatcacaccttgaaagacataggaggattcatactggagagaaaccatacaaatgtaaggtttgtgacaaggctttccggagtgattcatgccttacagaacatcagagagttcatactggagagaaaccatacacgtgtaatgaatgtggcaaggtttttagtacaaaagcgaaccttgcatgtcatcataaacttcatactgcagagaaaccgtacaaatgtgaagaatgtgagaaagttttcagtcgcaaatcacacatggaaagacataggaggattcatactggagagaaaccgtacaaatgtaaggtttgtgacaaggctttccggagggattcacacctggcacaacatcagagagttcatactggagagaaaccttacaagtgtaatgagtgtggcaagaccttccgtcagacatcatcgcttataatccatcgtaggcttcatactggagagaaaccttacaagtgtaatgagtgtggcaagaccttcagtcagatgtcatccctcgtataccatcataggcttcatagtggagagaaaccttccaagtgtaatgaatgtggcaaggtttttaatcaacaagcacaccttgcacagcatcagagagttcatactggagagaaaccttacaagtgtaatgagtgtggcaagaccttcagtcagatgtcaaaccttgtataccatcatagacttcatagtggagagaaaccttaaaagtgtaatgagtgtggcaagaccttcagtcagatgtcaaagcttgtataccatcatagacttcatagtggagagaaaccttaaaagtgtaatgagtgtggcaacaccttccatcacaattcaacccttgtaagtcacaaagccattcatactggagagaaactttacaagtgtaatgaatgtggcaaggtttttaatcaaaagacaacccttgcacgtcatcatagaattcatactgcagagaaactttacaaataggaagaatgtgacaaagttttcggttgcaaatcaaaccttgaaacacataagaaaatgcatactgaagagaaaccacacagatgtaaggtttatgacaagatttttgaatataattcatacctggcaaaacatattagaattcaaactggagagaaaccttacaaatgtgatgagtgtggcaacacctttggtcaaaattcacaccttgtaattcaaaaggcaattcgtactggagagaaaccctacaagtgtaatgaatgtggcatagtttttaatcaacagtcacaccttgcaagtcatcatagtcttcatactgcagagaaatcttacaaatgtgaagactgtgacaaagttgtcagtcacaaatcacagcttgaaagacaggagaattcatactggagaaaaaacatacaaatgtaaggtttgtaacaaggcttttgggagtgattcacacctggcacaccatactagaattcacactggagagaaaccttacaagtgcaatgagtgtggcaaagcctttagtgggcagtcaccacttattcaccatcaagcaatccatagtatagggaaacttgactaatataatgattgtcacaaagttttcagtaatgctacaaccatttcaaatcattggagaatccataatgagagatcttacaagtgtaataaatgtgacagatttttcagatatcgttcatatattgctattcatcatcgaactcatgctggagagaaaccttataaatgtcatgattgtggcaaggtcttcagtcaagtttcatcctatgcaaaacataggaggattcatacaggagagaaactcacaagtgtgatgattgtggcaaagcgtttacttcacattcacacctcaatagacatcagagaatccatgctggacagaaatcttataaatgtcatcagtgtggtaaggtcttcagtccgagatcactccttgcagaccatcagacaattccttttggagacagttgtttcaaatgccattagtatagcaagccatcaagcattaattgacattacagttaaatgagcactgacctgagtttgagttgacttaacattgagtttaagcattaattgacattaaactgtttatgttaagaggactgggctgggcactgtggctcacgcctgcaatgccagcactttgagaggccaagactggtaggtcactggaggttaagagtttgagaacagcctggccaacagacgggagccacttttcccagcctgtgttttcatttctattctttctttcttttttcttttttttgtttttgtttttgagatggagtctcttgctctgtcatccaggttggagtgcagtggcatgatcttgactcactacaacctccgcctcccaggttcaagcgatcctcctgcctcagtctcctgactagctgggactacaggtgcgtgccaccacacctggataattttttgtatttttagtagagactgggtttcactgtgttagcctggatggtctcgattttctgatcttatgattcacccacctctacctcccgaagtgctgagattatgggcgtgagccaccgtgactggcctgttttttgtttctttaacaaaaagttatggggatttctatgagtattgtgttgaatctaaatcacattcggttatataatcattgagcaatactaatttttccaatcaatatggattgtatgtgtatttatatgtttttaatcattttgatcaatgtttgtagatttcaaggtacaaacttctcacctttatatgtttattcctaaatatttcttactttaagctctttagcaaatggaagtggtttttaattttattttaaaattatttaatgttaatgtatggaaattcaactaatttttggtgctattattctattctgcaaatacactgaatatgtttattagttccagttgtattttagttgactgtgattttcttcacagatcatgtcatctacaaacaaataaaatttgacttctttctttctg

SEQ ID NO: 1038 - DNA, 1371 bp, Homo sapiens
ctgtgtgtgtcctgggggaccagcagcactgtgacgaggctaaggccgtggatatcccccacatggacatcgaggcgctgaaaaaactcaacaagaataaaaaactggtcaagaagctgggtgagtccggccgctgtggttttgcatgtgagatgtgtggtgggggcggtagaaaggcttttctgccattttcgatttttaaatgatgaggggcctagaatagcaaaggatcggcggtggttgcctagcttgcctgagtgctgttttagctttggggtggtttgatgtttgtattgctatgaggattccagttgatgagggaggccaggcattgtaagttgaccagccaggtgctggtgaactatgatttggaaatctttacgctgcgttgtttaggcagtggcattagactgcttttacaggtaggaagcagacattcccagttgtcacgtgtccagggtccacagctaagaaataggcagaattcgagcccaggcagtcttgaccagagcatccgttgtacagcggttatgccatggatcatgggtcagcctggttttctgagagcatgttttgggaccagtgaaggtccagaggactttctggaaaccgtttgggctagggaaaagactgaggcggggtcttagagagggtgctgcttggaggtcacttacatgattgattcaagtgcgtttctggcctgccacatttgaggtgtgccttggtgaccaggttctaagcaatgccaatggcttcctctctctatcagccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgagtgggtctggcgggttgctatgggtgaaggtgttggcagggtctaaatcttatccaagtctctaaatatgccagtaagagcacccaccaggattgaaacttttggagtaaccctggtcttggcccgggtccaagtacctgctcaccaggccactgggggaggaaggacaggccatctgctattcgtccaccaacctgacttgatcctctcttccctcctcccaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagtt

SEQ ID NO: 1039 - DNA, 3496 bp, Homo sapiens
agttgactgccccacaacgagctcgggcctcacccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtgaggcgccagggagcccggagcgaggggcgggcggacgcgggcagacgcgggagcgctgggagccctgggagcccggctggcgccggccagagaagctgaggacccagagggtgggaccgaggggcggggcccgcagacttgggagggtggagggtacccgttgaggtccaggaggccctgccaacctggagagaggcctcagccagcagaacccttggtggaagttcttgggcctccccggaatggcctggccgtcaaaggagaagtgcagtgcgccttggggatgggcggggtctgcggctgaccccgttgacagctcgcatttagagctgagtgcaatctagaggaccgcctggtgggggcgctgccgagctgaatcaggcccgaaggtggctcttttccgccacagaccccaaggtttgcgtgccatgtgcataggcagcttggacaaacgtaaggacacaggagtcccagaccaggttccagacatgatgttctccttgaacctctgcctcggtgggatgtgtcctcaccatcctcctgtggccctaggtctggagtgtgacctggctcagcacctggccggccagcatctggccaaggcgctggtggtgaaggcgctgaaggcctttgtgcgggacccagcccccaccaagccgctggtcctctccctgcacggctggaccggcaccggcaaatcctatgtcagctccctgctggcgcactacctcttccagggcggcctccgcagcccccgcgtgcaccacttttctcccgtcctccacttcccccaccccagccacatcgagcgctacaaggtaggctggatgcgtccttgaccactgttctcaccatggggtgccaccctagggagtaagtcctgagcccagacaggggagtcacctgctccaggccacacacggctgcagccccagccctcaggacccatcctgcacagaacttgggaaggtgtcattctacctggcagggagtactttgattccttggggcagtaaggaaccctggcagtacctacatgccagggttgttgtgagggacatgagattataccattgcagatatcatttatggagcacctatgtttgtcagataatctgcactgttgtcttgctggaaatcagccccaatttgtggctcagaggaagcatcaggaaatattggctcttactactactgttgttgattgcagggtacccaccaggctgatcagtttcagccgtcaacactgctgtgtagtttcagggagcaggaaggagccttccccttttatagaaagcagcaagtgtcgtggaaggagctctgaacagggaagtgggaggcttgggtttgagtccccgttctgactggctgtgtgactttgggcaagtctctgccccaatctgggatacagtttcaccatcagtctcactaagaggttggtgctctctggaagaccacatccttccctagaaaggagattagttttggtttgggaagaggtctggtgttgggggagtttctccagctcccctggaactcctgtctctcccctacagaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcaggtggggcccggctttgcagtgggcacagtgggggggccacttctcagaggttcagctctacagccttagcctgtgctcccagcagaatccagttccccatgggcttagctgggctttcccagtgccctccgccactctcagagatgacattgtcattccgcctggttgatttccctttggacattctcagcaaattctgggctcagtctttttgatcgccacttctttgtggaagccctgccaggtcaagaagttttccctcttttgtggtgaggaggacacaggcctgggaaaaataggaacagagttcttgtcctttagtcccagctctcagaatcctcgctgtgtttccttaggcagcatggctccgcctctctgagcctctgtctctgcttctgaacagcggggccaataatgatgccccgatgccttcctggaagttcagtgagggaaagtcagttgagggacacaaaagtgttttgtaaactataaagtacgtggcatgtgtaggtgaattacaggggccatggatgtggacaccatggagggggaagtggagcgttttcagtggagttggctcctccccgcactgagccatgttcctatgtcaggtggcagcggggaagcgagggtccaatcctgccctgcgctagtcctcatctgagtctcagcctgggtcccccatggttttagcaacacgggtggcgagcagatcaaccaggtggcattggaggcgtggcgcagccggcgggaccgcgaggagatcctcctgcaggagctggagccggtcatctcccgcgcggtgctggacaacccgcaccatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcaagctgccacttgggcctggttttagatgtttttaattttgtaaaagaaaacaagtataataaactcagctgtgggacc

SEQ ID NO: 1040 - DNA, 3128 bp, Homo sapiens
agtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggatcttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatccc

SEQ ID NO: 1041 - DNA, 3402 bp, Homo sapiens
tagatgtttcaccagcatcataccttagcacatgcctcgcgttcttcccagaaagtcagccctgggaccaggtgggctggtaaagtcctcagtgctgggccctgtgcctgttgcatgagcctgtgtcactgtgactgtggaagttggagctagtgagaggaggaggaggtgggcagaggaaggagggtcccttgggctcgagctccacatcagccctgagctgctggcaagcacccctggcctgcagccagggagagccagagcctttgccaggcagcgagcctccgtgccttccactcctaggtcaggttttgacagcaccactttattactttgtttaagctgttagaaaatttcagaacatcagacacaccctattcaaatgtgagaacaaaaacaccttccagcagtgcctgcttctggaacaggactcctcctgcggaacagggttttgctcaatgactacctccccggtcatgctgctgtccagtgagcagccgggccagagcttgtcggaccgcagtgtgttctctgctagatgcggcagctgtgactcagggggaatgggggctgtatgcctgctcctgacacacctctgcccgttgtgctttgcaggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaaggaaggtgttgcctgctgcttcaactcgtcctcagtggcgcaggccaaatggtttcccttgaatgcacagccatttccggcgtcagcccgggaagactcatgtcagacccgctgtctccaggcctgttgtcagcgctaagtgcaacctgtctattcttggccagcaagttggggcaccacattggatggctctgatttttcccaaaacaaagcccatgccttgctcttaattttttggccttaagagctggaacccaaagacacgtggagcccagagctttcctagccctcggctgaaggaaggctcgcggagtagggcacagtcttgttggaccacagaggcctggggagcatttgacattctcatgctgctgtgaatcgggaatcccttggtgacttctctccagggttgtcatgttaagagagggcctggggcagacttaggatcaggataaagagagtggctgctattgacattgccaagcacccagtgtatcttatttctaatctctttgcccatgagccagagccgcttgcccaagggctcccagccaggggctgtggagttgtcaggtttgtgcctccgaagctgtgtcctgaccactgtggctgccgctcctggaggcctcagacctgctcccctacacacgtgggcagcaggactcccgagggcctctccccagacttcgggagaaggctcacctcgtgggagggagggctcgctcatgcccatctcctttcgttctttgcgggccactcggccaactgacgtcggcctctcctgtctggatgtccagtttctgtggctcactcctcaagccagatcatctgggactgagggtggcctctgggctcctgtagacttccacagccaggatttcacatccctccccagagcctcggaccgaacagccacaagcagccatgagtgtcgtgcctggactaagctggagagacaaaggcgtttgtggcaagggcccagctggaagccctggcaggccagagcatgcatgtgctggcttgcacgagcatactttggtgtttgtgttggggacaccgggcttctgagggactggcgtggctccagggtggggagcagcctggttgaagcgcggccaggcactcactctgttgttcagatcccagctccactgcctgctgtgtccacagtctcctcacctgtcaaatgggaatatctatgtggcgggagggtgctgaggtttccacgagctaatctgcctgctgtgtagtaactagtagcttttcttactgttagtgaacttgttttagtctgaaggaaggcacccatgccccaggtgaagtccagctgagttcagtgaggacgatggagacccttggtcttggcacccttctgccttatactgggaatgcctcaggcttgctcctgctgtgtgtctgtggttgcccactttctgctggtctccgagagactgattcaggtgttcaggagtctgttcgctattacatcacctccttgtgagaaataaagtggagcagcctcatccagacagcaaagcaaggagggagcgtgaggagcagccaggtgagctggtggcatggggccgcctgtgcagaggccggcctcgctgcttcatgtggctcagggaggctcagcacgtccgtcatcacacctcagggcagcgagagtggacctggtgccttcagaagcccacccgaggcctgctgctctggcctgcaaaggtggagtcaccaaagctcattacaaagtgtttgcttatttttgtctgccctgcatttttttatttcttgcaaaggcctcagaggatgtgggccccagcccaaacacatcttgttttcactagtagagcttttcctagtgtctgcacaggggtgcttccagtggctctgccatagccccagacaagctgctgacacggcagccatgaggtctgggacaggttccagggggtgcttttggcctgctccagcaggagtggaggctggactggtctccagcaggagtggaggctggactggtctccagcaggagtggaggctggtctgggctccagcaggagtggaggctggtctgggctccaggagtggaggctggtctgggctccagcaggagtggaggctggtctggggagagagctacacctccccaggcccaggtctcacgaaaggagcatcgaagggcaccgaggaaaaagccacttagccctctcctgtcctgcaccattatctgggcccattggttcttgggtccctgtctttctcaacaggcagccccagttggggaattaagttgattctggactggctatgcctaatgatagctgcaatttgaaacccataaagttcgagttcagcaataaagttggggaggcagtgtcaacaccttccttgtagaacggc

SEQ ID NO: 1042 - DNA, 2015 bp, Homo sapiens
attagtcactcgcgctccaggaaggttgtcaggcagcgctgagcagtaatgtgtcctactcacctgctgtttatccagcaccagacctcttctaagaactttacctgtttcagctcactgaatcctcacaacacccattgtacagaagaggaaactgaggcagcgagtggttaagtgacttctccgaggttacacagctaggaaatggtggcaacagtaagagcccacgaagagctgcggttggtagttcattctggacagccctcccgtgaaccgtccctgtactggcacttgttgctggggactgtcgctgtcctctccctccccgggccaggtgtgtcctggagggcagggaagcgtcttggcacgcgggtgcgcgccgccccctcggcctcctgggctccctgaacctcgcaggaccccggcaacttcgagccccgccccagctccaggccgcgggggcgcatcgcgggcgtcgggcggggcggcccagcgggtaaaagctgcgcggccgcaagctcggcactcacggctctgagggctccgacggcactgacggccatggcgcgttcgaacctcccgctggcgctgggcctggccctggtcgcattctgcctcctggcgctgccacgcgacgcccgggcccggccgcgggagcgcatggtcggagaactccgggacctgtcgcccgacgacccgcaggtgcagaaggcggcgcaggcggccgtggccagctacaacatgggcagcaacagcatctactacttccgagacacgcacatcatcaaggcgcagagccaggtgcggcgggcggggtgctgggaggggacacccggcccagatgggggaggccacaggcgctgccccagcgtgcatgaagggggcctaaaagcgcaatcgggatattttcatgcaatattttaaaaatcgaattaatgctaaaactccacgatggacaaccatctaaatttcaaggaaagacataattaaaccctgtattgcactacctgccttcctggcttgcctggtcctagtctctgccctgatggggtggatcggggaggagggaaggcaggtggggacagtgggcagctccctagatggggcatgtctgatgtctgccaaggctgctggtggggctcagcctccaggcctctccaccctccatccccaccagaacttccccccccccaaccccccccccaccccgtctgaatcatcccctctccctctctccccacctgagtgcctgggggcaacaggagaatatatcaagaggtgaaaagtgaggatcaagggtcaagacccctgacctgcccctaccctatgcccccagctggtggccggcatcaagtacttcctgacgatggagatggggagcacagactgccgcaagaccagggtcactggagaccacgtcgacctcaccacttgccccctggcagcaggggcgcagcaggaggtaacagctgggctcctccagccccagccctccccagagcctcaggcactcaggttgtccatcctgaactggtttggctggacacgtagatgtctagatgtctggctgaacctgtcgtccttctggatgagtcagcctctgggccaagatggggtgcagaaaggaagctggggcttccctcgggaatggggaagttggctaccaagatctggagtctagccccagacatgcggcttgacatccgttgggtcagtgattgtccctctcttggcctggagcggcctggcaggcagagggctggctgttgggaggagacaggtcgaggctgggctcacccctccttctcccccatattccctccacagaagctgcgctgtgactttgaggtccttgtggttccctggcagaactcctctcagctcctaaagcacaactgtgtgcagatgtgataagtccccgagggcgaaggccattgggtttggggccatggtggagggcacttcaggtccgtgggccgtatctgtcacaataaatggccagtgctgcttcttgc

SEQ ID NO: 1043 - DNA, 2394 bp, Homo sapiens
acatcctaaccatggctgtgtttctgcagctgctaccgctgctgctctcgagggcccaagggaaccctggggcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagagccgtacagtgcttcacgtgctgggggacaggacctattgcaaggcccccgggcctacccatgggtccgtgtatccccagctcctgatcccgctgctgggcgctgggttggtgctcggactgggagctttgggcctggtctggtggctgcacaggcgcctgcccccgcaaccgattcgaccactccctagatttgctctgtcccccccacatagctccacttgtgaaaaccgagccccagaggccagtaaaggaggaagagcccaagattccaggggacctggaccaggaaccgagcctgctctatgcggatctggaccatctagccctcagcaggccccgccggctgtccacagcggaccctgctgatgcctccaccatctatgcagttgtagtttgaagggaagcccttactccaaacctcccaagctaggggatcccagctccccataatccctctcccctccttggttcctcacctggaagaggaaggcaccatggtatagaaataagtgctagactgggagttgggagacctgggttccaggctgtctctgccactggtcttacttctaaacttactcccatctctcctataacctccatgtctccctcaccaccagtgtcctctctatacccaatcaagccctagctccttttttttttttttttgagacggagtctcgctctgttgcccaggctggagtgcagtgacaccatctccctcactgcaagctccgcctgccgggttcacaccattctcctgcctcaggctcctgagtagctgggactacaggcgcccgccaccacgcccagctaattttttgtatttttagtagagacggggtttcactgtgttagccaggatggtcttgatctgctaacctcgtgatccacccgccccggcctcccaaagtgctaggattacaggtgtgagccaccgcgcccggcctgattctttaagctgtttttctttgttgctggtgttttctttttggactcctcttccttgctccatatccctacagtatttcccaccattctaggtttgtccctttctcttcttctgggacactctcatcaacagtcagtcctcagccccctcctctgcaaatgacactcagaactctctctggctcagatctcagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaatg

SEQ ID NO: 1044 - DNA, 1487 bp, Homo sapiens
gttttaaaatgggttccaaagcggcgcgctctgtcggcccagcgggcttgcggcaccagaggtggtctgcagccgcgcaaggattcccacggtcgttctgggctggtgcagaagctggtgctcccgcacccagcggccagcaggctcggcgcagcacatctccccaccccacccccacacacccccgtggggtgcgtcgatcctgtagctcagagggagaagctacttagaacttcgtgaagcacagaggatctggagcgagccccgcagctgggatcagtggtcttaagttgaacccgcttacaggaagatgcagcccagctcacagcgaagtgtgggggggccgtctctaaagccgagaagggaaccgctttagaagtgggggtggggggaagaaagaatgaatgaatgaatgaatgaatgaatagaaagaagaaggaatattaaagatcggagaggaagttcaagagagaaaagagttttctctttcctttctgttcctggtgacttgggccctcaatctcgatgaagataacacgaggagtgcacaggcaagtgcccagttgccagcaattgcttcaaaagcccatgttcttcttttcccccattcttaggcacagccaaaattggtcagaaaggggagtaaagtgggacacgagcttcaaagtagggaaaccaaagaagggagcatccacgtcctccctctccagcttctcccccgcgttcttcgggcgaatccgagggacgggcgctgcgctggggaaagtttgtcccacccgcgtttcgcagctggttgcaaggagaggaggaggagagggagggtcaagctcggagcctgtgaccgcacggatgatcgagccggcgtcgcgcttacctcgcagtcctcgtacttgatattatccgtcaatttccaaagcattttcatggatcggcgtgaacggatatgcccctctcggtctcgcacccaagtggagctactctctggctctttaccaacagcctaatcgcctcattagcatatcaacaatagtccaattgctcgccagtaccacaatctgccgccggccgctccgacacagagatgccttctgcaaagcccggcactgctcaaggtccaagcgccacgcctggggcccagcttctagcacttctcccttaaccctgctaccacgatccgagctgcccttttggccccgtgcaattttattagaaatcattatccctttcgcaattaaacataaccaccaaaccaagaccggcgaagtcactccaggattttttcccaacaagggatcgcctccgctcgaggcagccaacccctcgggccgcagcgccttgggagttttattggctttgagctttcccccaggttggagattctgccaagcggctccggtggctctgctggggtttgcaatcccttattgcagcgtgtaaaataaaagttgtaccctgaagaggttacttgacagctccaggggttaaac

SEQ ID NO: 1045 - DNA, 1942 bp, Homo sapiens
gtttatgaatgcttgtctgagtggggccagattctctgtgcaatctgccccaaccccaagctggtcatcacgggtggaacaagcacggttgtgtgtgtgtgggagatgggcacctccaaagaaaaggccaagaccgtcaccctcaaacaggccttactgggccacactgataccgtcacctgcgccacagcatcattagcctatcacataattgtcagtgggtcccgtgatcgaacctgtatcatttgggatttgaacaaactgtcatttctaacccagcttcgagggcatcgagctccagtttctgctctttgtatcaatgaattaacaggggacattgtgtcctgcgctggcatatatatccatgtgtggagcatcaatgggaaccctatcgtgagtgtcaacacgttcacaggtaggagccagcagatcatctgctgctgcatgtcggagatgaacgaatgggacacgcagaacgtcatagtgacaggacactcagatggagtggttcggttttggagaatggaatttttgcaagttcctgaaacaccagctcctgagcccgctgaagtcctagaaatgcaggaagactgtccagaagcacaaatagggcaggaagcccaagacgaggacagcagtgattcagaagcagatgagcagagcatcagccaggaccctaaggacactccaagccaacccagcagcaccagccacaggccccgggcagcctcctgccgcgcaacagccgcctggtgtactgacagtggctctgacgactccagacgctggtccgaccagctcagtctagatgagaaagacggcttcatatttttgaactattcagagggccagaccagagcccatctgcagggcccccttagccacccccaccccaatcccattgaggtgcggaattacagcagattgaaacctgggtaccgatgggaacggcagctggtgttcaggagtaagctgactatgcacacagcctttgatcgaaaggacaatgcacacccagctgaggtcactgccttgggcatctccaaggatcacagtaggatcctcgttggtgacagtcgaggccgagttttcagctggtctgtgagtgaccagccaggccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgaggtggttcctaggagcaacactttcgacctccagttctccctgatgacagtagctgtctccaagagaaaaatcctcacttattaactctcttttcttgcatctcatttttatagagctactcatccttatttggaaaaaccaacaacaaaaaaggcttttagaaaatggttgtaaatctgacttctttgcaagtaactatgtatattgtaaatagatataaaaggccttttttctaaataaggacttaactgcctgtaacatgaaacttcaaactaaaccactaactcaatgaactacttatggtttgtctgacatccctcacttaccaattaattataaatatgtttttttaaatcccc

SEQ ID NO: 1046 - DNA, 1633 bp, Homo sapiens
ccccagatctctgtgcctcgcactctggagcaggcctcggcgctgccccatctgccccaggggatttccagagtgagctcaggcatctgcaccggctgtggaagcgctggctgtcggaagcggctcccagtttcctatccagctgagccaggctgggggaggagtggcggggacgtctgcgcctgcccaagtacaggctgacctcggcggtggtggtggctaggcagggacagctctcagggcacgggcggcttcacagggaaaccaagcctgcccggaacgtcgttttgcctcccaggagacctaggatgggtgtaaggaaaaacacatcttccgggaagtacaaagcgccaccgtgtccacggcccctccttcagcaaatgtatccgggcgcccagctgggagttgtttgtggtccaaaagctactggaaggcagttccagccccagtgcccggctcctgcaggaaagtggtttcagccaagtgggcagtgcaggaggtgggccagagacactgtttggagtgtgaggggaaccttgtgaccagcagaaaaggatggaggaggattccaaacttcaggagctgggccaaggtccaggggctgctgggcacagtcgtccatgtgtgtgctcagtaggatgagttcacttaattagtctgtgcctcagtttccccagctgcacagtgggctcactaacagtaatctacctggagggttgtgtgaggtgaggactcccgtggtgaaggtgtgcagccttcagtgcagtgcccggccatggcaggagcagtgcggggagccatcgtgataatggtgttagggtggcttcaggtaggggcgtggctgccggtccatggcacagacttgggagatggccgaggccctgcctcgtgggctgtcaaggactagatgggaacacgcatatggagcagtggcactgttgttattgttattctgtaggagtggctgtgtctggggtagggggacctcagtgccttgctggccaagggaagtgagggtgggtttccatctgggcatgaactgctgacctctgcccaggggttttcctggcctgccagtgtgtgtgtgtcactgacagtggggtggggggcagctcatggagttggtgcccctcagctgtgctttccctggcgtaggttcctggggctgggagcagggtaaagctgcctcaagtcttggttttctcctctgcctcccccgtgtggccgccaaccctgtgccagcaggtggtgcggggatggcttcctgccccggtctctggcaagaaacccttttccctctcccagtgggtctccccaggttgtcagctccatttagtcataagaagatctggggccaggcgcggtggctcacgcctgtaatcccagcactttgggaggctgaagcaggcagtcacaaggtcaggagatcgggaccatcctggctaatacggtgaaaccccgtctctactaaaaatacaaaaaaattagccaggtgtggtggcatgcacctgtagtcccagctactcaggaggctgaggcaggagaatcgcttgaacccagaaggcagagcttacagtgagccgagatcaccctactgcactccagcctgggcagcagagcgagactccgtctc

SEQ ID NO: 1047 - DNA, 2108 bp, Homo sapiens
ggttttctccccgcttgccggggtggtcctcttccctttgtcggaccaaagaagtaaacactgtgtggagagggactgacgtgtttggagggaaatgggaatgtacacgataattaaagagtaaagttgtgctcaacgctgtttacttctaattatttcctgattcacaaattaatttttgcaattcacaacttcaagaatacttggactattggattcaatccatagtaatctgcaaaagaagagaagcagaattatacctagaagtctactaatggacagttagtcacccacctacatgttgagattcctgacattcagacaactgacttgtaactgacttataactgacttgtaatacactgctactatatcaaaccgacaatgaattggaatgaaaaaccaaagagtgctacattaccaccactgtatcctaaaagccagccaccttttttgcaccagtctttaataaaccaaattaccacaacatctcagagttctttcagctatcctggaagtaaccaagaagcatgcatgtatcccggtaattcaaatccaatttcacagccactgctgaatatccaaaattatcctcaacaaatttctgtttctgatatgcataatgggacagttgtggcctcacacacttcagtagaaagaataacatatgcaaatgttaatggacccaaacaactaactcacaatttgcagatgtcttcaggagttacccaaaatgtatggttgaactcaccaatgaggaatcctgtgcattctcatataggggcaactgtatctcatcaaactgattttggagctaacgtacccaatatgccggcactacagagtcaactgataacatcagatacctattctatgcaaatgcagatgatcccttctaattctacacgacttcctgtagcttaccaaggaaatcagggacttaaccagtctttttcagagcaacaggttgattggacacaacagtgtatatctaagggactgacttacccagattacagaccacctccaaagctataccgttactcaccacaaagctttttaccagattctaccattcaaaaacaaaactttataccacatacatcattgcaagttaaaaatagtcagcttccaaattctgtattaactttaccatcaaggcagacctcagctgtaccatcacagcagtatgccacgcaaactgacaaaagacctcctcctcctccttacaactgtagatatggaagccagcctttgcaaagtactcagcatattactaaacacttgtctatggaagttcctcagagtcgagaaatgctgtcatctgaaataaggaccagctttcaacagcagtggcaaaaccctaatgaaaatgtcagcacaattggaaatttcactaacttgaaagtaaataccaacagcaaacagccttttaacagtcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatacttcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagacccatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccatgtccactgaggaatataaatc

SEQ ID NO: 1048 - DNA, 2687 bp, Homo sapiens
gtcacaccctaaagccacccaaactcagatcgatgccgtctgctgtcgccgttgtgtttcatttattcttcgaactactataggtggtcttcttggagaaaaggctcagcttgctgctgtaaaggatatttgccaggccatctggaagctaaagaaagttatggatgtagccgctagccaacatatgctggtttgtgctttacaagaacttggaaatctcatacacaatcttggcaccacagcggcacctttgctacaggattcaagtacaggtctccttgacagtatcttgtcagttattcttcatcctagcatttctgttcgactagcagcagcttggtgtttacactgcattgccgtggcattaccctcctacctaacaccactcttggatcgttgccttgaacggcttactggacataagtcttcacctgaagcagtgactggcttcagttttgctgtagcagctttgttgggagcagtaaaacattgtcctttaggaattcctcatggaaaaggcaagattattatgacattagcagaggatttgctgtgttctgctgctcaaaacagtcgcctttcagctcagcgcacacaagctggatggttgctgatttctgctctgatgacattaggtcctgcagttgttagccatcaccttgctcgagttctgctgttgtggaagtgtgtctttccagcatctcctaaagatctagaaacagaaaagagccgaggagattcgtttacatggcaggtgaccctggaaggacgagctggtgcactgtgtgctatcaagagctttgtttcccactgtggtgatcttcttactgaggaagtaactcagcgtcttcttccaccacttccttgtgctgtggatttgctaactcagctttcttcaatactaaaaatgtatggaagtcctttgaaaacaccgtcagtggtttatagacaaagactttatgaactgttgattttattacctcctgagacctatgaaggaaacctctgtgctatcctcagagagctggctgctgacttgactgcccctgatattcaggtggcagcatctacatttttacttccacccctctgtcatcaggatgatcttttgatactaagtcctttcctacaagagactgaccatagatttattgaagaacagctcctgcttggtaatggtgttgcttgcggaagtcttgaatatgacccttattcgatttatgagaaagatgtagagggagattcagtgcctaagcccttacctccagcactatcagttgttagttctgcatccaagctctttggggttgtatgcgctcatgtgggagaaactcaaaggcttcttatactggaacagcttttggacagtataaagcacacaaaaggagctcgtcagcaagtggttcagttacatgttgtttcttcagtttctagtttcttgaagtacgtggctggctccaagggatgtttaggtccagaagaaatgaaaagatttgccttaacattagttatgggagccctagaaagccccaaccccttgctgagatgtgcagctgcagagtcatgggctagattagcccaaatggtagatgatggagcttttactgctggattagctcaagttagctttgacaaattgaaatcagcaagggatgtggttaccagaacaggacactcattggccttggggtccctacataggtatttaggaggaataagttcttctcaacacctaaattcttgtattggaatcctttatactttggcgcaggacagcacttctcctgatgtgcagacctgggcattacattctctatcattgatcattgattctgctggcccactctattatgtgcatgtggaacctaccctttctcttattataatgttgttgttaaatgtgcctcctactcatgctgaagttcaccaaagccttggtcgctgtttgaatgcccttattaccacgttaggtccagagctacaaggtaacagtacttcaatttctaccttaaggacttcctgtctactgggttgtgcagtaatgcaagataacccagactgccttgttcaagctcaggccatctcttgccttcagcagcttcatatgtttgctccacgacatgtcaacttgtctagcctggttagctgcctctgtgtgaatctttgtagcccctacttgttactgagaagagcagtactggcttgcttacgtcagcttgtacaaagagaagcagctgaagtttcagaacatgctgttatgcttgctaaggatagcagagaagagttgactccagatgctaacatcagagaagttggccttgagggggcattgttgatcttactagacaaggagacagatgagggattatgccatgatatcaaagagactttaaattatatgcttacatctatggcagtggaaaaactctccctgtggttaaagctttgtaaagatgtacttgctgcatcagctgattttacagctgtaacttgtgtggatacaatgcaagaagaagaaggagataaaggggatgatgcctcagtcctgaccaccagacgtgatgaaaaatcccatccttttaccaatccccgatgggctactagagtctttgctgctgaatgtgtctgtaggataattaaccaatgtgagaatgctaacagtgcacattttgacattgctttagcac

SEQ ID NO: 1049 - DNA, 1939 bp, Homo sapiens
acaacggcgggaggctgcagcggtctgcgcgccgggagcgggggcgcgctggccgcgggtttggaagaggacagttgccctttattctggcggcagatagcagcaggtgaaaaagtgctacacaagtttgatgtttgtgtcttcttctccaaggccaagaaattatctccataggaggcaacagtactatgcatgttatgaattgtgtctccttggtcagtgataaagaaaatgggaatattgccacagcacctggattcatgattgggcagacacctcctccagcacctcctccacctcctcctccaccccctccatctccaccatgttcatgttcaagggaagagtgtccttcctcccctcctccacccccaccaggcctacccccaactactcacatgaacggctacagccaccttggtaagaaaaagcggatgagaagctttttttggaaaactattccggaggagcaagttcgaggcaaaaccaacatctggaccttggcagccaggcaggaacatcactaccaaattgatacaaagaccattgaggagctctttgggcagcaggaagacaccaccaagtcttcccttcctaggagaggaagaactttaaattcatccttcagagaagctcgagaagagattactattttggatgcaaaacggagcatgaacattgggatatttcttaagcaatttaagaagtctcctcggtccattgtagaagatattcatcaaggaaaaagtgagcattatggatcagagaccttgcgagaatttcttaagtttttgccagagtcagaagaggtaaagaagttaaaagcgtttagtggcgacgtgtcgaagctgtctctggcagattcctttctgtatggcttaattcaggtgccaaactattcacttcggattgaagccatggtgctaaagaaggaatttctaccttcttgctcttctctatatacagatataacagttttaagaactgctataaaagaactgatgtcatgtgaagagctacattcaatattacacttggtgctccaggctgggaatatcatgaatgcaggagggtatgccggcaatgcagtaggatttaaactgtcttctttgctcaaattggcagacacaaaagcaaacaaacctgggatgaatctcctgcactttgttgcacaggaagcccaaaagaaagataccattcttctaaacttttcagaaaaattgcatcatgttcagaagactgctagattatctctggagaacacggaggcagaactgcacttgctgtttgtcaggacaaaatcactaaaagaaaacatccagcgggatggtgaactttgtcagcagatggaagattttcttcagtttgccatagaaaagctgagggaactggaatgctggaaacaagagctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttag

SEQ ID NO: 1050 - DNA, 2293 bp, Homo sapiens
gagctactgcaggcggccagcggggagcgccactctctgctgctgctgaccaaccacagggtcctctcgtgcggagacaacagcaggggtcagctgggccgcaggggcgcgcagcgcggggagctgccagaaccaattcaggcattggaaaccctaattgttgatctcgtgagctgcgggaaggagcactccctggctgtgtgccacaaaggaagggtcttcgcatggggagctggttctgaagggcagctggggattggagaattcaaggaaataagtttcacacctaagaaaataatgactctgaatgatataaaaataatacaagtttcctgtggacactaccactccctggcattatcaaaagatagccaagtgttttcgtggggaaagaacagccatgggcagctgggcttggggaaggagttcccctcccaagccagcccgcagagggtgaggtccctggaggggatcccactggctcaggtggctgccggaggggctcacagctttgccctgtctctctgtgggacttcgtttggctggggaagtaacagtgccgggcagctggccctcagtgggcgtaatgtcccagtgcaaagcaacaagcctctctcagtcggtgcactgaagaatctaggtgtggtttatatcagctgtggtgatgcacacactgcggtgcttacccaggacgggaaagtgttcacatttggagacaatcgctctggacagctgggatacagccccactcctgagaagagaggtccacaacttgtggaaagaattgatggcctagtttcgcagatagattgtggaagaaactctaagcatggatttatgactttcttttagacttcgtggatgttcaagtcaaacacatttttgctggaacatatgccaactttgtgacaactcatcagattagacccccccaccaccaccatttcagatttattttttctttatgggtaagtgtgtttgttgaatttgcatcatgtaaatgcacatacacatgtaacttgtgtcaacagcagctgtttccatcttcaggagggaactgaattttccctgtccaggactgtgaaggaagggtttctgacatgtcctggagggaatttcccagtggcacctccttcagtaggaggattgtcatgtgtgtgagtgtgcaggggtgtgtgtagcaggggtggcatgtagcgtctcagctgtcctgtgttgcaagggtcacatcaccgagtccccaactcaagtttattgcttaataaaattaatgatgatagataacagtcatgactaattttaactgcagtcaccaagtgtcaggcagcaatcgaagttcttcaaatggatcaagatgtttaatgctcatatcaactctcgttgattttatttttcacattgacagatgaaaaaacggagtctcagagaggtgaatttatgcaaagttgcactgttagtaagtggtagagctggattcaaatccaggcagtccaacccagtagcttacaccattatccaccatgctatagtgccttcctaattgttaacaggagggattttattattacatttctgggtgagttctgaaatatgtttatggaaacaaaggccttcatagttatttttctaatttgtactttttcctattatgaggaatgttttaaaattgatgtttaaacttgatgtttaaaacattcctgacgacaggaaaaagtacaaattagaaacataatagactctgtctgtagtccctggcacagaatgtggtcagaggcaaaggtttctgtgctgttgggatagttaggagactatactttggttgctctatcatagccattcaatcagccactcaacaaaaattgagaccctttttatatatcaggctctgctcttggtgcctgggacaaaagtgaatagtacagacaaagttaccctcattcatagcatttggactccacaggcagggccggaccataaatatgtaaatgcaaaataaataagattgtattagaggcccggcatggtggctcacgcctgtaatcccagcgctttgggtggccgaggcaggcggatcacttgaggtcgggagttcgagaccagcctggccaatgtggtcaaaccccatctctagtaaaaacacaaaaactagctgggagtggtggtacgagcctgtaatcccggctacttgggaggctgaggcaggagaattgtttgaacccaggagtggaggttgcagtgggctgagatcgtgccatgcactccagcctggcgcacagggcaacactttgtctcc

SEQ ID NO: 1051 - DNA, 2401 bp, Homo sapiens
aagggaaggccccgaggctgcgggcggccagggctgcccgcggattcccagacccggacgcccgagccagcaaccctgaggggcggccgggcagcgccgccaccatgttcctgggcaccggggagccggccttggacacgggagatgacagtctgtctgcagtcacctttgactctgatgtggagacgaaagcaaaaaggaaagctttccacaaacctccacccacatcgccaaagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggttgtggtgcttcaggcagctttcaggggacatctcacgcggacaaagctcttagcaagcaaagcacatggctcagagccacccagcgtgccaggcctcccagaccagagctctcctgtgccccacgttccgagccccatcgcccaggccgcgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctggtaatttcattcatttggattctggcaccagggcagctggtctgctgaggtctcagccaaagagtggccacctccaggaagcccgggcggtgtcgggacggaagggaggagtgtcccatctggagctgcctctgaactaagcgtcgccttatgccaggaaggcccacaacagggccccgccttggcccagcttgtcctttgtgcctggaattgccgaggtccttgctgtctttattttttgctctcagctccaacaggaccgaggtggcttcctccttcaggccagcatttctcctgtttgtttgttgagtaaaaccgtgttattgtt

SEQ ID NO: 1052 - DNA, 2360 bp, Homo sapiens
gttggactgggaatcaaaagaatggtaaggcagggtgtctgccttcactgtgcctgcagtctggctgagatgcacatgtgagccacactagcacaagccagcatgcactggcctgtcacaagagaggtgagatcaattctagggatgcggaggtgggagtgatgacatctgtggggaatggggatgggaggaaagtcagggaagacaccagcaatgaaagactgggaggatttgagaagaaagataggggaggaaggacaagggaaccatatcaacagcagtgttgaaaatctggggacttgcctgggaaatgaagtcatttcactggactgacaatgcatgctgcagtgttggtttcccttcataggtggagccaggcccagcataagcactgaccctgtggatggatgccaggtgaggctggcaggtctgctggcccaggtgttgtctcccgcaggagctgggagcagacgttgtctgaaggtaggggtatattgtagccatgctgaggagccagcatagaagccagtgttggacctagggagctccagcaggaagacactggggagagacattgagaagaggaaatagaaatgcaaggcagggcaaagggggtttgatgatgacggtgatgatgattttttaagagtatgtattgtgaacaaagtaggaaaggacttgtgcttatttacagtggacagactggtgctggggcaagtgggtacatcgtagaagttaggatgaaggagagatggaaatggtgaccagtggagatcagcctcaatggctttcaatacagactaagaagtgtgaccttgatccaggaggctctgggagccacagtgatccttcttgaacacggagtgacatagccagacctaagttttagaaagagggatcttctagctcttggtgggatggattggaggggggagaggctgaaggcaagacaaccttggccttcacagcctaatttaaaaagtaaagagcaaacacttgagtcagaatgcttcagagggggaaaggggggaatttggtgtgagaagcagatgttgaaaggatttggggatggcttggatgttgggtgagcacacaatccttgttttccccaaaatgcctagttgcagcccagtgtctcagcataagtgaatcatggagctgcctttctttaggtcaaaaatggccaaatgtggctatttaatgtggttcaacataaggttaaatgtgcctccttttcatatatgggaagtgtcctggtttggacagtaaatgatttggtccccctagttagacatggtgagatatggcagaacagttttcttcgaagttctgagcttgttgactgggagaatgccctggtagcagaagtgaattgggattgggaggtgggtgatattgacctacctgctcaccaaacttgggaccgactcacatttgactttcaaataattctgttccctctccaaagatgtaacactttcatctctaaggatattggaagcaaagaagctctgaaggtggttcctgtagaagctcttaaaagattgctttcagtggcatgacccatatgggagtgtctaagttctggtggatgtgttcatgagtgaggctccctgcactgtagtcatttctcacatgggtggttagagtaggtggctggccatcccaaggcgcatgggtctcgttcacttaactgtatccattaactgatttctgactctttcctgaaagacagctaggctcacacatgctcatccttattcacaatggggctgggcttaggtgtgtctaagggctcagtgcagacacacccacccatgtgtgcatcccacaaagagtgcccagcagaaccactctcattctgaaccccagcacatgtgcctgcttcatgatttaagcaagtaccaggtatctagtggagaagcagaaatgtcacggtgattaaactttttagttttatgagatcttgcttcagtcccttgaatgcacaggttaactgcacggcttgctgtgtagaggagggaaatgcagggaattacatccacttctatttcatgggtggaattactagctataccaaagcatcagttcctaaggataaataaatggctttgtcaggccaactatgacaatagaagatacttcagtggaaacacatttttctgaaatggttgcactcaagatcgttggtgaggggatactctgtgagaaaggttgtgcagggaatgttgacggatttcggccagttgtggtggctcacacctgtaatcccagcactttgtggggttgaggtcagtggattacttgaggccaggagttcgagaccagcctggccaacatggcaaaaccttgtctctact

SEQ ID NO: 1053 - DNA, 2085 bp, Homo sapiens
agttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttgaaaggaggatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaagg

SEQ ID NO: 1054 - DNA, 1817 bp, Homo sapiens
catcaggccgcctccccctgccctcgcccgccctggagtacactctggggtcccgcctggccaatgggctgggccgtgaggaggccgtggctgagggggcgcgaagggccttgcttggctccatgcctggcttgatgccccctgggctgctggcagctgcagtgtctggcctgggaagccgaggcctgacgctggcacccggcttgagtcctgcccgtcccctcttcggctccgatttcgagaaagagaagcagcagaggaatgcggactgtctggcagaactgaacgaggccatgcgaggccgggcagaggaatggcacgggcgccccaaagcagtgcgggaacagctactggcgctgtccgcctgcgccccgttcaatgtgcgcttcaagaaggatcacgggctggtggggcgagtgttcgccttcgatgctactgcccgtcctccaggatacgagttcgagctgaagctcttcaccgaatacccctgtggttccggcaatgtgtacgccggcgtcctggcagtggctcgccagatgttccacgatgctctgcgggagccgggcaaggcactggcttcttcgggcttcaagtacctcgaatatgaacgccggcatggatcaggagaatggcggcagctgggcgagctgcttaccgacggcgtccgcagcttccgcgagccagctcccgcggaggccctgccccagcagtacccagagccggcccctgcggctctctgtggcccacccccgcgagccccatcccggaacctggcgcccacgccgcgccgtcgcaaggcatcccccgagccggagggcgaggcggctgggaagatgaccaccgaggagcagcagcaacggcactgggtggcacccggcggcccgtactccgctgagacccctggtgtgccctcgcccattgccgccctgaagaatgtggccgaagccctgggccactcacccaaggaccctggcggaggcggggggcctgtgcgtgcagggggcgccagccctgcagcctcctccacggcccagccgccaacccagcatcgccttgtggcccgcaacggcgaagcagaagtcagtcccacagcgggggccgaagctgtcagcgggggtggcagcggcactggggcgacccctggggcccccctgtgctgtaccctgtgcagggagcggctagaagacacccacttcgtccagtgcccctcggtgcccggacacaagttctgctttccctgctcccgggagttcatcaaggcgcagggcccggccggggaggtgtactgcccgagcggagacaagtgcccgctggtcggctcctccgtgccctgggccttcatgcagggcgagatcgccaccatccttgctggagacatcaaagttaagaaagaacgggacccctaggctaccactgcctccaggctactgccctctgcccctttgccacccaccgctgccgcggataaattattccctccccgacccagcccagtgccacctctatctgtgtacatactcccttcttccacccagatgggtcccctggggtagatgcattgtgggtggggggagaaggcttgtggctcctgtccgagggggtgtttggggtcccttggcccctccagtttccctctgtcctccttggcttggctttgctgctgcttgtagttgggggagaggtgcccccctcctccttgagaagggacctcctgaaaactcgctctttataaacgaggcaaaagcatttaattcccacccccccaccccccgctcccttctgctccttcaataaaccgaaagatgggtttttttttc

SEQ ID NO: 1055 - DNA, 2089 bp, Homo sapiens
tacggacagcagggtcgtcctgtgtccaaaagcctcctccccctcagccccttcactcgggtctcatggggcccctctgtggcccccagcgcacaaggcacgcacccactatggggcctttgcacagctgtgccctccccaggctccagccctcacctcccccaggctatttctcagatgtcccttcagaactagagcccttgggcccccagccccattgacacggaacgggccccctgttgtatctcaggtcactgctgtggttgcagccacaggggcaacacctgttactgccacagcgtccgacctggggccagcgtgcattcaaacgcactgctctgagaggccaggacgtccatgggttgggcgcagggggcggcggtgggaaaaggtgtcaggcaccatgggtcccgacctggagcccacgtgccagctgcagagatgggcactgaaggcttttgagcaagaggaggaggtaacgctggcccctggggatgctgtcagggaaactgaggcaatcttgagccctcggagcagagaacgggctgggccaggggctggaggaccctgggccagctccagctgggtcctgctctgttcccacccctgctgcttattaaacccttgtaaagcagcacaggactaaggtagggaaagtactttaggaaatgcccctttttcacattttatcggcaggtgtttcatacaaagaatacaagtaactgatgaatgaagggggcatcttgtgtccccacaatcctgctgtgcgcacaccacaggtgagccgttctgcctaagggaacagccccggcccctccctccggctcctccccagcaccgtctcctccacccagtggcctggccgtggatgctgcctgtggcccagctttgagacaccgccctgacacgtgtccagccttacgtggaaggatttgtctgttttgtggcatcctagtaggtgccacgttagtagatgccatgttagtagaatggatgtgggcatttctttgtaagttcccaaaagcctatgagggttttttccacgattccgttcccagtttggcttttgttgttgttgtggctgttcttggcccccctgggccctgcagtggagtggggggctgcacctgggagcctcgagctgaggcccagcccctcctgccctgcattttcctgccaagcagcacctgagactctgaagccgatgcctatacaggcagaaacctgccaattccagcttgaacgactggagggtcctgaggatgggggtccctggggtgccatcatgggcagggtgcatctgtttgggtatgctgccccccagctggcggggcaccggggacaggcacagccacactgggggcatttctggtcttggaagccttcttggctcttccggagggaaggcggctgctgggtgccctgtgatccacccgcgagctgggctgttcggcttggtctgcaggggctggggggctgcatttcttttcaccagctgcacccacccggccccatcctggctggcaccgaagggagcagcgcgccgtgacatcctcccctcaagcctggtgaatggtggttccatgaggctggagtcagtgggtgcctgttgtgacagctggatttcagtgttggtacaggagcacacacctaaggggcgggccagtgaatgagtgtgcgagggtgggctagagaacgagcaagggaatgagagagagtgggttagagagtgagtgagccagtgaatgagtgagtgagcaggagtgggttagagagcgagggagtgagtgaatgagtgggctaaagagggccgggcgcggtggctcacgcctgtaatcccagcactttgggaggccgaggagggcagatgatctgaggtcagcagttcgggagcagcctggtcaacatggtgaaaccctgcctctactaaaaatacaaaaacaaaattagccaggcgtggtggcgggcgcctgtactcccagctactcagaaggctgaggcgggagaatggtgtgaacctgggaggtggagcttgcagtgagccgagatcgtgccactgcacttcagcctgggagacagagcgagtctc

SEQ ID NO: 1056 - DNA, 1953 bp, Homo sapiens
acaaagccctgcagatctgctgcttttcctgattctcctgtcctgagtgagtgcaaggggctcccctgtcgtcgatgtgttctttgaagcagatgctgtgcctgatacctgctggagagtcccaccgccttgagtgagtcaacaaacctatcatccttcccatcttccaggatggatattggggtggggggaggttaaagggaataccataaagttgctaccatacggttagggctgaatacaatgggagtacttattgtgatgatgtcaatgatgatgacagtgatgatgatgatgatgatgatatctagaactccaggttttcctggagagaaccaaggaggattccccacttacctaataaataagtgtcctgtaaatgcagaacatgccatgtaattgatgacacaagcgggatctcacttctgggggatgagaatcaattctttatggattcccacagggcagagggacccgggtggagatactaagctgtctgttgtatttccgaacgaatgagtacgtacgtaacagttatcgtgtctccttgtaactcgtgtgctaatcataaaatcttcacaaggattcatgacattcgtgctatgactattctcattttacagtgaggaaggcgggacacctaggaattaagtaacttgccaacatagggacgagctcaccacacaacaaccaagggtggggataccagtcaggtactgcggaaaacactggaaggaggagagactgatcacctgcataatcactgctgaaaggtcatgtaaggtggagacagaaaagtgtacgtggatttggcaaaaaaaaggatttgctggggaagagggggtgaaactctgaattgagtgaggagagaaaggggaaagaaattgaagacagaacagacactgctttctagaaataaagctatagctggagggggaaatgaggtcaagagagatttccttatttgttaagatgggaaaaataatagcccatccgtgtacttgttgatagaaataatttggtagaaagagaaaaattgatgatgcaagagagaatgagaaggaatttggtggggtagaaagaaggctagaacctactgctcaaagagagggtttggctatggtgagggagaatctatctacatgacaggacattgaccaggcacggaggtatgctcttgtagttttcatactttgtaataaaagaaacatcaattttaaaaactcaacaacaaatagaacatgaaaatagtctgtctacttaaaaccttaaaacattacagatgaaactaaagtctcctttggtgatgttgtgggattttatttattttgatgtctgagaactattccattgtatggatataccataggttgttcatccattcacctgttgagggaaatttgttttgttttccacattggctgtgacaaacacaactgctgtaaacatttgtgtacatgtttttgtatggatgtaagtttttcttttgtctaaagtaaatagttaatttactgctgggtgatatggtaactgtatgcttacccttataagaaactgtcaaactttctccaaagtgaccatacaatccattttgcatttccgccagcaatgtatgcatgagagaccagttgatcctcatcctttcccctgctggtattgtcagtatttttagtttagctgctctaacatgtgagtcatggtgtctcctcatagctttaatttgcatgtccctaatgactaatgatgctgagcatctttccgtgtgctcattcttttctccacttcttaatcggattctttgttttcttactgttgagtttagagccacctttatacattctaggtacaaccttttagatcaaatatgtaatttgcaaatattttcccccagtctatatctggtcttttcatcctctttaacaatatattttgcagaataaaagtattttgatg

SEQ ID NO: 1057 - DNA, 2608 bp, Homo sapiens
atgtcagactgctgctcagcgccaggcatcagctgggaagctggcgtgggcaggccagctgtacctggcctggagctccagattagaagaggagccatgtcagaagaaacagtaagtgaatcacagttttccttgaagacagcagcgctaagagtgtttgatcttcctctgacttggtactattctctctcccagatcaaattttctccggtggctaaaaagttgtttgtggtaactgcagtgagtgctatatctgtaatttttctggctcatcactttaaaagaaaacgtggaaagaagaaaggaaaaatattaccatgggaaccagagcacctcatacttgaatacactaaaagagcagcatcagacaaaggttcaagttgttccagtagcagacagaatttgacattatctttaagttctaccaaagacaaaggatctcaagtttgtaactatgctaatggaggacttttcagtaaatattcaggttctgcacagagtttggcctctgtccagagtgtcaattcttgtcatagctgcgcttgtggcaattctaattcctgggacaaagcagatgaagatgatattaaacttgttaatattcctgtgactactccagagaacttatacttaatgggtatggaattgtttgaagaggcattgcgtcgatgggaacaagctctgacctttcgcaatagacaggctgaagatgaagcctgtggttccattaaactgggtgcaggagatgccattgctgaagaaaatgtagatgatattattagtactgaatttatccataaactcgaagctctgctgcaaagagcctatcgtctccaagaggagtttgaagctacccttggggcatctgatcctaattcccttgctgatgatattgataaagatacagatatcaccatgaagggtaatgtggaagactttggcctgcgagacaccttgagcatcgcatccacggattcctttgcttccgcagcagagcttgcagaacacagagaagtacggcatacctacagcctggagtccctttgtcactgcccattttacgaggaagccatgcatttagttgaagaaggaaaaatttactccagagtactgagaactgaaatgttggagtgcctaggagacagtgattttcttgccaaacttcactgtattcgacaggcttttcaggtaattctttcagaatcagctaacaggatattcctcgctgagagcggaaggaaaattttatcagctttaattgtgaaagcacgaaagaatccaaagaagtttgaagatgtttttgatgaaatgatctattttttagagcagaccgatcactggggtagtactgaaatggaacttgctgctagaggggtgaaaaatctaaatttttatgatgttgttctggattttatattaatggactcctttgaagatttggaaaacccacccacatccatacagaatgtagtaaataatcgatggctaaactcatccttcaaagaaacagctgtggcttcaagttgttggtcggtgctgaaacagaaaagacaacagatgaagatcccagatggattttttgcccatttttatgccatttgtgaacacatcagtcctgtcctagcctggggctttttgggtcctagaaattctctgtatgatttatgttgcttttttaagaatcaagttcttttatttctcaaagacatttttgactttgagaaggtgcgctattcaagtacagagactttagctgaagacctcatgcagttactcattcgccgcactgagcttttaatggcctatcttgaagcagatgccctgaggcatacaagtagttgtctaagcagtcatggtcatgttatgtccactgggctactggaagccaaagtacaataagtaccataagaatcatacaatttgagtgtgctatgaaatattttaaggtaactattgattttgtaacatatattacaaagttaacagaattgatgcatgtggattcagggaggaaaaaaaaatctactaaaaaatgagcaactgtactgtatttatacagaagttctgtcattgaattcctgtgtagtgtagtcatagtggctttttgcattcattaggtaataattgaagtcatgaaatgtatattttacagaaatatcgcttgaattgaagccaatatttgggagttaattggtttgtcttcttgaagctgtcattctcaaaagctctgtttttatgctttgcacctttaaaatgtacactttagccaaggtctttgtggcccacacatgcaagaatatattacttctaatgtcaatatatttaactttgcctagaaacatatttttaattataaagttattcatttgtttaatcaagtttaggcagtaatgatgtttaatatgtactgcatacattattgcttgtgcatttgcttatgtatttgaatcaaagaaattgtaatcactgaatattgttatagaacatttaaatgggccacttgcagtggctcatgcctgtaatacattgggaggctgaggcaggaggacagtttgaggccaggaggttgagactagcctggacaacataaggagatgcctgtctctac

SEQ ID NO: 1058 - DNA, 1806 bp, Homo sapiens
agtcggcccctcagaccctggagcgatggaggaccccggccccggcgcggtccagcggtgggagcgggcgccgcccacctgtcggatccctgggccatgacccctgggacggcgagtgagctgcgccgggaacccccgggacggagagagcagcctccaacccccaaggctcacattgcttcacggagtagcggcccggggaaggagcacgcgagcggttccccggggttgcatctcacacccgggagggagggacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgg

SEQ ID NO: 1059 - DNA, 2032 bp, Homo sapiens
gaaacgggcctgaactcttacagaagctcttgtggccctaggatgaatttagaggtctccatacccagcctggaaggtgaagaacgacccctaacgacccaccctcccaacctaatgccggttctgctccacttgtccactctggggagctgtgctttggcttggaagctctcggattgaaggatgggcccaagaccctcacaggtgaagcctcggtaggtcccagggagaagaaagattcctccaccccaccacccctctaagtccgacccacctttctccccgccagctgcatcagatccctccagggcctcattgtcagtcctgtaatcttttcatccgtgataggatgggccgtgggcccttgtgggtgaagctcggcggttcccgagtccatgtggggtggcccctgcggagcctggagccttcttgcccgctggcttgctgatcccgccgagccagctcccttcctgcttttgacggtgagggaaccagctgggaggtcctccgagctggacggggaggcgggcggcctctcccactccccacccgctccctccctgccgccgccgcctccggctgctcttgcgacaagccaagaaaatggggcgcctgctgggagcccagcgccgtcctcccgtttcctgtgatctaccaatcctcctctccgcggaggctcggccgggcgcacctgaggccggcagcatccccggggcttggcggcagctgcaacctccacagacggccgccaggtggcgccgcgccggggtccgggagctggcgggcccggggcggggttggagggactcagctacgcgcctggggaggccgcgggccctcgcagactaccgaacttccattctgccgccgggttttcacacctgccggccccgaggaaacaatgacgttgggattttggggggccgccccttgactcgggcgaatgggacacgaacggcgaccccttgctctcttccatccgcctgccgccgttgctgcccaccgactcctacagctcatttctcgctcctgcagcctccaggaatgcaaataatttctcactgggttttggcgggggcgcggagctgcggagaagcgcgcgcccaacagctttcgccgcagctgggtccccgggcgctggcggctgcggcccccagatacaggcggaggctgcaatatgcacatgcggccacagtgtggcgccaggggcccgccgcgggacacgctcggagcgcgacgccccatcccatcatttacggatcaaaccaaataatctagaatcaagttgctgtgtgtgtcatactcctcctgttttttttccctaaacttttagtagagtcatttacatagttcagtttttacctcagctatgttacacagtggcaggaaaatattttgtctccaaactacagcccaagtatgagagcagcgtatcctgaagctaattagtaaccagaaaatcaggaaggtaaagcaaatctctggaggcaagatctggactctatggtatcgccgcttctccccacttgaagcgtctctttgcagtgccgcacttggagatttggacttaatcgttaaacaaacagaacagttacattctgccttcctacagggcaggggcctaggactggcagcatttttgttgtctctagaaatagaggggttatgagagagcctcaaaagagagggcaagaataacacatccatttctcatcatgagttacccccttgtatgcctagaacgcgtatggagacattctcttttagtaaagtcaaagagaaaagccatgaactaagtatcctgaacacagaggcgtgagccctctcagtctcacagtcccttaggagtcatttgtaagtactatttccttccttattgtctatactattccctcttgtctccctgaaatctacccactcctggctgtgtgtgtgtctctttctgtctgtttctctgtcttaatcttctgtacatatgcacccactcacctttttaccttgttctgagaaataaaatactatttttcaaact

SEQ ID NO: 1060 - DNA, 2766 bp, Homo sapiens
tgtatttttagtagagatgaggtttcactatgttggccaggctggtctcgaactgctgacctcaagtgatccacctacctctgcctcccaaagtgctgggattacaggcataagataccacctcacctgcccggcctgtttggcagtgtttttaagagcagatgtagttcatatacattcttttttgtttgttttgtttttgagatggaatctcactttgtcatccaggctgtagtgcagtggcacagtcttggctctctgcagcttcaacctcctgggcccaggcaatccccctgccctagcctcccaagtagctgaggctacaggcacacaccaccatacccagcaaatttgtgtgtgtgtaaacaaggtcttactatgttgcccagggtggtcttgaactcctggtctcaagtaatcctcctgccttggacttccaaagtacagagattacaggcatgagccaccatgcctggcctcatgtacacttttttttttttttgagacagagtcttgctctgttgccccggctggagtgcagtggtgcgatctcggctcgctgcaagctccgcctcccggattcacgccattctcctgcctcagcctcccgagtagctgggactacaggtgcccgccaccacgcctggctaattttttgtatgtttggtagagatggggtttcactgtgttggccaggatggtctcgatctcctgacctcatgatctgcccgccttggcctcccaaagtgctgggaattacaggtgtgagccaccgcgctgggccgaaatatttttaagtgtctacctctctgtactcacaggcagtgtgataggtgcttggtaatcaaaagtggttagcacatgctaccttccctcaagtgagaccatctgactttccctatagttaagatagagacatactatttaaaataaatgtaataagcattaagaggtagggctaaacttttagggagaaaaggtacacgttgtataattataggtgccaacttattaaattttagctaatttttagacataaggtactgtgaaacccctttccaaagttattacctaagatatgcaaatatctaagatggtacttggagatcacatgatcataatctttggtataattggaggcaaaaacaacaaagtggcagtggggcatgaacggcagcccagtccattgtctgcacaagagaaaaaggataataaagaataaagttaggggcacagaatagacccagttcttactatttgaaataggagtggggggaagggttcaagagtcctaaggacagtataaggacaggaagtgggcaactgtagaagcagcagatcatcagcgggcagggattcctcctggcacttgtttctatcccgctagtgtcttcagactgaagcatggccaggcttccatgccttgtctgactctaggcctacttctgcagaggagtcacagagccaggtcgtcatctgggaaaacactttgtgtgtgtgtgtgagacggagtctcactctgttgcctaggctggagtgcagtggcgtgatgtcagctcactgcaacctccgcctcccgggttcaggtgattctcctgccccagcctcccgagtatctgggaatacaggtgtgcaccaccatgcccggctaattttttgtatttttggtagagacagggtttcaccatgctggccaggctggtctcgaactcctgacctcgtaattcaccggcctcagcctcccaaagtgctggtattacaggtgtgagccaccgcgcctggcccacacttttttaatttgagacactcttatcacccaggctgttttttctggaccaggatgggccccttgaaacaagtgggtcagggagagaagtaaaggggtaaaatgtagaccaggagaaatggagtgatagacactggaggaaaggggaaagtcaaaaagaatctgtgaaaaggaagaattcacaaataggaaaatatccaagattgactcttccaattgcctggggcttctattactctaataatatattgtattaacaagcgtcttctgtgtgttcaaagtacttttcagtgtgtctcacagcagttgcagagaccaaagaaaggagccaagtgaaattagcttgatttcacagatatgaaaagtaagcaacttgacaaggttctttagaaaggaaggaatggagccaacagtagggagcccaggttctgagtaaagagctgcttgttatcaaaagcctggagtgacaccactgaaggctagtctgccgtggcttctctgtacgccgcccccctcctcccaccctccactccctggcagtggaccaggtaatcttaacctctcttacctaatacagaactctttctcttctgtagattctttgtgggaaagagattcctcgctggatcaatcgacttgcctacttcagctcctgtataccctttctacagagttgcctcccgaaggagtggctcacgcccgcagccctgcagtctagtgtcagccaagaactccaggatgaactggaggaagcagaggatgctgccgcatccgcttccgtggcaagcactgcagcaggctccagacccgggcgccacactaaactataaatgtctccaaagtcacacattcagaactgtctctggcagtcgaatatcactagagaaaagtaaacagagaagcatcctttagatattttgtatgcaaagatggctctcccccaaatcccagtttttcagctcaggattatatttgtaatc

SEQ ID NO: 1061 - DNA, 2135 bp, Homo sapiens
aaaaagcaggcttcaggatttgaagtttgagcccatccctgaggtagagccggaatttacctttgtacttcacacggtcagggttggtggtgactacgtgggtctggagctgactgccgtcctgacacgtcctagagctgcaagcaggtcctgccagagagccaccatgacctctcagcctctcaggctagcagaagagtatggcccaagtcctggggagtctgaactggctgtgaacccctttgatgggcttcccttctcttcccgctactatgagctgctgaagcagcgccaagccttgcccatctgggctgctcgctttaccttcttggagcagttggagagtagccccactggagtggtgctggtgtctggggagcctggttctggcaagagcacccagatccctcagtggtgtgcagagtttgcgctggccagagggttccagaaaggacaggttactgttactcagccctaccctcttgcagcccggagcctggctctgcgggttgctgatgagatggacctgaccctgggtcgtgaggttggatacagcatcccccaggaggactgcacggggcccaacaccctgctcaggttctgctgggacaggctgcttctgcaggaggtggcctcgacccgaggcactggagcctggggcgtgctggtactagatgaggctcaggagcggtcggtggcatcagattcactccaggggctactgcaagatgccaggctggaaaaacttccgggggacctcagagtggttgtggttactgacccagcccttgaacctaagctccgagctttctggggcaatcctcctattgtgcatatacccagagagcctggtgagagaccttcccccatctactgggacaccatcccacctgatcgggtggaagctgcctgccaagcagtgcttgaattgtgtcggaaggagcttccaggagatgtgctagtgttcctgcccagtgaggaggaaatttccctgtgctgtgaatccttgtccagggaggtagagtccttgcttctccaagggcttccaccacgagtactgccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtgagtgagagagagatagcggtggggtagtaaagacagaaatggcccactctgatctgtcttggccttggttgggggacgggcaacaggtttacaatcctaggatccgagcagaattccaagtgttgaggccaatcagcaagtgtcaggcagaggcaagacgattgcgagcaagagggttcccaccaggtaagagcctttgccctcactgaaataaaaaacccaagagtcaccaacatgcaagccctgagaaatctacagtggtcttctttcccaggtctttttcccctcaggatcctgcctctgcctgtatcctaagtccttcttagaactagaagctccaccattgccacaacccagggtgtgtgaggagaatctgagctccctggtgttactactaaaaaggagacagattgcagagccaggggagtgtcacttcctggaccagcctgctccagaagtactgatgcaagccctggaagatttagactatctggcagccctggatgatgatggggacctgtcagatctgggtgtcatactatcagaattccctctggcccctgagctggccaaagccctgctggcctcatgcgagtttgactgtgtggacgagatgctcaccctggctgccatgctcacagctgcccctgggtttacccgtcctccactcagtgcagaagaagctgccctgcgtcgggccctggaacacacggatggtgaccacagttctctgatccaggtgtatgaagcctttatacaaagtggagcagatgaggcttggtgccaggctcgaggtctgaattgggcagcattgtgccaagcccataaacttcggggagaactcctagaactcatgcaacgaattgaacttcccttgtccctaccagcctttggctctgagcagaatcgcagagaccttcag

SEQ ID NO: 1062 - DNA, 1386 bp, Homo sapiens
atttttgtatctttagtagagatgggatttcaccgcattagccaggatggtctcgatctcctgacctcatgatccgcccaccttggcctcccaaagtgctgggattacaggggtgagccaccacaccgggctgggattcttttttctctgttttctttttttttttttttttgagacagggtctcaccctgtcgtccaggctgcagtgcactggtgtgatcatagctcactgcagcctcaacctcctgggctgaagccatcctcccgcctcagcctcgcaaatagctgggaccacaggtgcatgccaccatgccccgctgatttttgtattttttttgtagagacagggttttgccatgttgtcgaggctggtctcaaattcctaggctcaagcgatcctcctgcctcggcctcccaaggtgctgggatgacaggtgtgagccccgtgcctggcctggtcatttctcttgctgtgcccaacctgccattaatcccatccatcctgagcccgacgtggtcatttctctcaccacccagcctaccgcccgacgtggtcctttccctcaccacccagcctaccgcccgacgtggtcctttccctcactacccagcctaccgcccgacgtggtcctttccctcaccacccagcctaccgcccgacgtggtcctttccctcaccacccagcctaccgcccgacgtggtcctttccctcaccacccagcctaccgcccgacgtggtcctttccctcaccacccagcctaccgcccgacgtggtcctttccctcaccacccagcctaccgcccgacgtggtcctttccctcaccacccagcctaccgcccgacgtggtcctttccctcaccacccagcctaccgcccgacgtggtcctttccctcaccacccagcctaccgttaatctcatccagtgcttttgtcacctcgtgttgtaattcaattttttttattttttatgagatgggggtctcactatgtggtccaggctggtcttgaactcctgggctcaagcgatcctcctgcctcagcctcccaaagtgctgcgatgacacgcgtgagccaccaagcccagccaacatgttataattctctagaggcttgcttggggtcccctttacgtcttccatgtctctactaaacttttgcagattgggattcagttgtaagaactgctgagtgcccatgtctgctggttctgatatcagggtcggtttcaggaggctgcttttcctccttgtttggggtcctattatgctgccttcctgtgggcctggtactctcgggttgatgcctgaggcattgcgaattttaccatgttgcgtgctgggtgttttagcatttttataaatcatcttaatctttgttctgg

SEQ ID NO: 1063 - DNA, 2230 bp, Homo sapiens
ccttgtaattcataaatctctgaaaacttaaaagtttgagcaaaagtttgtcatgtttctatgagtaatttataataaaacttgatcagaatttgtgagactagcgtttgtctttatattttcctttttttttttttttttttgagacacagtctcgctctgtcgtccaggctggagtgccgtggcgtaatctcggctcactgcaacctctgcctcctggattcaaacaattcttctgcctcagcctcctgagtagctgggattacaggaccagtgatggtatagaacactgtattagagacatggagctggggctggatgaagattccatcagtaattcaatcaacagacaagtgttatccaatcacgtctttaaatcaatcactgacatggagctggggctggatgaagattccatcagtaattcaatcaacagacaagtgttatccaatcacgtctttaaatcaatcactgatcccagcccctataaaagggagcagccttaggaggcacatcagataaacccagtgtggaaagctagtcacacatcagctcagtgttcggcccgggattacccagtcaaccaaggagcttgcagttttaaagaatccaccaactgttgaaacaaatccctagagacacaaggcaagagactgaatcatcaaagtaaagtctctctgagaattattgctaagaatggctttagatctaagaaccatatttcagtgtgaaccatccgagaataatcttggatcagaaaattcagcgtttcaacaaagccaaggacctgctgttcagagagaagaagggatttctgagttctcaagaatggtgctcaattcatttcaagacagcaataattcatatgcaaggcaggaattgcaaagactttataggatctttcactcatggctgcaaccagaaaagcacagcaaggatgaaattatttctctattagtcctggagcagtttatgattggtggccactgcaatgacaaagccagtgtgaaagagaaatggaaatcaagtggcaaaaacttggagagattcatagaagacctgactgatgacagcataaatccacctgccttagtccacgtccacatgcagggacaggaagctctcttttctgaggatatgcccttaagagatgtcattgttcatctcacaaaacaagtgaatgcccaaaccacaagagaagcaaacatggggacaccctcccagacttcccaagatacttccttagaaacaggacaaggatatgaagatgaacaagatggctggaacagttcttcgaaaactactcgagtaaatgaaaatattactaatcaaggcaatcaaatagtttccctaatcatcatccaggaagagaacggtcctaggcctgaagagggaggtgtttcttctgacaacccatacaactcaaaaagagcagagctagtcactgctagatctcaggaagggtccataaatggaatcactttccaaggtgtccctatggtgatgggagcagggtgtatctctcaaccagagcagtcctcccctgagtctgcccttacccaccagagcaatgagggaaattccacatgtgaggtacatcagaaaggatcccatggagtccaaaaatcatacaaatgtgaagaatgccccaaggtctttaagtatctctgtcacttattagctcaccagagaagacacaggaatgagaggccatttgtttgtcccgagtgtcaaaaaggcttcttccagatatcagacctacgggtgcatcagataattcacacaggaaagaagcctttcacatgcagcatgtgtaaaaagtccttcagccacaaaaccaacctgcggtctcatgagagaatccacacaggagaaaagccttatacatgtcccttttgtaagacaagctaccgccagtcatccacataccaccgccatatgaggactcatgagaaaattaccctgccaagtgttccctccacaccagaagcttcctaagctgctggtctgataatgtgtataaatatgtatgcaagtatgtatattcctatagtatttatctacttaggatataagatataatctcctgattatgctttcaatttattgtcttgcttcattaaaatgtaaggctaaggagagcatggaatttgtcagttttgttcactaaagtattccaagtggttgggaaagtggaacatttccaagaaccaataaatttctgttgaat

SEQ ID NO: 1064 - DNA, 2183 bp, Homo sapiens
aaaaatgatggctatgtggacatgagcagctccaacacctctaagaacaatcagcagagcacagaccaggacgcagaaagacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccacagcagcagcagccccagcagcagccacagcagcagcagccccagcagcagcagctccaccagcagccccagtagcagctctagcagcagcagcagcagcagccccagcagcagcaactccagtagcagctccagcagcagcagccccagcagtagctccagcagcagcagcagcagccccagtagcagctccagcagccccagtagcagctccagcagcagcagcagcagccccagtagcagctccagcagccccagtagcagctctagcagcagcagctccagcagcagcagtcccagcagcagcagccccagtagcagcggcagcagccccagtagcagcaacagcagccccagtagtagcagcagcagccccagtagcagcagcagcagccccagcccccgtagcagcagccccagcagcagcagctccagcaccagcagtcccagcaccagcagtcccagcagcagcagtcccagcagcagcagccccagcagcagctgccccagtgcagccctgggcaggaggccacagagcccacagagctcgcactgtgccccctttccctgaagctgcggcctctgccccccatcagcctggcctcttgggaattctcccacagggagaggccccatgggtattctcccacaatctgcagcctccaccaggccttgagtagctttgggtgcagagccaggagggcgtttggctgtcctaggtctagcccctggcccaatcccagccccattccaggcccactcaaaagccaaggcccaatcccaggtccaggctcaatcctaggccctggcctgattccaagccaggcttactcccaggcccaggcttagtcctagccccaatcccaggtcctggcccaatcccaaacttaggatccctcccagccccagccctagtccccttgtgacctcagagcacttatgcctccaatttcttgccagacagtcattccctgacttcacagagctcctcccacccctagaccagttcgaggaatccttggtctccaccacgacatcccagtaccaagagggggatggctctatggacaaaaagactcgggccccaagtgattaatggatttatagggggcctgtgtctgcaaagtcctgcggataccagtggacctggagtggctggttggtctacactgctggtgaatgcaccaccaccatttaaccaccctgccgctggtgggcatttgctgtcttcactgtgtggccatcacgactagctctgctatgaatgcacctgccctcatttgagttgagcctgagcatttcgcagctgggattggagtcgctgctcatggggatgtttggcattagtggatgctacttgagagctttgtaaagagctttactcagcacttctgatagtcagcattctccctgacacttaggattgtgagactttttaatgtttgtggatccaatggcttatggcttccctgatgactgagaggttgagaagttctcacatgttaattgaaccttagaaatcctcatatgtgtccatttgtttgcccatttttcttcatttatttgaatgtatttttatattctcttgataattaaagtgctgcaaacacccccc

SEQ ID NO: 1065 - DNA, 1983 bp, Homo sapiens
ggcggaagatggcggccggcgaaaggagctggtgcctgtgcaagttgttgagtttcgagtatgtctttatcagcagcgtgaaaatgaacttggtaccataaattagtaccagtagagtggggtgctgctgaagagatacccaaaaatgtggaagcgactttggaactgggcaacaggcagaggctggaacagtttggagggctcagaagaagccaggaaaatgtgggaaagtttggaacatcctagagacttgttgaatggctttgaacaaaatgcggatagtgatatggacaacgaaatccaggctgaggtggtctcagatggagatgaagaacttgttgggaactggagaaaggtgactcctcttatgttttagcaaaggtactagaggcattttgcccctgccctagagatttgtggaactttgaacttgaaagagatgatttagggtatctggtgtaagaaatttctaagcagcaaagaattcaagaagtgacttgggtgctcttaaaagcattccattttaaaagcggaacagagcataaaagttcagaaaatttgcagcctgacaatgcagtagaaaagaaagacccatttttttaggagaaattcaagctggctgcagaaattttcaaaagtagcaaggagcctaatgttaatcctgaagaccatgggggaaaatgtctccaggcaatgtcggagaccttcatggcagcctctctcatggcaggcctggaggcccaggaggaaaaagtggttttgtgggccaggtgcaggggccctgtgctgtgtgcagcctagggacttggtaccctgtgtcccagctgctccagccgtggctgaaaggggccaatgcagagctagtgctgtggcttcagagggtgaaagccccaagccatggtagcttcacatggtgttgagcctgcgggtgcacagaagtcaagaatggaaatttgggaacctctacctagattgcagaagatgtatagaaacgcctggatgcccaggcaaaagtttgccaccggggcagggccctcatggagaacctctgccagggcagtgcagaagggaaatgtggggttggagcccccacacagagtccctactggggcactgcctagtggagctgcgagaagagggccaccgtcctccataccccagagtggtagatccactgacagcttgcaccgtgtgcctggaaaaacctcagacactcaacgccggcccatgaaagcagccaggagggaggctgtaccctgcaaatctacaggggcagagctgctcaagaccatgggaacccacctcttgcttaagcatgacctggatgtgagacctggagtcaaaggaggtcattttggagctttaaaaatttgactgccccactggattttggacttgcatgggccctgtaacccccttgttttggccaatttctcccatttggaacagctgtacttacccaatacctgtactcccattgtatctgggaagtaactagcttacttttgattttacaggctcataggcagaagggacttgccttgtctcggatgagactttggactgtggacatatgggttaatgctgaaatgagttaagactttgggggactgttgggaaggcataattggttttgaaatgtgatgacgtaagatttggaggggccagggcagaatgatatggtttggccatgtccccacccaaatctcagtttgaattgtgtctcccagaattcccatgtgttgtggaagggacccaggggaaggtaattgaatcatgggggccggtctttcccatgctattctcataataatgaataagtctcatgagatctgatgggtttatcaggggtttccgcttttgctgcttcctcgtttttctcttgcccactgccctgtaagaagtgccttacacctcctgccgtgattctgaggtctccccagccatatggaactgtaagtccaattaaatctctttttgttc

SEQ ID NO: 1066 - DNA, 2243 bp, Homo sapiens
tttgacaccgggcttacatccaaatacagatttaccccagaagagaatgaaacaatgttcagaacccctgaaaactgtgttcaaggaagtcagctggatttttttgagacaggggtcttgctcttgttgcccaggctggaatgcaatggtgcagtcttcgctcactacagcctctaccgctcctgctcaagtagtccttccgcctcagccccctgagtagctgggactacaggcacacgccaccatgccaggctaatttttgtattttttgtagagactgtgtttcaccgtgttgcccaggctggtcttgaactcttggactcaagcaatccacctgcctcagcctcccaaagtgctcacaggcatgaggcaacgtgcccagcctcatttgatacttttaaaatacatttttaatatttttttcctccaagatgccttccccattgtgtaagtttcaggtcttacaaacctggatccaccccagcagtctgagttgcatatatacatacctcctattacatgtccctcctcccactattatgtcacctttctaaacaccgcaattgggagatgagacaatgcgcaggaacgaagaactgttctggtgaagaggacccaggggcagtgagagggggctagggacaaaaggtgaatggggagctggttcaggttagaagaatgggtgcatgtgaggggcatttggagaatgcgagctgggggagggagagtggctgagcctgtaggcacagtagacacatgtagtaatgacggggatgtgttatgccccacaccaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacgaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatttcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgagataagaaaaaaac

SEQ ID NO: 1067 - DNA, 2309 bp, Homo sapiens
cgcagacgggaagctgctcagcaccggcttcagcaggatgagtgagcggcaactcgcgctctgggacccggtaggccaggccgcgccgtgcgcgctagctcgctccttctctgggtctgccgggagcgccttcccgggctgtggctggcgcccaagaggccagagcggagcggggagctcccattcgggaaaagcctcgctgcgactccggggagccagcagacacccctgctctagggatcggcctttgagcgcgcttaagggttcgggatcggctgagagccgcgtgcctcctgctctctccaggcccggatgctctccaggtcaggggccagacgtggccccgcaggaagctgagtgcttaggccccatttgtctcttccccgcatccgctcctccaccccggacacccaagtcagcaagctggttgctcatccctccatgctcctcagggcaggcagctgggtgatgtccctccctgtctccccctccccccaggagaggtttgcggcccacgaggggatgaggcccatgcgggccgtcttcacgcgccagggccatatcttcaccacgggcttcacccgcatgagccagcgagagctgggcctgtgggacccggtaacgcagctggaggcttgggttttgctgcgtcgcgtgaaggatcctgcgctggcgcccccacctggtgatgccgagtccctgggggtggtttgctgtgactgcatgcggcgcgcagcggaacaacttcgaggagccagtggcactgcaggagatggacacaagcaacggggtcctattgcccttttacgatcccgactccagcatcgtctacctgtgtggcaagggcgacagcagcattcggtactttgagattaccgacgagccgcctttcgtgcactacctgaacacgttcagcagcaaagagccgcagcggggcatgggtttcatgcccaaaaggggactggatgtcagcaagtgtgagatcgcccggttctacaagctacacgaaagaaagtgtgaacctatcatcatgactgtgccccgcaagtcagacctcttccaggacgccgaacccgtgctcatttcgctgagggacggctatgtgccccccaagcaccgcgagctccgggtcacgaagcgcaacatcctggacgtgcgcccgccctccggcccccgccgcagccagtcggccagcgacgcccccttgtcgcagcacaccctggagacgctgctggaagagatcaaggccctccgcgagcgggtgcaggcccaggagcagcgcatcacggctctggagaacatgctgtgcgagctggtggacggcacggactagccccgcgcgccaggcaggcggagcggggcggggcgcacaagctcggccccgccccggcttttagtcccgaactccggaccccgccttcttgggctgggcccgggggcgggactggggagggaactccgcccctcgcgggagaccagaactcttggagcttaggggagacccacgtcgctccagcggaggctggactgcgagcctcgtctgggactcggctggagctggcctagggaggcctggggtaacctggggggctcagcaatggtgctgcacggcgaggtggtgtccccctttgtcctccgcccagggcagggaaagtgcttagtattagcgtgatgcttggggttattggagcctgagcttgacctcaaacgggtggcgatttgatgggtacccccaggctggggaaaatgacagcgcttctcctaatcagctcactggattccatcaccctgagcggtaaaccagatgggcgtcaccccagttctgcagacacatacacaacccgtttgctgcagagccggacccagtggctacacccacagcggtctgtggtagagaactctcttccttctttccaccgacaggggcgagggctgcttcctcgcggcagcccccgcgaagaaatctcgagagaactggcatgaggagttaggttcatcacaaatacacacacactgcccccaaccctctgccgttgcctctctcagaaaaacaagacgtactgaatgaaatattttactaagcgttcagtctgtgcctcctgcatgggtgggagtgaggggaacgagacccccagcctctgcaaatgctacccccaggctcctgggagacctggcgatgcactcctgggctcagggtccatcaggcagcctcttaccctagagctctctccactctgaggttcagaaggaccccaacccacaccgtaggcgttccccccaagtaaagttaggtagcaaaagcctccggt

SEQ ID NO: 1068 - DNA, 3029 bp, Homo sapiens
cgtagctcataatccatttttataacaccttgctatctatatttacacctttaaagaacacgggaatttaagagggaagagtaactaggcttttgctaaacttgggctaataaaaccctctgtagagagatccttaatataggcatggggacaacaaggagtatcccaagggactcgccgctagggtgtcttttaagctattggagcaaattcaaatttggcttaaagaaaaagaaactcattttgtattgcaacaccatttgggttaaatacaagttagatgacgaatatatctggcctaaacatggttctatatactatagtgatattttacgattaggcttattttgtaaaagagaaggaaaatgggaagagatcccttatgtacaggcttttatggctctatactggatcacgttacttccaggcattagaatgccatgcataagggatccccacctagctgctccccatagaaagttcataagcctccccagagtctcttcagtcccccagtcctgagtgggggttctcgccaattccctaatgagattccaccccaatgtcatcaggcacctttcccccttatccaactagccctagcctataccctctgctgcccaagaaaatgagcccaaccagtacaccaggagtggggctccatatcagcccctaaggtcaagcctgtgtccactgtggaaagtagttgatggaaatgagggaacactcaaagagtacatatgccactttccatgtctaattagaccttataaaaggaaagaattggccagttttcagataaaccagaaaagcttatacaagagtttgttacgttgactatgttcttcaaattgccacgatttacaaatattgtcatccgcttgctgtgctgtggggaaaaaaaagtagaggaaaaagtgtgtggttaagccagtcaattatgacaaggttaaagaagtaactcggggaaaagatgaaaatcccgctctgtttcagggtcttttagttgaagcactcaggaaatatactaatgcaggcccagacaccccagaagggcaagctctcctgggtatacattttctcattcaatcttctcctgacattaggaggaatctacaaaaagcagcaatgggaccttcaagtcctatgaaacgacgcttaaacatagcctttaaagtttacaacaacagggacagggcaaaagaggggagtaaaaagaaatagccaaaaagtacaattgttaacagtgactttaagcctcctgagtagctgggactacaggcatgcaccaccaagcttggctaatttaaaaaaaaaattatatagatagggacttgctatgttgcctaggctgatcttgaactcctaacctcaagcaatcctcccacctcggccttccaaagtgctgggattatagccatggagccgccacacccagccaatgtgccgaagaaagaaagaaaaacatgctcatcctttgagtcaggttcaaattttttctcctctttaacccccagtcactccagttataagtgatttttaactcttctcacactttaatgcatctggcaagaagatccacgtggtgttaggaacaatacaggaccttaaggatgggggaatcagcaggtgtcagcgtgccctgtatgctcagggcagctgtttccactggacattctcccttcgcctctctgggcagcaactcctaggccagccgacctgctgtgtcgagtaaccaggatttctcaatcttggcatggttgccattttggaccagatcgttctttgttgtgggggctgccctgtacggcaaagaatgccgagcagcacttccagtctccacccacaggacgccagtagcaccctctaagttgtgagaactcaaaatgtccccagaggatgccagatgtcccctggggtggggacacaatcaccccaggttgagatccatggagccaggtctgtttgccaccaaggggtaaagctccattcccaccttaggagggctaggaggcagcatcgtggggccacagaaggcctgggtttgcagtcagaggacaggatgcacattccttcaagatacagacccagattgttgggcatctagttcttgggttttctgttgttgctgttccgttttgtctgtcttccctcctttgtttactagcagcctggaatttgccactttttctaaacgaagatttatggaacacttaccacacggctgacgctgcgcgaggctaaggttctaatacaccgcagctcacttaactctcgcaataccataaacgcacactgtttcatcttgaccctttcttgggaaggtgacagagaggtaggagggcaaacatcttgtgtgccccgtcccaagggtattactggtggaataatatccgccccccaccccagtttctaatttgctgtaggctgtgacgctgtggggcaagactaggagtcctgttgaaattaggaataagtgtgctgtgagggaagggctgccttattttagagcacagattttctgaatatctattttgacaggttcgatcctctccccttcctgccttccttctgtcgattttcaatgtcttgatggtgtcccacctgagtggcctttagagatgtgagttgtgaggcactggggaggcaggcacacgtcctccagcccaagactgcctaatttaacagggatttctgcattctggaactagcctccattttccccaagcaggattactccagagggcaaaacacagcccaatagtatcacatttcctttctgctttagcaaaaataaccactgtctcattcatgggaaaaggccgccaaacaaatttgttactggaaccatttgtaacaacttctagtttgcactgccttggagcaagcacactttgtagaggagggatttgcagttacttgggcaacaaggtaaccactgatcattacaggaagcttcagaaaccgtgggaccagtgtagaagaatggagtatctgtccaaactaagaataaaaagaatgacacttgt

SEQ ID NO: 1069 - DNA, 2532 bp, Homo sapiens
aattcaagctgcagcctttgctgatgacggtcaggaggccaactgcgcctggggagcagcgggatccggggatggggctgccctgtgtgctcacctgcctgacctgccccaggcctcctcctgtcccaccctgcctaatgctctagagtccccctgggctggcctcaggattgcaagcagtgcgagggcctggtctcggccctggtctcagccctatccagatgtccgaggcagatggaccacccgctgagcgtcagaaatggggtgagtgagtaagtgagctcagggatggggagggacagatgggtggaggagtggaagatggaggatggggagggacagatgagtggaggagtggcagatggaggaggatggctggagggacagatgctgggtgattgttgggggtgcaggtgcgggacgggtcggggacaggtggaaggaaaacagcacacagatgcggacagatggccagaaagattaatagttcagtggcagagacctaggcctggcggctgtcgtccccccactcacggatgcgcgcggtccagcactgctcccccagctgggtgcagttctccacctgcaggcagtcctcgttgctcacctgggctttgcaggagtagcacagcagggcagtgcctgtggggtggagtgggaggggcctcagaggctgccccatagcactccccaggaatgggggctcccaggcaggtgggcctccatggcggtggcctgaggaagtcctcggcgccctcttgtcaccctcaatgtctcctccccatcttcacggccccctgctcagtgcctccgaaatgttgccctgtttagtccctcggtggctgcttttgtgaccgtgtgtttcagaagaggaagctgcggctgtgggggtgactgaacccgggaccctgggtcgggagggtcccacctcaagcagagcagctccctgggacccttggaagctgcagtgctgggactgggccggatgtagacccccgggtcctcgcaggacacccccagcacctcccccttgtgccccaaaaaccacttcttagcctgaggcttcctgtcccatgtctcccagctcctcatcagcatctctgcccatccatccgtcagtctgtctacctgccccctaggagccaggccctgccccacggtggtgaaggagagtgactccgtgctgcccctgcaagccccggtcacaggggacggcagggaacaggtcgctgcctggtcgtgccaagagcttccctggaggagcggaggctagggcaagagcctcacccccttcctctcccttcctccttccttcccctcctctccgtgtgccctgcaggtatccctctggcctccccggctcacccctgctcccttccctgctgggggccagccaaggcctcacctggctgcagggccaagcctgccatcaacagggcaagcagcacagccttcgtggtcactggtgggctgtggtggagagggcctcaggtgactttatatggcctcaaatggggagaggctggactgcccacagtcaacaccagcgggtttcctggagccagtgagggccccggggctgggcaggtccgagtctcctccctgagcgacctgcacctccctctccctttgtccttctttccacctctggaggacagagcctacccagggccatatctcagccaccccgggctgagggctgaaacgtcctcaagacccagattatgcctctcccacctcccccacctcacagtgcaaggccagacaagggagaccctttctccagactcctccaggcctcggccttccagccaaggatgagggcacctccctgggccctgtgctcctatagaagctgtgccgccctctggggcccacggcccgcagggtgatgagccttggtcacagcgtcactgacagatcattagcaggtgctgcaaaggacaggggcaggggctgttccggtataaaccaaaagtaacattctaaggccccccagccatctgagtggaaccctcctcttggcaagggctttccgaagttaacctgaaaaactggttcaggccatgacagcaaagggttggatagcctcattatccctcctcccttcagaactctggaacagccagcgttaacatcaacacaggccttcagtctgatgagaaacatttaccatctattgtctcggaagcctgctacctggaggcttcatctgatgataaagccttggtctccacaaccccgtataacccagacattcctttctattgataactcttgcaagcgattgccaaccagaagatgtttaaatccacctataacctggaagcccccagttccagctgcccacctttctggactaaaccaatgtatatcttcaatatatttgattgatgtctcatgtctccctaaaatgggtaccatcaagctgtgcactgaccaccttgggcacatgttctcagggtctcctgggggctgtgtcacaggccatggtccctcatatttggctcagaataaatgtcttcaaatatt

SEQ ID NO: 1070 - DNA, 1905 bp, Homo sapiens
caggtgccccggctcggggtcatgcttgtcggctggggcgggaacaacggctccacactcaccgccgcggtgctggccaatcgactgcgtttgtcctggcccacgcgcagcggccgcaaggaggccaactactacggctcgctgactcaggcgggcaccgtgagcctgggcctggacgccgagggccaggaggtgttcgtacccttcagcgcggtgctgcccatggtggcgcccaacgacctcgtgttcgatggtgggcggagccctgggccggggtggggcgggatgggagatggggtctggaggggcccaggatccgggcagggccgagtgtgagggtccccccaggctgggacatctcgtcgctgaacctggccgaggcgatgcggcgcgcgaaggtgctggactgggggctgcaggagcaactgtggccgcacatggaggccctgcggccccggccttctgtttacatccccgaattcatcgcggccaaccagagcgcgcgcgcggacaacctcatcccaggctcgcgtgcgcagcaggtgctgtcccatcccgcatcccttgcttcctgccacctgttcttcgccacttggttccctctttttgccccaccccgcgaatccaggcctcacttgacacccggggaactgagtagcccaggcctctgtgagtccgagagtatgtacaaccaacttccctacaccctctccatcctccccacaccctcaccatccaacccacagctggagcagatccgcagggacatccgagacttccggtctagcgcggggctggacaaagtcatagtgctgtggacggcgaacacggagcgcttctgtgaggtgattccaggcctcaacgacacagccgagaacctgctgcgcaccattgagctcggtctggaggtgtcgccctccacgctcttcgccgtggccagcatcctggagggctgtgccttcctcaatgggtctccgcagaacaccctggtgcccggagctcttgagctcgcgtggcagcaccgggtttttgtgggcggagatgacttcaagtcaggccagaccaaagtcaagtccgtgcttgtggacttcctcattggctccggcctcaagaccatgtccatcgtgagttacaaccacctgggcaacaacgatggggagaacctatcggcgccattgcagttccgctctaaggaggtgtccaagagcaacgtggtggacgacatggtgcagagcaacccagtgctctatacgcccggcgatgagcctgaccactgcgtggtcatcaagtatgtgccgtacgtgggtgacagcaagcgcgcgctggatgagtatacctcggagctgatgctgggcggaaccaacacactggtgctgcacaacacgtgtgaggactcgctgctggccgcacccatcatgctggacctagcgctgctgaccgagctgtgccagcgcgtgagcttctgcactgacatggaccccgagccgcagaccttccaccccgtgctgtccctgctcagcttcctcttcaaggcgccactagtgccgcccggcagcccggtggtcaatgcgcttttccgccagcgcagctgcatcgagaacatcctcagggcctgcgtggggctcccgccacagaaccacatgctcctggaacacaaaatggagcgcccagggcccagcctcaagcgagttggacccgtggctgccacctaccctatgttgaacaagaaaggaccggtacccgctgccaccaatggctgcaccggtgatgccaatgggcatctgcaagaggagcccccaatgcccaccacctgaggccccggtcacacagtttctcggctcttcctccccgctgccccccacgaccctaccttgaaggcccccacaaataaaggcgctgccactc

SEQ ID NO: 1071 - DNA, 1661 bp, Homo sapiens
aaccaggggcggtgcggcctggtccggggaggagaacatgcctgccgccggaccgcctttgctgctgctcggtacaccaggatctggaaaaacagcgctgctatttgctgcggccctagaggcggcgggggagggccaaggcccagtcctcttcctgacacgaaggcctcttcaaagcatgccccgcgggaccggaacgactctagacccaatgcgactccagaagatccgcttccagtacccaccctcaacccgagagcttttccggctcctgtgctctgcccatgaggccccggggccagccccctcccttctgctgctcgacggcctagaagagtacctagcggaagacccagagccccaggaagccgcctgcctcattgccttacttctagacacagctgcccacttcagccaccggcttgggcctggccgggattgtgggctcatggtggccctccagacccaggaggaagcaggtagtggggacgtcctgcacctggcactgctccagcggtattttcctgcccagtgctggctgcagccagatgcaccaggtccaggagagcacggcctccgagcctgcctggagccaggcgggctgggccccagaacagagtggtgggtgactttccgatcagatggagaaatgatgatcgctccgtggcccacccaggctggtgaccccagctcaggcaagggttcaagctctggaggccagccctgagctttggtgggtgactacctctctgtgcttcagtttcccatggctggaatacttacctcagggacatatgcagatccaaagacctaaacaatgtaaagtgctttttctcttttaaaagtatagcattatcttgtatatattttacccaatcaatatgttgtttatagtttcattgctttaaactttataaaaagagcttcaggccaggcgtggtggctcacgcctgtaatcccagcactttgggaggctgaggcggtcagatcaccagaggtcaggagttggagaccagcctgcccaacatgatgaaaccctgtatcaactaaaagtacaaaaaaaattagctgggtgtggtggcaggtgcctgtagtctcagctactcaggaggcttaggcaggagaattgcttgaacccaggaagcggaggttgcagtgagccgagattgtgccactacactccagcctgggtgacaaagcgagactccatctcaaaaaaaaaaaaaaaaaaagtttgagacttccttctttttgcactcaacgttgttactaagattcatctacatttttttagttcattcctttttccatattgcatataattccatgggtgactataccctgatttcttcatcagattgccttatttactgctgcgaacattcttgcacacatgccctggtacgtgtgtgtgtttttaggggccgagacaggtggatcacctgaggtcaggagttcgaggtcagcccggcctacatggtgaaaccccgtctctactaaaaatacaaaatttagccaggcatggtggcatgcacttgtactcccagctacttgggaggctgagacaggagaattgcttgaacccgggaggcagaggttgcagtgagctgagatcgagccactgcactccagcctgggtgatgaagacgagactctgtctc

SEQ ID NO: 1072 - DNA, 2693 bp, Homo sapiens
agataggcccaggggttcactgccgctctgtctgcaaacctgaaaatagtaagcaacttgaacatccaccaagagggggctgtttcaactgcctctctgtccccgcaggtgctggacagacagtggctcccggcacaggctttgctctactgtgggctcagtggtctctgccctgcacagcagtgaccagtgccttgtcgtccccctcaccagaatgaacactcccttactctcgcttctgtctccactggggcttggcacaggatctggcatgctagagtcaccagaaaagtaacaagaggcagagcatggtggaggcaccacaggcgcctctgggaggaggtccccagggctccctggccgggacaggcaccagcagtccttacttgcagcttcaaggacaagggcttctggttcaaaagccgttgatactgaatcagccagtaattttcctgcctggtttcacttttggcttctaactccgtctgccaggaatgaagcaggcaatgttagtcacaaaatggtaataaaacctgtaataacaatgatggattacaggcgtgagccactgcacccagcctgaatgtgattcttttattctgccattcgataactcttcgttgagtactgttctaggtgctgggaatacagcagtgaacaaacaatgctgataacagccacggtgacaacaggcgtagctgacatgttcacagtgccatgtgccagaccatgctgtgcacctaacgatgccatcattaattctcacaactccgggaaggagattctacctcccaggtgagggagctgaggttcagggtgatgagtaacctgcccagggtggggccaggaattggacccaggcctgtcttgctccagagcccgtgctcagaacaacggagctgttcagtgagggctggcatgacatggggagtgggatcaacacaggcgtttctcaatccctgctgggcctgactgccctttgcgggcccctcctggacctggccacgcccactgctcccttccgtcgttggccctcccgggctgcagcccctctcttccagcgcccaggagccggatgggctgtgttctgctggggcggtgcttcctcctttggtggtgacccccaaggcctacaagggcaggggcaccagccatagtacctggctgctaaggcacagcgccaaggcaccatctgcaaagtaacctgatgcgtaggagatggcagtagggcaccgtgaggaacaggcagcttcctctgatgggcacaggcaccacttggcttgttcagggctccagaagcagctggtctctctcttctaaacctgcacaggacccggcctaggacgcagctcagagggcatctggtgcattcacggggacacaggaacgactcggtcttttccaccccagatggtgagcctggcctctgtcctcattgcttgggtgccctctgggtctagaggagacactctcaagggggcctctgccacgctgaaaatgtgccagtgtcaaacccatcaggggacagggacagctgggccactcctgccaaaagcttatcaaacggcctgccctggacatagtgagtcctgtctggagtgaatactcatggctgttcccgaatactcgactacaaaggcattcggagagcattgcctagaaaagtttaaaaaccagaagtaatccacatactcaacaataggggccacggacagccttgagaaaggacgtcaaggaatagtttaatgacttgaaaagaatgtgcggaaacaggctgctcgaaaagggtatgcagcatgccacgtttaaaaggcgcatacacgaacagctataaaggtgcatcacaatgtttggaaaatatgcatcaaaaccgcaggagaggctaggcgcggtggctcatgcctgtaaaaccagcactttcggaggccaaggcagacagatcgtttgagcccgggagttggagaccagcctgggcaacatagcgaaaccccatctctacaaaaaataaaaaaatttgccaggcatggtggcacatgcctgtagtcccagctactcgggaagctgaggtgggaggatcgcttgagcccaggaagtcaaggctgcagtgagctgagattgcgccactgcactccagcctgggcgacagagtgagaccctgtctcaaacaaacaaataaaaaatggcaggagataacgcttggaaatgcaattattttcctttgtactttccagtttttctttgatgaataactcttacttgaataacaggtgtttctaaaaatggcaagtctgttaaagaaaagcaaatgcctgtgtgatgctgagcacagaagccaaacacataccaggatttcccggagctcttcctctcgctgctgcttctctttgagcagctgctggagcagggagctgagggcccagcgctgctccgagatcatctcctgcgaacaagaccacaccccgcaccaccgtgagctggcggcagcgcaggagtcccgcagtggcaggatggagaagggcctggcctcccgctcactcggttctctgcccaatgcctccaggctgcgttgggggacaaagctaagaggcccttctgcccccttaccctaagcccgcatctctcttccttgtggggttaagtcaggcatgggatcctggtgactgatgacaatgggatggtaagaaatatcaccc

SEQ ID NO: 1073 - DNA, 2017 bp, Homo sapiens
agactcaggaggcgtctctccgagggtgtgggctgtgatggggccctgtgcacccatccaggctgcccagaccaggagagcacaggtcagccggacacatgatgggggcacgctagaaacgcagaaggggacgcagcagccacattccagtccacaaagacgccgcgcaggcccgtccatctgccccgtgaatgccaaccaggcagagacacacatacagctgaggctgggccggatcccagagcaaacccttgggtgcctctggagggagcccgccaagagggatggctcataaacactggggaaggaacagaaggggagggagcaaaggaactcggccgctcacctccgacccaaccacttcccgagaagccatctctgtggtcatggtggtcccaggcctggctctccctgcgcccacccccaccacccagtcactccacccagtcaccccacccagctgtgacctgccacttccctccatctcacatgctttcccctcacctccctcaggaagcctccccagcctctggcctccagtcccaacaagccatgctccttccagagggaacctctgccaggggagcctccactttcttgctcctgcctccctacctggcacccaggccggccctggtaccctggtactgaataaaggcacacgtctaaatgatgtcggggggaatctgcccagtgttggcactggagcgaacacgacccactgccagcatggcccacgagccacacccccccaagccagcacctcctccccagaggaagcacggggctcgacggggcacgcccctgaatgggaggtcacacatggtgagggctcccttgttcccagaggtctagctgtctccctgctaagatgcagagctcactatgggcctcgcagggggttaagccgagtcatttcatcttcacagcagctgtaggtcccgctgacatagctgacacatagagagctaaagtgacctgtgcaaggtcacaggctaggagtagcagcacggggcccagcacgaggaacagccttagcatcccccgcctccccaaccctgcagcctgccctgactccaatcccaggggaattcctgagctgcaggcaaaggctgaagcaggagctgacaagccctgctgagcccagagaggtctgggcggtcccaggagggcgtctccctagggctttgatgagttggtggccgcccaggcacctctgcctgcctgcccagcatggcaggtgtgtgggctggagcttctgcccagccctgccccacagccacaattaggggacgagtgcagataaagcacgggggccagttacatctgaatttcagataaacaatgaattgttattttagtacagtatgaaagtatttggccccaaagaactggaagcaggaaaaggaacagctcctcatacacccatgctcacagcattattcaccagagccggaaggtagaaacgatgtctctccacagtcgaatagattgtttccacaaactgtctgtaggtgcatacaatggaataggattaatccgtgaaaaggaagaaattctgacacatgctccggcgtggaggaaccttgaggacgacgctgagtgaaagaagccagacacgaaaggacagatacggcaagactcgacttatgtgaggtccctagaggagtcggattcatagagactgaaaggatggcgggcaccaggggcggtggagaggggaaatggggagttactgtttaatggggacagagtttcagttttacaagatgaaaagggtcctggagctggatgggggtgacggccgcacaacagcatgaatggactgaacgccactgaaaactgaactcttgaaaatggttaaactggcaaattttgttatgcatattttgccacaaaaagcaaacaactcttctccccaaaaatatctggggtgtacttacactaaatatgtagggcatatttactctcaacatttatttccttatttgaaattaaagtatttgggacacactgc

SEQ ID NO: 1074 - DNA, 2198 bp, Homo sapiens
tcagttgaagaagcgaccgagggactgggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaagtttcatcgtctgtaaaacgggctgacggccaaatcagaggacacagcagggcacctgggaggtacacgcagatgagcattctcaaggcgtgttactgggaacccggcctggccttccatggacaaagccatttgatgggtaggaggggccctgtttgaggcacagtgggtctgtccccctcttcccctgcctggttgctggcgctcaggaaacactacaggtcacatgcttattgggctttttgtcccaagcaggtggctccccctgtgcccatgtcctccacacagcctggtggtcatgtcggaggccctcatgagcatccatcactgtcactgttacctcctcactcagctgggtggcccagggtggtctggaactgcagcaccgcccaggcaactgctgtgcgccaggcagggctgagctcaggtcatggcttcacttctcccgtcctcactcactgtccgtccatagacatgggctcctcagcattcccttagatctgaagtctacatcccccgtcccaaacacgggctggggcatgcactgtatagaaaacttaattggccagcaggtgacattaattaaatgcttagctgagtgccaggtgaggctctccatgctgtaaacactcaccttatgtaacccttcagtgagccgctgaggtgggtaaccactgttaggctgttttacagatgaagaaactgaggccaggagaggtcatagtgctcacttaggccacagagtgacagagatgggctttgagccctggcagtctggctatacaacgcagtaaggttcacacccacccagggtggcagttaccaccctctgccacatagtgcctccatcagagggtcccctttgtgggcctcagtttacctacctgtgaaatgggaggaagatacccccagccccacgggcagatgctcagcccactttccccgacgcaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccggtgagcccccacagcgccccggcacgcacggtgccagggcgccagggttccccaccgtcctcctcacgcacagggaccacgcgctctccacctgcgccagccctgcctactgagcccgcctctctctgccccttgcagtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctcgtgagtcacctgggaggggagggaagggaccactcgggaacctgcggggcggtccggctttggggccagtaggtccccaggaaggcccctgatcagagtctcccgccttcggcctcaccgtagtggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgc

SEQ ID NO: 1075 - DNA, 2026 bp, Homo sapiens
gagaaagagtccctccctgaggtcttccttcaccaggcccgagaagctaagctgcagctcgtagctgctaccaggtttcaggggctcactgagctccagcaccatgtattccgtgtccagcgcgaaccacacgtcgtccacgggcacgcggcccactgtggcgttcccagtgcccggggaaaggggtccccgcacctcggcgcgctcgcagtcctggaagaggctatgcagcagcagtcgagaggtggccaccgtgcagcgcaccgtgatgttcacgcggccagtgaagggcaaagacccggccggaagctcgtcgggcctcagctgcggccacagctccagatcgtagtgcagcggcacgagccagggcggcaggcgtagctggtcccagggccccgggggtcgccagttgctcggggtggtcgtcaccgctagctcgcgtgcactgctgggtttcggggtcggcgtcggcttctgcctgaggggaggggaagactcggcttccgagtccctgagtccaggcagctccgacggtgggacgcgctcgcagtggccgtacaaggcggcgagtacggccagcgccagcaggagggcggctaccaacccagccagcagcagggccactgcgcggctcacatagaagcctgagctggaagggggccccatggcagggaccgggttcaggcgcgaggctggagctcagagactgtggcagctgtcaaaaccccggccagggtgttcagtgctgggacccctgcccctcctctcttgtatcgtgcctcttcctcctggaagagcctggacggactggagctcagcagacagcggttgggaccatggcttccccctcccagctaatcagacacaggtcccagcctacccacccccgcccccggccagcgccagggaagaggcggacctggctcacccagacgcgtacccctttgggttcgaagagacagaccccacggaagatgcctccagggttggcgcggggagggggtggtcaagccaaacgaatccggacaccttaaacgtggatatttggatgaggggtgtgccccgatacggtttcaggtgttgtcggaaaggggacaggtaccaagcacctctatctccaagccagcgatgagctaccagcaacacacctgctccaccgccagctggggcttcgtgtgctagggggtggtaagggcttgaggaccaggatatttgggaatgcgttcagaaatgaccctgcagggcgtcggccgcgccgtcagaacaaatttctggagccaaatgtgtggcgctaacttcgcttcctaaataagcccaggaggcatgcggcccaggcagcgaaggcgaagatggaaacaacgtccggaggcccggaacttttccagagctcaggaagccaggctggaggaagaggcgacaaagtgctagggagcctggcgtctgcgtctcccgggtgaaatggggttgtggggcagagcagggttaggaccgcgttaccacaagaaggggcctggcgggatggtttttcttagctctgcaactgcctggggccggggtttcccttcctgaagccgggggagaggggacacctgctttcagaaccgactcgaatcaagcaaagagaataaaacaattcggcggccagtgtttccacccagaaattcctgggctggaactggttttcccggcggtaccctagtcgctgaggctttcacatgtttgacatggcatctgtttgctatttagctggtgcccctgagcgaattcttggcgtctgcgctggatctggagtctgcattcacgcacgctggtgaattgggaatgagattgcaagcatcaggaggcactggggacggaagggaaggtagttagatcccactgcaggctgaagattttaaactatcccgtcttgagactcgcgcgcgtgtgtgtgtgtgtgtgtgtgtgtgtgtgtgtgtgtgtgtgtgtgtgttacagcgaaaatataataatttttccatagcagctataaaacggtgttcgcttt

SEQ ID NO: 1076 - DNA, 2327 bp, Homo sapiens
agatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctacgagccgtgcggcatctacaccgagcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatt

SEQ ID NO: 1077 - DNA, 1738 bp, Homo sapiens
aagtactttatagattcagaagtaaatgctgtcctgttctccatcagctgttcgtttgttacagattttgtatttcttttttttttttttgagatggagtctcactctgtcacacaggctggagtacagtggtgcggtctcggctccctgcaacctctgcctcccgggttcaagcgattcttctgcctcagcctcctgagtagctgggactacaggcgcgtgccaccacccctggctaatttttgtatttttttttcttttttttttgagaaggagtctctctctgtcacccaggctggagtgcagtggcacgatctcggctcactgcaagctgcgcctcctgggttcacgccattctcctgcctcagcctcccgagtagctggaattacaggcgtccgccaccgtgcccggctaatttttttgtatttttagtagagatggggttttgccatattggccaggctggtctcgaactcctgacctcaagtgatccacccacctcggcctcccaaagtgctgggattacaggcatgagccaccgcacctggccagatctttgtatgtcttaagtgtttcaaagttataagcatttttctggggggatgtccattttggagggatccattttgatcctttgtactctataatgtgaactttcccctgttccaacacttaaaagagaattattagcacataatctaaaagatggaattttttttttttcttgagacagagtctcgctctgtcgctaggctggagtgcagtggcgcgatcttggctcactgcaacctctgcctcctgggtttaagcgattctcctgcctcagcctctggagtagctgggactactcgtgcatgccaccacgcccggctaatttttgtatttttagtagagacagggtttcaccatgttggccaggatggtctcgatctcttgacctcgtgatccacctgcctcggcctcccaaattgctgggattacagcactgtgccctcctaggaaattattttttaagtgaaattttatttttattttttttaggattttggtagagaatgagtaggcctactcatcaatatcaaacaggacatttagtttctttccttagaacagacataaatttaatttcatggtaatatgataataagaaaatgcttctatttttctttagcacctccatggttctcatatacccatgtctgtaaaaagtgacatgagaattttgttgggttacattttattgtatttattagattcgcttatatagatgacttaggcagaaataaagtcatgtctttagaaggtgaacaagccaacttgtgatggcctgccttttgcttttggcagttgggatgagaacaattgactctcccattggttgttagatagttgaaatggtgcgttggtggtcatacttagtgttctaggctgtgaaatcatggagttcttccacttccaagaatgactcatttgctgttggattctagtacagaatttagcagcctgatgtgtccccaaactgatttaatttctactgaagtgcccttgtgtacatttgttttgtaatttaccaaagtactacctgagtgtataatgactcctgcagtgagttaatgtaattgctgctttgaccattgttttaaatctgtgtactagagtaactgtgagcagaatgaaatcacattatctcagtgttcaaaatatcattctaataaagtacatgcattaaacaatttt

SEQ ID NO: 1078 - DNA, 1950 bp, Homo sapiens
tagaaagaaggcgagagagaggagaccggaggtctgagctgcagccactacacaggcctggaattctaccacagggaatttgcagcacgagtctctggaaaaagacaacctcgccctgcggaaggagatccagtccctgcaggccgagctggcgtggtggagccggaccctgcacgtgcatgagcgcctgtgccccatggattgtgcctcctgctcagctccagggctcctgggctgctgggaccaggctgaggggctcctgggccctggcccacagggacaacatggctgccgggagcagctggagctgttccagaccccgggttcctgttacccagctcagccgctctctccaggtccacagcctcatgattctcccagcctcctccagtgccccctgccctcactgtcccttggccccgctgtggttgctgaacctcctgtccagctgtcccccagccctctcctgtttgcctcgcacactggttccagcctgcaggggtcttcctctaagctcagtgccctccagcccagcctcacggcccaaactgcccctccacagcccctcgagctggagcatcccaccagagggaagctggggtcctctcccgacaacccttcctctgccctggggcttgcacgtctgcagagcagggagcacaaacctgctctctcagcagccacttggcaagggctggttgtggatcccagccctcaccctctcctggcctttcctctgctctcctctgctcaagtccacttctaacctggtcttcggagctgggttggccccttctttgggctcaggaagcagccttagcacacgggcctctcctccctcactactgggtgctgccctgcgtggctgaccagctggcccaggatttcacagtcgaaaaggaagccaccactgatgcctcccactgtgacaggccctgtcaccaccaatatcttatttcaacctcacagttgacctgagaaatcgagattatcactccactttttcagacaaggaaactgaggctcagggaagccaagtgacaagtccaaggtcacgaagactttcttggagcccgaaacaccaccctctgctcctccttctcctgtcctggcccaggcatcctaggggctgaaatcctggaaaccgtgggctggtgtgagaaggtttgcatgctcagagcagagaagggctctccccactgcttcgtgattccagggccagagccatgcagtcccagaaaccccaacctagctggggcaggtccagagtccaagccctggtgggtagaggccaagcagaagccctgaagtggactcttgcttcccctagtagtgttttcagtgccaagaagctgaaactgtgagctggagttggggagaggtctggaagaggaccatctgggatttctacagcctgggtacccatagccacaccaaggcttctgggagattctgcagggtcagctttccaggctgttcccaaatagctccctgcctccccactgcccctaaagccacagcagaagagccattcatctcataaacaaaaaggaagaggaaagaatgaggaaggaccctgtgcaaggttatttgcaggcagggatgggcttgtacctgacagcacccacccctgtgtggcccccaggccctcatcaccctcagacccctcctaagcagttccctcattgctctttggactaggctgacagcaggaagagcagggcccatgaccgggtggaagttcagttttggtgtctgcttcaagagggggttttacactctgattccaggacaagcactctgaggcgggtgggggagagaaaccctggctcttcacccaggtttcacacacatgtaaatgaaacactatgttagtatctaacacactcctggatacagaacacaagtcttggcacatatgtgatggaaataaagtgttttgcaatcttt

SEQ ID NO: 1079 - DNA, 1502 bp, Homo sapiens
actcggaagtcctggcctaaggattttattacactgtctgctcctgatgaccctctgcggttgtcaggcgtgaatcctctggaaggaactgtttgcagttgtatgcacaaaggagacccatgcaggcatgcaccccagatgggctgctagactacccctcttcatcagcctgctggaaagagcagacagcgtaacagcagcctatgccaaacagcactaaggatgtcagtgtacgagacggtgcgaagcccagaggaggcggcttgggatcctctgggccatccctggccctgtagcacagacacatacaagttccttggacttgtcacactccttttcacttgatccctctctggcctgggtcacatttatgacatcccccctctgcaacctttctctctgggggctgtaccaaaggcatggtacctcagtctggtatccagactgtgaaatcagcctctgggccaaggagggtcctacagacaaggtggcatctcaacctcacccaagaaacccccgggactttaccccagcaggctgccactggggcaccgaactaagccagctcagccttccaagctgcttagcctttgtcaaccatcaaagtggggaaagggtctctggccttgcaaggatttgggcaggatggaagtctttgtctaggtctgaaatcaagggcttgggaatctagagcagagctcctggccagcgtttgaagcctggcctcccacctggggcatttactgacaccctgtcgccagcctagaacatcctgctctgaatgaacagagcccagatgggggtccagagctaagtgacccacctggggaagctctgattattcatccagggccttctcaatgagcacattacctccatgatcaataaccaagaggctgcagtcaaatactgctactgtcactttgaagattttctaagggcacaagtggcacacttgctctccggcctttgggagaggcatgttcttgggcagggctggctacggcaagagggaaccaattcctttcccctttaggcaccctctacctggcagctcttaaaactaagaaaaaatatgatatacacacacattatatatatatatacatatacacacacacacacacacacacgtatatctatttatgcacatattggggccaatttgatttgctagtattagacaataaactgtacaaggaaatttattatctcagtgtctttatttagcataaaagtggccttagaagaagggtgaaggttagatagatggaatctctgtcaggggacaaacagctgtagcatccccttagcatctttctagccaatgagccccctccccaggaggagggatggcctgactgaaacaggtgagagtttgcttccccctttcagcagcattctttttagatttaggtactgaagaatcccagtgagttctgcatttgtatcttgcaagtttgtataaacccaatacaggaaataaaatgaatggtttgtat

SEQ ID NO: 1080 - DNA, 1747 bp, Homo sapiens
aggaaggaaccagctgtaagggagggcagagggggatgtcttggaggggaatcccagactttggacactggtctctcttggaccaagaccccctctctggcttggcctccagatctgcccacctttctgtctccgtctttccaggattccatatgcttctgtctgtcttctcgtcgcagggtagattctctgtccctttctctgctgctcttcctcctggagccgtggaggcagctgggcgtgggtgccttccccgtggaaagccgctggcagggagtctacagccccttccgggactttgtgtgtgctggctgccccagggacctgcaggaggccctgctgggcttcgacgtgcagagctccagggagctgcgtaggtctcaggattacctgtcctgcgagaggacccaccctgaggacagtgtgggcagtatggaagacatcctggaggagctgctgcagcaccgggagcccaaggccctgcagctgtacctcaggaaggctctgagcaactcactgcaccccctgggaaagctgctccggacactgatgctgaccttccaggctacctacgcaggtgtcggggccaacaagcacctgcaggagctggcccaggaggaggtgaagcagcatgcccaggaactctgggctgcctacaggggtctgctgcgagttgccttagagcgcaagggccaggccctggaggaggatgaagacacagagacaagggacctccaggtgcatggattggtgctgcccctcatgctgcccagcttctactcagagctcttcacgctctacctgctgcttcatgagcgggaggacagcttctacagccagggcattgccaacttgagcctctttcctgatacccaactgctcgagttcctggatgtgcagaagcacttgtggcccctcaaggacctcacgctgacgagcaatcagaggtactccctggtcagggacaagtgtttcctgtcagccaccgagtgcctgcagaagatcatgaccacggtggacccacgggagaagctggaggtgctggagaggacatacggggaaattgagggcacggtgtcgagggtattgggccgggagtacaagctgcccatggacgacctgctgccacttctcatctacgtggtgtcgcgcgcccgaattcagcacctgggagccgagatccacctgatccgtgacatgatggaccccaaccacacaggaggcctgtatgacttcctgctcacagccctggagtcctgttacgagcacatccagaaagaagacatgaggctgcaccgcttacctggccactggcactccagggagctctggtagcctggcctttcctggacagactgaagagctgagcagggcactgccagcctgtccctcattacccaaggcaaggggcaggacaggccctcagaagcagctcttggaggagatgagcattttgttttgcacaggaagatgctgctgctgccctgactgggatgagggtgaggggtgacgggtgtggccctggatgtggtggttttcccttggccactagcccatcttcaatgaccccttaatctgcagcagctcacaggctgggggtgaggagtccctggcttctcttagcctgagcctttctcccaagttccagagcctctccgggcctcagtgctgccatctgtacaatggtggagtgagtacgctgtaaaggaccttccattcattttgctgaattccagagtccttttgg

SEQ ID NO: 1081 - DNA, 2771 bp, Homo sapiens
ccagttgtttggtgtctggtcagtgcaaacctgggctgtggggcttgatcagtggagacctggtcagctggggttagtgctggcctggtcagcatgggctggggcactggtgaccaggtcaaggggtgctattccgtggaggactgggcacatgggacctagtcagcagaccctggtgggcgtgtcctcatcagtgaggcccttgtcagtggggccctggtcagggcagccttgtcggcgggacctaatctgtagtgtcctggtcagagaggacttggtcagtggtgacttttgtagcaccggtctacagggtgacttggtcagcgggaatctcagcatttggtgccggttcagtggggtctactcactagggtcccagtcaggggcatctgatgacataaggcctcgctattaggggcctgatcagtggcaacctgttccctggaggcctggtcagtggggcctcatctttgggccagggaatgagttcatgatcagtggaacctgatcagtgaggccttgtcaataatgacctagtcagtgaggacttgtcagtaaggacttggtccgtgaagccttgtcagtgaggccttgtcagtaaggtcctggtcagtggagtccttgtcattgtgtgcctggcagtgggggccttgttagtggggcctggtcatgaggttctaatcagtgagggtgttgtcagggaggacctgatgtgcggggtctggtcagcagggacctggtcaatgtgggctgctgagcactgcttggataagccaggtgcaatgtgcattattgaaggccctgtggacagctgggatagcccagtgatgcccaagggcctagtcaaaagtggacaaagcacatatttggatggacctgggagatcctgctcagagattctgacaggacaaaggtaaaggaagggccagagtggctggagagatggtcacagtctatgggctgcacaggatggaggaggctggggaacaggcagggtgggcagttggggttcagggagaggcaggtgcatgctgggaggtcagaccctgtgaggtctttgggggcgtcaggttgggtaggctccaggcactctcactcacataggattccagaacactgctacaaggctctgagtgtttgtccctcacataggattccagaacactgctgccattgtctgaatgtttgtcctccacataggattccagaagtctgctgctggggtctgaatgtttgtcccccatctaggattccagaacactgctgtgagggtctgaatgtatgtccctcacatatgattctagaatattgatgctagggtctgtatgtttgcccttaacatatgatttcaaaacactgctcctggattctgaatgtttgtccttctcataggaatacagaacactgctgctggagtctgaatgtttgtcactcacatagaattccagaacactgctgcgaggatctgaatgtttgacccttacatgggattccagaacactgctgcgagggtctaaatgtctgtccctcacataggtttccagcacaatgttacgaggttctgaatgtttgtccctaacataggattccagagcactcctgctgtgctctgaatgcttctccctcacataggattccagaacactgctatgagggtctgaatgcttatacctcatataggattccagaacactcctgctgtggtctgaatgtttgttcctcacataggattccagaacactcctgccgtggtctgaatgtttgtccctcacataggattccagaacattcatgctggggtctcaatgtttcccttaacataggatttcagaacactgctcttggggtctgaatgtttgtccctcgcataggattacagaacactgctgctggagtctgaatgtttgtcagtcacatagaattccagaacactgctacaagggtgtgaatatttttccctcacctagtattccagaacactgttgcaagggtctgcatgttggtccgtcatataggattccagaacactgctgctgtggtctgaatgtttgtccctcacataaaattctggaacactgctacaagggtctgaatgtttgtccttcacataccattccagaacactgctgccgtggtctgaatgtatgtccctcacataggattccagaacactgctactaggttctgaatgtttttcccacacctaggattccagaacacttctgctggtgtctgaatggttgtccctcacatatgattccaggacactgctatgagagtcttaatgtttgtccttcacatagaattccagaacactgctcccgtggtctgaatgtttgtccctcacatagcattccagaacactgctacaagggtttgaaagtttgtccctcacataggattccacaacactactgctggggtctgaatgtttggccctcacataggattctagaacactccagctggcttctgagtgtttgtccctcacataggattcctgaagactgctgctgtcgctatagtcgttgagagtgtctgaatgtttgaccttcaccaaacaccaaatatcctggccctttagtctcgtactttccagcctccggatctgtgaacaataatctctgttgtttatgaattactcagtctgaagtattttgtaatagtagcctaaagagactaagagagcatcacctgccctgtcacctcatcacctcattactgaagctatactaacagcagtcacttttagtgggtacttcatgcatcag

SEQ ID NO: 1082 - DNA, 2605 bp, Homo sapiens
agaatgtaccatcgtgtcttagtgcacagtaattgcctatccctgcaggaggtggaagatttctgcagactgcgttgcctctgtgtggcttttcaactccacttacccctttctcagagagcttgttctcgagtcatcacatgctcttggattaggaacagtgattctttcttaaaaatgaacaagtggtatgaatatttcattttaagcaacttaaacgtttttggatgctggaatctgaatttaaatcatgtttcagacttgtatgatgagcaattgttaaagaatattgccttctactatgaatttgaaagtactcaagaaccacatttgaatttgggagattccattaggagggattatgaagacctgtggaatgttgtgtcacacctggttaaagaatttaaccttggaaagtcttttcctctgagaacaacaagaagacattttcttagacaagagaaatcggtcattcaagaaatctccttggaaaagatgcctagtgtgggctttattccaatgacatctgctgtaattgatgagtttgttggagatatgatgaaggatttgcctattctaaagagtgatgatccggttgttccttcactgtttaaacaaaagacatctgatgaacttttgcactggcatgctcaaagactccttagtgacgactatgacaggatcaaatgtcatgttgatgaacaatctagagatcctcatgttcttgatttcctgaaaaagattcaggattatcagcaattttatgggaaatcgttagaatcaatctctacgaaagtcattgtgactcaaactactcggccaaaggaggattccagtggtgccagtggtgaaatattacagaataccaaaccccaccaaattaccaaaaagagtaagaaaaagtcatttctcaaagaagatcagaacaaagctcagcaaaacgatgatctgctgttttctattgaagaggagatgaagaacaatttacattctggaataaggaaattggaagattatttgacatcatgtgcaagtaattcagtgaaatttggagttgaaatgttaggattaattgcctgctttaaagcatggaaaaaacattgccgaggtgaaggcaaaatttcgaaagatttaagtatagctgttcaaatgatgaaaaggattcattcactcctggagagatacccagaaattttggaagcagaacatcatcaatatatagctaaatgccttaaatatttaggctttaatgatctggcaaactctttggatccaactctgataggagatgacaaaaataagaagaaatattcgattgacattggaccagctcggtttcaactgcaatacatgggccattacttgataagagatgaaagaaaagatcgggatcccagggtccaggattttattcccaacgcatggcagcaggaactcctggatgtggtagataagaatgagtcagcagtgattgttgccccaacgtcctcaggcaaaacctatgcttcctactactgcatggagaaagtgctgagggagagcgatgtcggggtggttgtgtacgttgcacccgcaaagtcccttgttggtcaagtggctgcaactgttgagaatcgttttactaaaacgttgcctgccggcagaactctatgcggtgcttttacaagagattatcgtcacaatgtactaaactgtcaggtccattatcttggcagagaagttggagcaaaattttgggagctcctccttgtcattattcgatgtccctttttggttctttcagctaccataaataacccaaatcttctcaccaagtggctgcaatcagtaaaacagtactggaaacaggcagacaagattatggaagagaaatgtatttctgaaaaacaggctgacaaatgtctcaactttctccaagaccattcatataaaaatcaatcatatgaagttagacttgtgctctgtggagagagatacaatgatttagagaagcatatatgttcagtaaaacatgatgatgtttattttgatcattttcatccctgtgctgcgctaacgacagatattattgaaaagtatggattcccacctgatcttaccctcacccctcaagaaagcatccagctttatgataccatggctcaagtctgggaaacttggcccagggctcaggaattgtgtccagaggaattcattctttttaagaataagatagtcattaagaagttggatgctagaaaatatgaagaaaacttaaaggcagaattgacaaattggattaaaaatggccaagtgaagaaggtcaaaagagtactgaagaaccttagtccggattcattgtctagttcaaaagatatggtgaaaatgtttcctcttcttgttgaaaagttaagacaaatggataagttgcctgcaatattttttttgtttaagaatgatgatgtgggaaaaagagctggaagtgtgtgcacttttctggagaagacagagacaaaaagccatccccacactgaatgtcatagttatgtctttgcaatagatgaagtacttgaaaaagtgaggaagacacagaaaaggatcactaaaaaaaacccaaagaaggctg

SEQ ID NO: 1083 - DNA, 2177 bp, Homo sapiens
gacttcgagagggacttagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggtctcaaaggccacagaggtctcaaagaccccagaggctcgggaggcacctgccacccaggcctcgtctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacgaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggctctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattctttggagaaggtatttgggattcaattgaaggaaattgataagaatgaccacttgtacattcttctcagcaccttagagcccactgatgcaggcatactgggaacgactaaggactcacccaagctgggtctgctcatggtgcttctttgcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttaggtatctgccttggtttcagtggggacatctggggcttatggggctgggatgaggagctggatgattctaggaaggcccaagttggagaatgatgtggagagtgtgccaagacactgcttttggcattttattcctttctgtttgctggatgtcaattgacccttttattttctcttacttgtgttttcagatattgttaatcctgccagtctttctcttcaagccagggtgcatcctcagaaacctactcaacacagcactctaggcagccactatcaatcaattgaagttgacactctgcattaaatctatttgcc

SEQ ID NO: 1084 - DNA, 2358 bp, Homo sapiens
gtgttaaaatgcagtgaggggccaggtgcggtggctcatgcctgtaagcccagcactttgggaggccgaggtgggtggatcacaaggtcaggagttcgagaccagcctggccaacacagtgaaacccccgtctctactaaaaaatacaaaaaattatcccggcgtggtggcgggcgcctgtaatcccaggtacttgggaggctgaggcaggagaatcgcatgaacccagtaggtggaggttgcagtgagccgagatggtgccatcgcactccagcccaggcaatagtgctgaggtgggatcaggagttggagaccagcctgggcaacatggtgaaaccccgtctctacaaaaaatacaaaaattagccaggcgtggtggtcttcgcctgtagtgctagctactggcgaggctgaggtgggaggatcacttgagcctaggaggttgagactgcagtaaaccgagattgtgccactgcactccagcgtgggctggaccagtgagaccctgtctcagctcagtgagaccagtaagaccctgtctcaatcaatcaatcaatgcagtgagttagagagcatctattgagcatctacggtttgcgggtcacttccagcaccattttgagatgcggaaactggctgaagttgggtgattgattgaccaagttcctttgggaaattaataaagtcacactgaagcaataaactaccctcacctccaccaccagctttctcaggagaccccttcccattgcctgccccagacctcagggaccatggctgggtgtgtgggtctgtgctttctgcctttgcagtgtgtggtaatcgagagggtgggtcggcgcgtgctgctcatcggtgggtacagcctgatgacctgctgggggagcatcttcactgtggccctgtgcctgcaggtagctggggtggatgagggctggggggtccaggccgggctgacttccacctcacccccgccccgtccacggcagagctccttcccctggacactctacctggccatggcctgcatctttgccttcatcctcagctttggcattggccctggtgagtgggcccaaggggctctgggcatccatcatcacatagaaggagtgatgggtgcctgggtgcacagtgggtgggtgtgaatgcaatgtcccctgcaggccctcggagaccacctcatgccggggcttctgggagggaatggcaggaggagagcactgaggggccccccatacagactgggcctgggctcccactcccatgtctgggctggggtcggggagaggcaggcagggaaccctggccagcagccccctgtccctgcccctccttctagccggagtgacggggatcctggccacagagctgtttgaccagatggccgggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctacc

SEQ ID NO: 1085 - DNA, 1714 bp, Homo sapiens
ctatgagcaggcagtgattaaggtttagccctggctggaatgcggaaatcctggctgagctgggcttcttcaggctaggggttctaaaggccttggggctggaggagggggaagccagcagctggccaggggagcaatgtggaggtggccaatgcccagcctggcctgcaggaaacacccccaccctctcagccctgcccacttctctgcctcccacccttccgcacccaaactctccacagccctcgggcccaggtgcgtcccttcagctctgagggcgctgctctcccctgccttggcatccagcctcagctaaagagggtcatacacctttgtgagaaacacatgactttcttccctggcagctttcaggcagttctttatgcccagtattctgaagctgctttccactgtgtgttggatcctgcctgtcagtcactaggagtctgtcagtctcctgccctttgagactctttctcttggtctggggcctgcctgggcctctgcccctccacttgaacttagttcagcaattggcttctcccacaccacctgtttcccccagcgcttccacttctgaggcttggaatgcacagactgcttcaagaactgtgcttgctgggtgtcaattattctcgcttttggggtgtggactcctaccctggtggctgctgcctgagcactagtctggtgattcctgctctgggccgctcagtttctgccaccctgtgagcttccccagttacatgtgggcctggctgagtgtctccatctttctctggctccaagatgctggtggccccggtgaggtctgccattggtctgccaggtccctctgcactgaggcaggggaggccagcaaggacttcagggctgcagagccttccctgcagtttctaccttacaaacagggatctaatccctaacctggggtacgtgtgagaccacagggagaaggccctcgaggcatgggcaccatgccaggcctgtagggcaccttcctgcagcaggcagaatccccttcccaagtaggaggggaaagtgacaagaaccagggcccagggagggagcagcaaggccatgggaaagggcagccagcatccggctggatttgggctgcctctggggattcgggagggaggactggtggaggacaaggcacacttggctcagcagcattcccctcctctccctagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctg

SEQ ID NO: 1086 - DNA, 1710 bp, Homo sapiens
agtcccgccctccttgctgtcacaggtgcagcctgtcctctccttcccctgaccagcccagcatccacatagtctacacagagctccccttgctgcccagacaagctgaaggaccacaggaaaagccatggagacttcagcatcctcctcccagcctcaggacaacagtcaagtccacagagaaacagaagatgtagactatggagagacagatttccacaagcaagatgggaaggctggactcttttcccaagaacaatatgagagaaacaagtcttcttcctcctcctcctcttcctcctcatcctcctcatcttcttcatcctcctcctcctcagagagcaatgatgaggaccagcaacccagagcaaccggaaaacatcgacggagcctgggggctggatacccccacgggaacggctcacccggtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcgttctgagagacgcacaggagaccaagccagaccaataaacagaacacttttccttccatgtggtctgaatgttggcaccagcccgggcaggggcatctcatttgggcagtactgctgtgcaacccagctgcaaggatggaaggcagagggtgggtgtggggcctgaggcttcacagtacctggaccagcaggaagattctgggaggtcactgctctcagaggacagcaagggaccctgagctctgcaagctgtgatctgtctgggttcatggtttttctcaaatcccaggctatctgcatgcgctctcaggtgctaccgagccatcctgggagagatggatggtccactgctttgaggcagggagccatcgggctggggccccttggtgaacctgatgcaggtaagatgctgaggactaaaaccattttttttgcacccaaaaaaaaaggcaggaaaatgatcatcagaaactaaatggcagccaggcatgggggctcacaactgtaatcctcgcactttgggaggctcaggctaagggtcgcttgaagctgagagttcaagaccaacctgggcaacatagtgagacccccatctctacaatttttttttaatgaccaaatgtggcggtacatacctgtacatacctgcggttccagctactcaagaggctgaggcaggaggactgcttgagcccaggagttcagggctgcagtgaggtacgatcaagccactgcactccagcctgggcgacagagcaagatcgtttctctaaaattaaaaaaaaaaaaaaaagacaaat

SEQ ID NO: 1087 - DNA, 1681 bp, Homo sapiens
atcatgaatgggatgagtgtcctgatgaaagagaccctgaagagctctgtcaccccttcaccatatgaggagactggggaaaggcagccatctgtgaactgggcagtgagtcctcaccagacacagaatcagtgggcacgttggtcttggacttcccagcctctagaactgcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctc

SEQ ID NO: 1088 - DNA, 2078 bp, Homo sapiens
actttccggacacctctctatcttggtggcgctcccagcgcttactggttggttagagcaacagggacaaaccgaggctttcaaggctgtgtgcagtcgctcgctgtgaatgggaggagaattgacatgaggccctggcccctgggaaaagcactcagtggggctgatgtgggggaatgcagcagtggaatctgtgatgaggcctcgtgcatccatggtggcacctgcacagcaatcaaagccgactcctacatttgcctctgtccccttgggtttaaaggtcgacactgtgaagatgctttcaccttgaccattcctcagttcagagagtctctgagatcttacgctgcaactccctggccactggagccccagcattacctttccttcatggaatttgagatcacatttcggccagactcaggagatggtgtcctcctgtacagctatgacacaggcagcaaagacttcctgtccatcaacttggcagggggccacgtggagttccgctttgactgtggctctgggaccggtgtcctcaggagtgaagatcccctcaccctgggcaactggcacgagcttcgtgtatctcgcacagcaaagaatggaatcttacaggtggataagcagaagatagtggagggaatggcagagggaggcttcacacagattaagtgcaacacagacattttcattggcggagtccccaattatgatgatgtgaagaagaactcgggtgtcctgaagcctttcagcgggagcatccagaagatcatcctgaatgaccgaaccatccatgtgaagcatgacttcacctccggagtgaatgtggagaatgcggcccacccctgtgtgagagccccttgtgcccatgggggcagctgccggcccaggaaggagggctatgactgtgactgccccttgggctttgaggggcttcactgccagaaagcgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccctgcctgatgctatatgcagaggcccagggaccaggtgtgtttcctctcaccaagaagaaagtacacactgatgagaaactgagaaccaagacaggcatccctgggtggcctttcctgctgacactccacgagctgacccagcagaattctctgtgtaggaagcatcggactttgtccattgaatatgtagcggctgccagagatcacacatcaatgcaaattccagagcctgtctgctatagctcagtgactgtgttgtgattcatagtacattaaaaagagagagagagagaaagaatcccacagggcactattaaaatacttctctccttccctgactcatgacactcttcctgacagcagaatgactgtgtgaccttgaacttcacatttcccacattggcccttggattgttcggattaaccccttccactcctcactggctggttcactgtgttctgactagtccataaaaataaagatggaaggagatc

SEQ ID NO: 1089 - DNA, 1820 bp, Homo sapiens
aggatgggtggagcagggaagagccaggatggggagaagttaggggtcctgatggccattatgggaatagaggctgggggccaactgactggcccgggcaatgattccccaaacccctcaccattgctccccaggagcagcaatgtctgtgcaggtagcggctcctggaagtgcagggctgggcccagagcgcctgagccctgaggagctggtgcggcagacgcggcaagtggtccaggggctggaggcgctgcgggcagagcaccatggcctggctgggcacctggcggaggccctggcgggacagggcccggcagccggcttggagatgctggaggaaaagcagcaggtggtgagccactcgctggaggccatcgagctggggctgggcgaggcccaggtgctgctggccctgtcggcacatgtgggtgcactggaggcagagaagcagcggctgcgctcgcaggcccggcggctggcccaggagaacgtgtggctgcgggaggaactggaggagacgcagcggcggcttcgggccagcgaggagtccgtggcccagctggaggaggagaagcgccacctggagttcctggggcagctgcgacagtacgacccaccggcggagagccagcagtctgagtccccgcctcgccgagacagcctggcctccctgttccccagcgaggaggaggagaggaaaggtcctgaggccgcaggagcagcagctgctcagcagggtggctatgagatccctgcccgccttcggaccctgcataacctcgtgatccagtacgcggggcagggccgctatgaggtggcggtgcctctgtgccgccaggccttggaggacctggagcgcagctcgggccactgccaccctgacgtggccaccatgctcaacatcctggcgctggtgtaccgggaccagaacaagtacaaagaagccacagaccttctccatgatgccctgcagatccgggagcagacgctgggccctgagcaccccgcggtggccgccacgctcaacaacttggctgtcctctatgggaagcgtgggcgttaccgggaggcagagcccctgtgccagcgcgctttggagatccgagagaaggtcctgggtgctgaccacccagatgtggccaagcagctcaacaacctggccctgctgtgccagaaccagggcaagtttgaggacgcggagcggcactatgcccgggccctgagcatctatgaggcactgggcgggccccatgaccccaacgtggccaagaccaagaacaacctggcctcagcctacctgaaacagaacaagtatcaacaagcggaagagctgtacaaagaaatcctccacaaggaggacctacccgcccctctcggtgcccccaacacaggcacagctggtgacgcagaacaggcccttcgccgcagcagctcactctccaagatccgtgagtctatcaggcgaggaagtgagaagctggtctcccggctccgaggcgaggcggcggcaggagcagccggaatgaagagagccatgtcactcaacacactgaacgtggatgctccaagggctcctgggactcagtttcccagctggcacctggacaaggcccctcggaccctcagcgccagcacccaggacctgagcccccactaacgtccagtgaactgcgctggccgcagcttcttgggaacagtgcaggagggatgggctggtggggtgagagggggtctatcatctcctggcccccccttgcctctgggtacctggtggatagctgccttctcctgcgattaaaggctgtggacgtgacagtgag

SEQ ID NO: 1090 - DNA, 2968 bp, Homo sapiens
aaaggtgtccagagtaggaggacggtgcaacgcttgatgtgggtgtctcaggtgcaggcatctgggcctcagggcttggttctgtgaagtcgcctactccagcctggagagaagggctgcctcaatgggtcctgagggggacccttggccttcagtcttgaagccttcctcccctcctttccctcctcaccttcagacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaaggtgcgggtcatggccggggcacgatgggcaggacagagctagactcttctctttacaccctaagatacaacaaaggggtttcctcttgttaccgaatgtccacctgcactacaaaatgctgttctcagtgcaggcctgcatccctcaccccttctttgacccagctggggcactgagccaagagccagggcaaggaaacacctgggtccagaatcagggctggaccctggagtgctgggtgagacggccccagccacagggagccttaaggatggaaacttggcaccttaaggactatgagaccagtgtgtgtggcttgggtgactcctttctctccagtttctagcatgtggaatggaaagagccctgaacagggctcagaaagatgggtctgttgccacctctgctagtggacagtttctttcccaacttttgggaccctgagcactctaaaagttgcagttggggaagatgacctgaggccacagccccaggtctggttccaaactgactgtgtaaggcagaaggccacagtttgggctcaggcaggttagtaagaggttgggggaggacccaagagggagctttgtcacccaggagggagaaagggctccccagagagtctagtcctttgcccaggctgtggatttcattcagactaaggaggtctgtgggcaggagtgagtgcaccacatctgcccccagtaaaagggaggggagatgacctatagtaatcacctactcttgccagcttttgtcgtggatattagtaagggtgatattaaccacaacaaaacgtatttactgaatgcttgctatttttaataggcttatgtaattcattcttcccatgtgctaggtactatttataattccacacccttcaatgaagaatcccttataatctcccttttaccggtgagaaaactgaggtttagtgtaggtaacctgcccaagggcccgcataacaaatggagagctgaggttttagcctggcctggtaagttctgaacagaggaaggaaggaagcatcccagtgaagagacaggatgctccaagagaccttggagtgacagtgactttattaaaatagcatttaccaagtgctttttctgtgccagtcactgtgctaagtgctttacatgatcacccgttttaatccttactagaacctacaagttaagtattatccccattttagagatgataagatagggatagtgaggctaagcaacttgcccagtggctgactccagagcaggtcctcatacctctgctgtactgcctctgatgtctgccccaggcaaggtggtcctgggagctcaggcttccttttggaatgcaaacgaatcagagatgattgcggatagtccgttgtcgtctctgcaatcccctgagcctcagttgaagagacaataatggagatttggagaaagagggatgagggccttccacctaaggggagcatccagacacggtccctgttgtgtttctgacatcttagacagacccttgggatttctctaccctctttgtgcttctgtgcccatcctctcgaagttccttgaactgttgtgatccagtattcctgattgatggaggtgctcatggcaggtttttgtgtgtctggtctgtgtgcccctcttctccagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctgg

SEQ ID NO: 1091 - DNA, 1988 bp, Homo sapiens
tcggcggcggtggcggaggcgacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtgggtacacctgagcccactcttgcacatgtacacaggcactaacatggcacacacatacactcctgcgtgtgcacaagcacacacatgcaaggcatatacatggacaccgacacaggcacatgtacatgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggattcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaggcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgcaaaaaaaaaaaaaaaaaaag

SEQ ID NO: 1092 - DNA, 1396 bp, Homo sapiens
gtttggtccaggcccttgtggagggcacagtctggcatggaggctgttaaaaggcacaatgaaccccacagtggtgtggtgctggggacacaggcagctgcagcactgaggatgaagaagtcctgacttggcctcaaagccagcattgacttcctagaagaggtaccagctaaatggtggtgagaaggctgggtaagatttagccatagggtgatgctgggaagagtttcaggcagagggaacgatttatgcaaaagcccaaagaaaatagctccccctggctgtggcttaggagtcccttctcttatttttgtgtattccctgatgagatccagggaccctgtgactttttcctgggggactctgtgactggagggcctctctcactggtcctccgtggggctgagggcatgagtggctccactgaccatgtccttgggcctgagagctctgtctagcaagtgggagctggcaggctgccctgccccatacccagctgctaaactttttccctccctgtttcatgcccctcaggaggaggtatctgagagcagctcgagcgcagaccccctgcctaatagctacctccctgattcatcgtctgtgtctcatgggccagtggcaggggtgacaggcggtcccccagcacttgtgcactctagtgcactcccagaccccaacatgctggtgtccgactgcacagcttcctcctcggacctggctcggccatcgacaagatcatcgagtccaccatcgggcccgacctcatccagaactgcatcactgtgaccagtgctgaggatggcggggccgagaccacacggtacctgatcctacagggcccagatgatggagcccccatgacatcaccaatgtccagttccaccttggcccacagcctagcagccattgaggccctggcagatggccccacatccacatccacatgcctggaggcacagggtgggcccagctccccggtgcagctgcccccagcctccggtgccgaagagccggacctgcagagcctggaggccatgatggaggtggtggtggtgcagcagttcaaatgcaagatgtgccagtaccggagcagcaccaaggccacactgctgcgccacatgcgggaacgccacttccgtccagtagcagcagccgcagcagcagctggtaaaaaaggacgtctacggaagtggagcacctccaccaagacccaagaggaagagggaccagaggaggaggacgatgatgacattgtagacgctggagccattgatgacctggaggaggatagcgactataatccagctgaggatgagccccgaggccggcagcttcggctccagcgcaccacccccagtccccccagtaaaagcctccactggcaaatgcagtc

SEQ ID NO: 1093 - DNA, 1522 bp, Homo sapiens
ctgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggcaacgtgaacaggaggataggctacatgaacaggaggagaggctacgtgaacaggaggagaggctgtgtgaacaggaggagaggctgtgtgaacaggaggagaggctacgtgaacatgaggagaggctgtgtgaacaggaggagaggctatgtgaacaggaggagaggctacgtgaacaggaggagaggctacatgaacaggaggagaggctacgtgaacaggaggagaggctgtgtgaacaggaggagaggctacgtgaacatgaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggagaagctgttagaacaggagaggcagcaggaggagcaggagaggctgctggagagggagaggctgctggaagaggtggagaagctgttagaacaggagaggcggcaggaggagcaggagaggctgctggagagggagaggctgctggacgaggtggaggagctcctggacgaggtggaggagctcctggagcaggagaggcttcggcaacaggatgagaggctgtggcagcagtagactctgcaggagctggagaggctgcgggagctggagaggctgcgggagctggagaggatgctggagctggggtgggaagccctgtacgagcagcgggccgagccacgcagcggcttcgaggagctgaacaacgagaacaagagcacactgcagttggagcagcaagtaaaggagctgaagaagtcaggtggagctgaagagccaagaggctccgagtctgcagcagcagccagaccagtagctggagccccagtcccacaaggagcttggatgtgcggacaagcagggtggactccccaggagcacccaggcttgagtggagaggctgttggtacaggagaggcggcaggaggagcaggagaggctgcatgccattcttttcgggctgcggagaacagggagccaaacatcaccatcatctaagagcgggtcaaggaatt

SEQ ID NO: 1094 - DNA, 1611 bp, Homo sapiens
gtttgagatggagtctcgctgtgttgcccaggctggagtgcaatggtgcgatctcggctcactgcaatctccatctcctgggctcaagcgattctccagcctcagcctcccaaggagctgggtttacaggcgcccaccaccacacccagctaattttggtattttagtagagacggggttttgccacgttggccaggctggtcttgaactcctgacctcaggtgatccacccgcctcaacctcccaaagtgctgggattacaggcgagagccaccacgcctggcataaaactttatttccagaggtgagtagtgggcagggttggcccagagggtgggctgattctgcctctgccatcccagctgcaacagctatgcacttgagccctgagatgggatccatgtcccctcctggggtatccccgtggccaccacgcgtggttttgcacaggacctgggccagctgtgcacatggagcggtcctgggcttcagtggctgacccctcccttccgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccttgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggagggtgaatggtcttgggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttggaaatttgttcttttcctttgaagtcacattttcttttaaaattttttgttttgcatccgaaaccgaaagaaataaagcggtgggaggcagggccattgtgttg

SEQ ID NO: 1095 - DNA, 1747 bp, Homo sapiens
atgtagaagagggggtgtgagttctgaccttttttgaagtgcagcatgtgtgcctggaagggccccagtggcaagtgtccagctcgctgcatcccagagacagaacatagctgtgtagtcagcgcccaggtggagacacagcagcacatcccagaacccccgctgcctccaccacagacaaccaccatcccaactgtcatagcatagggtcactactgctgattcaggtagtaaaacttgtcataggaaatcagaataacagcaagaatgtccccacctgtctccagtgagagagcaggaatatgccgggcacagtggctcacgcctgtaatcccagcattttgggaggccgaggcgggcggatcacccgaggtcaggagttcaagaccagcctggccaacgtggcagaaccctgtctcttctcaaaatacaaaaattagccacgtgtggtggtggtgggcgcttgtaatcccagctgctcgggagactgaggcatgagaatcacttgcaacccgaaggtggaggttgcaggactccagcctgggctacagagcaatactccaactcaaaaaaaaaaaagagcaggaatatcaacctccatattgtccctggggaacaggtcggaggccatggtgctcacagtctcccggcttgggcagatgtggctgtggctgagtccttcagcggcgctggacccctggcagcgccacccatggtgcagggaggctttgggatggccctgcggatgctcacacttggcttccctctccctgcggcaggagagcctgtcccgcctcctgtccacctgtggcctcgtccagtctgtagagttgcaggagaagccggacctggctgagagcccaaaggagtcaaggtcgaagttttttcatcccaagccagttccgggtttccaggtagcctatgtggtgttccagaagccaagtggggtgtcagcggccttggccctgaagggccccctgctggtgtccacagagagccaccctgtgaagagtggcattcacaagtggatcagtgactacgcagactctgtgcccgaccctgaggccctgagggtggaagtggacacgttcatggaggcatatgaccagaagatcgctgaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccgaaaagagctgctcaacttctacgcctggcagcatcgagagagcaagatggagcatctagcgcagctgcgcaagaagttcgaggaggacaagcagaggatcgagctgctgcgggcccagcgcaaattccgaccgtactgagctgtgagagccgcagtgaatggctggaggtgcagggccaggaggaggcgaggcagggcctgcagcggtctctgagaggccgagctctggccaacgggccccaggttgaaggccaccgcgtccaacagccccatcagagtccacacaggccaggagggaaggaccaggccacccctcgggtcttgtgcttcagcagtcctggggacccaggcgtgccgagaggaggacttgtccttcctgcttcttgcctccacaccctcctctccaggaccctggatgaatccgttctgtgcttccttttccctcaatgcaaaagcccttgctggcaacgaaaaagcctc

SEQ ID NO: 1096 - DNA, 1827 bp, Homo sapiens
aacctgaagctctcagagcttccctgtcttcatctatcagcccagggagaggaatcagtggttttccaaaagctgtacctctttccataaatacaagaatgaagggctgagatgatggcagttagaattatattgagaaatggtagcgggatctgagaaagcaaggccatgagttgaaagcagagagaaggcggttcgagtggagccctgatgaagttcatgctcatggttgcccagccattaacacgggctcatcacatctgtttccagattgcttctagaacttagctaccctcgttctataagatggaatgaaaatgcgtactacatacagatcatgaaaagacgcaaagaaaatgcatcttcacattgcagttcagaatcacgccggcctcattctaccgctgctctctcctggatctcggccacggatcttttgctcgcgaaagttcctgcgtctagctgcacacaacgctgctgcaggaaaccgaggtaagggatttgccgagacttagctccaccacactccccgaggccccgcccctcctctctggccctcccctaggcccaggtgtctcgcgttgcacgtgcagttgttgtggttctacgtcacgtggtcccggaagttcaagacagacccgcctcaaacatggcggcgcccagcgcgcgaggacgtgatccgcttctgctccggcttggattgtagccttgacgaggtctgagcgaccatggaccggccggggttcgtggcagcgctggtggctggtggggtagcaggtgtttctgttgacttgatattatttcctctggataccattaaaaccaggctgcagagtccccaaggatttaataaggctggtggttttcatggaatatatgctggcgttccttctgctgctattggatcctttcctaatgctgctgcattttttatcacctatgaatatgtgaagtggtttttgcatgctgattcatcttcgtatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagattcctttttctttggtccagtttcccttatgggagtccttaaaagccctctggtcctggaggcaggatcatgtggtggattcttggcagtcagcagtctgtggagcttttgcaggtggatttgccgctgcagtcaccacccctctagacgtggcaaagacaagaattatgctggcaaaggctggctccagcactgctgatgggaatgtgctctctgtcctgcatggggtctggcggtcacaggggctggcaggattatttgcaggtgtcttccctcgaatggcagccatcagtctgggaggtttcatctttctgggggcttatgaccgaacgcacagcttgctgttggaagttggcagaaagagtccttgaagcagagacaagcctcacctccacttctgtcaagagaggggcctgcagtgcaaaccctcttccgctgagcagctgtctgaactataggccccagtgctgaagaccagttgtgctaagataccggcatggagattgtgccatccgtggtataggctggctggtatgaagtcattggcctgtatgccagagagctaagagaagagaacggggtctgtggcggtactctgaacaatttcctcagaacctcttaataaataagtttggtaatgctgag

SEQ ID NO: 1097 - DNA, 2225 bp, Homo sapiens
aaagatctgttgaagagtgagtaagagggaccctggactagggtggaggatccccaaatctccccacccccgacccttatgccgagatcaaggaagggtagggccattcattacttcccacccttcccaaatgtcacagtggttgacactcaattggtgctaaggccattttgtcaaatgaacagctttctcagcatgtggtccagtcaccactcaatcagaataccccaaatgtgaagcaaagggatctgcattttagcaagttttccaggtgatacaccctaatgagacactgggaatgaatgggtgagtgagctgcaggtagcagtgccacagacaggaggaggaaactcaagcatggcatgggtcttggaattttccatctgcctctgatgccctctggcactgctcgttctctggagtggtttcctggtggcttattctctggacacatgccagcccttggagtgactattgtgcttgcctgtttcttcaccttcatgctcccctcaccatcaccataggccttaccagttgaaccctttctgccaccccctctggggatactgtacttagggacactttttcccaaactggcccatactctcctccccaataaaaagatctcactgttcttctgggctccttccccaggcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgtaacccctgagggagactggcagagggagtggatgggggacggggaaggccattttgagggggctgttggaagtaccatggccccagaggagagaagtgggggctcagggtggtgggaagaagcaaggaggaactggttctcagtttgcccgctgagtcggaggaggaggagcctgggtaggaaggggaggatgggggggcaggttggatgtcagggtcttcctctcactccctccttccctctttttaccctttcctctttaccccaggacctggaggaacttgctttgtaccagatccagctgctgaaggacctcagacatacagagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctg

SEQ ID NO: 1098 - DNA, 2639 bp, Homo sapiens
gaagcggaccagggccaggcttgtgttcgcagccttgccggggctggggttccgatgtggtccccggagcgggaggccgaggccccagccgggggagacccggcgggccttctgccccccgagtgggaggaggacgaggagcgcatgtccttcctgttctccgctttcaagaggagtcgcgagtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcttgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgggggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccg

SEQ ID NO: 1099 - DNA, 2116 bp, Homo sapiens
ctggaaggctacatctaccggcacatggaccccgtcaatgacactaaagtgacacagcacataaaagagctcctggaaagaaacactaagaagaagtccaaattgagaaagaaacccaagccttatgttgaagagccggatggggtggcgataagcacgtatgccaagtactgttaccacaagctacagaaggcagccctgaccggggccaagaaggggctgaagaagcccaacgtggaggagatccggcatgccaagaacgccgtgttcagcccgtccatgttcggcagcgcactgcaggaggtcatgggcatgcagagagagcgctaccccgagcgccagctgccctgggtgcagacacggctctctgaggaggtgctggcgctcaacggtgaccagacagagggcatcttcagggtccctggggacattgacgaggtgaatgccctgaagctgcaggtggaccagtggaaggtgcccacaggcctggaagacccccacgtccctgcgtccctgctgaagctgtggtaccgggagctggaggagcccctgatcccgcacgagttctacgagcagtgcatcgcacactacgatagccccgaggcggcggtggccgtggtgcacgcgctgccccgcatcaaccgcatggtgctgtgctacctcatccgcttcctgcaggtcttcgtgcagccggccaacgtcgcggtcaccaagatggatgtcagcaacctggccatggtgatggcgcccaactgcttgcgctgccagtccgacgacccgcgcgtcatcttcgagaacacccgcaaggagatgtccttcctgcgggtgctcatccagcacctggacaccagcttcatggagggtgtgctgtagcgggggcgcccggggacaggagggatgtcctgccgcccccagccaggccgaactccgcactcgctctcccggcagaggggccagaatcgcccggcccagccctggagccccctccactcccccaggcccctggccccggcgctccccacgtcttctgcctggtctgagggtgcagccagggcacagcagcggcggggagggcgcctctggccccccacctcacggccagttcccgcgggcaccgcctcgccctccgctggccgcgggtcagctccgagaaagtgccttctgtgtcctggagccgagcgacgctgcctccttggggccgggctgcctccctgtggctcctgcgcgccctggcctgggccttgcccagccgccccggtctctccttccctttctcctgtcctcgtcctggcctgcagctcttcccagccccgagagagcttcccgacctgtccccgcctcctctccctccctcggcccgtggtccccagctggtgactgctcaggagtttgggggctccaggacagtgggcccggggcctggcaggctctcggtgggtggggtgggggcccccaaaccaaagtcctctggggtagggagcagggctgggcaggcattctgggggcagggtgggggaggggcgagagtatttttttcttcgtgtaactgtaaatccagaatctatcctgcatcgcagcccaccgtgtatagagatataaatagagggaaagatataagaactaaatttgctaatgacatagttttaacctaaatgctatttatctctgagccgtccccgtcctccgtgcagagcaagttgaggtcattccttcttttcttctccgatcttttttcttggcttctgaccaaaaaccaagctctaccccatccccatcccagacctgcaggagacgagcgagcgggaaggcgccgggcccgggactgtccgttctcggggccagagctgctgggggaccgagtttgtacattttccattttggaattttgagttccaattgttgtaaaacttaatttctccccagtttttatatatatattttttagagttccgtttttatttattaaaaacaaaagccccagccctgccgaggcctgggcggcgtcctcagtcgggtggtcccggggcctttgcggtcccgcccggctgagacgctcgccccgacgcatggacccgagaggcgacgacacgagtgaataaagtgcacatggaccctg

SEQ ID NO: 1100 - DNA, 1494 bp, Homo sapiens
aagtgtaagtgagaacaggtgtgagtgagtgggccggcgggcttctggtgggtcgggcactgtggtccctggcctcagagaaggaagggcctcgaggtcatcatccttctcctagcaggcagctatgcggcggggcagggacaggggaggaaggagggccatgaaggggaggagggtcagccaagatgctgtgagttttggagcgggacactatctgagtcctggaggcatatgaaactgtccataaaggacggatgctggggtcctcagtgggggccagggaaagggtgggacagcccgcgcttgacagcgcctgcctcagtgctcgtgttcactgggggtcttcccatcagccccttcacccacgaggtgaactgccgcggagctgtgagggtgccgtttgcattccaattgtcgggactctttcacctgagactgagactcagtgggtgggtccaccgatcgttcctccatgggagtttaagtgtgaagaggagctggtgggcttcaggagggtcgggcagcacagtccgtggcctcggaggaggaagggcctcacaggtggtggcgccgccatgaccttgtggttgtggcagggctggggcgagggaggaagttgggccacggaggggagagggatcagatggagcaaaacttggggggtactttttgaggtatctttgagtcccagaggcacctgaaactgccgaaagaggacaggtttcggagttctcagtggggacctggggaggaggggacctggggtggctgtatattaaaaaatctcttcataatggagtttagttatgaaattaagtctctttaggaaagaccccatgttttgatctaggacttgaagatcacttctctgccgagctggctgtggaagaaacaaagcagtttgcagatagatttatttgatgtgattggaaaccaggcgtagttattattaactcaggacctattatggaaatctcacaaaattaaaaaaaattacaatcagcagatggccatggaaagagtcaagtataattactcctttttattgcagtcttcagttcacgatcttctagttgcagcgatgagtgcacgagtgagatcaagatccagaggaagaggagatggtcaggaggctcccgatgtggttgcattcgtggctcccggtgaatctcagcaagaggaaccaccaactgacaatcaggatattgaacctggacaagagagagaaggaacacctccgatcgaaggtgagaagggcatggaggagcattttgtgtttcatgtatgattttatactagtaacaggaataaataaaccatcccctaaaaattggctggaaacctgtaaagtaatccttggtaagggaatagtgtagttttcagctgctgtagtccttgtgataaattttctcttcagcattttacttatcttatatcttaagagttctttggcatacttggaaaatacaatccttgccaagactctatattagc

SEQ ID NO: 1101 - DNA, 1502 bp, Homo sapiens
tggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatgattttaccaacgaaagctatggcaacccaggaattgactgtcaaaagaaaactgagtgggaataccctgcaggttcaggcctcatctccagtggcactgggtgtaaggattcccactgtggctcttcacatgatggaactgttcgacacaactgtagagcagctgtatagcatcttcactgtaaaggaggtaagtaactccctaagctagcatgttaagtgctgacattgggagaaaatacattacaaagaacaggagctggtttttggttttccttgtggctgtgtttttgattgaagggatgtgggatggtggtgacagaagtctgagcatagtttctgaataattggaggggagatgggcattctttgggactatgtccgcattacattgagttttctccctctaggaagagagagtttgtgttttattttctgtaagtaaaagctacatgtttaggatttttaaaccatattaattgttatattttgtatttcataattatattatgtgttagtgtgtactggaataacatgttttatttggttagttggtgcaaaagttttctaaatctactgctgtattagaaactgaaaagggagggaaattccagatgtttgatgggaacatcactggtgaatatctaggattggtaagtagactcaaggttgaagaagtaaggtgggattaactcttaatattactttttgtatatgctgtttttagcaccgaaatcacgagggtctgtgttgcctcaaccttaacagcagccctctgttctggttactattactgtacttaaaacattattatatattcctgctgtccttgatgttactgctgttctgagacattttggcaataaagacaattatcagtggtgctgatgtataaactggaagaaggaccgtatgttgttcattgattcttctaggagtttcaatgaaaggatttttctgtgttgtattgtgggaagtcttaaaagattttcagtggaatttcccctctcttttcagttaacaaataagaagatcatcatgaaatggagatgtgggaactggccagaagaacactatgccatggttgcactgaattttgtgcctactctagggcaaacagaattacaattgaaggagttcctatctatctgtaaagaagagaacatgaaattctgttggcagaagcagcattttgaagaaataaaaggttcactgcagctgacccccctaaatggttgaattaaaatttattataaggc

SEQ ID NO: 1102 - DNA, 1881 bp, Homo sapiens
cttggctgcccccagccccgcccatgtctcagccccaagaccttctgggacttttttttttttttagacaagagtttcgctcttctttcgctcttgttgcacaggctggagtgcagtggcgtgatctgggctcactgcaacctccaccttctgggttcaagcctcagcctcccgagtagccaccacgcccagctaatttttgtatttttaatagagacagggtttcaccatgttggccagtctggtctggaactcctaacctcaggtgatccgcccgccccagcttcccaaattgccgggattacaggtgtgaaccaccatggcagcccttctggcacttgccagcagcagcaagagcctcacgtgtcccccgcctcccctcagaccaagctccccaccgctgccgccacagagggtaccagggaggagaggctcaggacccccgtggcgaggatgcacctcccagccctcggcccagccacacggaccacagggctcccgagtctcagcaacaccagctaaggggcatcatgcctctcctgccacacccagggcccgtgccttgctgtccctgcagcccccagacccaggcagacagggacagcccttctgaccaccgcacacactcgccaccgcaaagatccccggggatgcccctcgcctgtgtgtgtccctcatggctgtcacagcaaatctccaggagcccggaggtgcccatggaaaacacccccagcttccggaacgttctttcggacagggccataccggagcaagactcagctttctggtagcgggtggctgggcactgcctgtgagattctgtcacactcgctccagattcaaggggtccaaaaagtgtaaacaagtcaagtgcccatccagggatgaacgaacacagcccggcccggccacaccatggagcaggactcggccatgaacaggaaccaggctctgacaccggccacggcgcagatgcccctggaggagtccaccctcagcaagagacacacagacaccgacacggcgtgcaatcccatttgtgtgaatgtccaggacaggccgattcagagacaggaaggggacacgtgggtgccagtgactggggattatggggactgggggaaatggctaaagggcacccacaaaagttaatgataatgttccacagttttttttttgagatggagtctcactcttgtcacccaggctggagtgcaatggtgtgatctctgctcactgcaagctctgcctcctgggttcacgccattctccctcctcagcctcccaagtagctgagattacaggcatatgccaccacccccagtagagacggggtttcaccatgttagccaggctggtcacgaactcctgacctcaagtgatcccccacctcggcctcccaaagtgctgggattacaggcatgagccaccgtgcctcaccagaattgtgtacttttttttcttcttcttcttcggcatggagtttcgctcttgttgcccaggctggagtgcaatggtgcaaacttggctcaccgcaacctcctcctcccgggttcaatagattctccagcctcagcctgctgagtagctgagattacgggcgcccgccaccacacccagctaatctttgtacttttagtagagacagggtttcaccatgttggccacgggcaaaagaattttgttgagggcaaataatatgagaccacaaaactgccttccctgctcagttttaattttcacagttttaatttttagccttctctggttaccaaaataaccacgctcacggccgttcatttgaagatatttccagttaacgtgtgtgaagtgggttttttgagatgtaatttacaagcaataaaatgctcctgtctctgc

SEQ ID NO: 1103 - DNA, 1990 bp, Homo sapiens
agaacttgaccctgtcaacttgaaataatcgaaagaattagaacctagcttgaaagaagttatttaagctttgaaaagctgagaatatccatctgggaaacacagactccagagaaatgagcatggcctcatgggagaacgtctctccaatggagtccattccttcccctagaacaggggaaggaatgaaaggaattccgcgttgtggcacatcccagaatagttccatcaggaaagatcaatgtggaaatcaatgagtctcctattcatattctgggatgggaacaggaatagcagcccagggcgagctgtggtgaaacagccaatcaagttattgtcagtggtcccctgggatcatgtgcctgttatggaagaagcaacggagccagggaagaaatggacatcatctagaggtttggacttgggaagtgcaactccattgcctttagttgcaatagctggaggagacttcaggttattttccactgtagaaagggtgggtctccactgtgaagttgtatttatggaaataaggaagtatgtatgcactgggtgagaagaagggtaggagggctattataacccttgctttttatgggttatggccctgcatcccttctttgagttgccagcctgctcttcgtggtttggtgcaaggcttcccacaacccagccctgactataggggtgaacttaagactaagagcactcggaatctttttccctagacattgaatcttgaccatagatacacagtgatggatggtgactgcagttgtgaccttcaatggcaatgtttaaacagaaggtccatgaactcctgctgctgatatctctggaaccagagcagccctggaccctttatatctcaaggccgatgtgttataggaccaacaggttcatatgcccactgtgtagtaacaggccaatgcactgagacagccaggaggcagcagagaaagagtttaatgattgcagggctcctagtgaggagatgggagaagaccctcaaatccatctccccgagagttctgagttggggttttaaaggggatcttggaggatgaggggctggaaaattggggtcattgattggtcagggtgaggaggatgaaattatcaggatgtggagcctgtgtgctttggtgagtcagcttcttggggggtccttcagacctgctgatgtgggtggttttagtggcatgtaggacgtgaaagaatatctcaaaggaaaacaacatttcataaggttctagttgttatctctagagcagataaggggatctataatcttgtaacagggtctatctgattctaagacaacagacaaacaacaacaaggaagcgcgtcagagaacaggccgacctcatgatccatgctgcgtgtgctgcaagctcattttagtctcatttctctccctcccttcttccctgatgaataaagtttattgggatggtttcagatgctcagcttttccatatgattaggtgagtgatccagaacccttccaaaggaccctgtggactcaaccctctgtttgaacaacatacaagataatatgagacatttatttatcgaggaccctctgagcacctggcactgtgccagattctttcagatatataaaatttcacttgctcctgttgattctggaaaggagcaacggcatcttatgaagctgtagcagatactgtcctggcctcgctcatgtgtgtcagatgtgttggagtgccctggctgctgctctgcatgtgtagctgaggtcctgctggaaaaataccaccggagctctctgcagctggagtggaataattctgaagtgtgtgttttgcctcctttcccagtgtctccccatggggttaagctctggtcgcctgctcctgttgctggtcttgtggcacacacgtggcaggatgtcaccctttccctgggttgcgtccactttccttgctgtgttattcacactccccaaataaaatactttcactc

SEQ ID NO: 1104 - DNA, 2051 bp, Homo sapiens
accattagtacctaggaggcagggatcagaggaaatagattcagaggtaaggagaattttggggctatactttcaagaaagtcgtgttcgggacccaggaggtatgggtcagaaggaaaggagcacagcagatactctgccggatctggaggaatggaagtcagcggcgggtctgcgatggtggcaaacagcagtggtggacggttctgggtctggtaatgaagtcatagaaggcccccagaatgcaacagtcctgaagggctcccaggctcgcttcaactgcaccgtctcccagggctggaagctcatcatgtgggctctcagtgacatggtggtgctaagcgtcaggcccatggagcccatcatcaccaatgaccgcttcacctctcagaggtacgaccagggcgggaacttcacctcggagatgatcatccacaatgtggagcccagtgattcggggaacatcagatgcagcctccagaacagtcgcctgcatggatctgcttaccttaccgtccaagttatgggagagctgttcattcccagtgttaatcttgtagtcgctgagaatgaaccttgtgaagttacttgtctaccctcacactggacccggctcccggatatttcctgggagctcggtctcctggtcagccattcaagctattattttgttccggagcccagcgaccttcaaagtgcagtgagcatcctggctctgaccccacagagcaatgggactttgacttgcgtggctacctggaagagcctgaaggcccgcaagtctgcaactgtaaatctcactgtgattcggtgtccccaagacactggaggtggtattaatattccaggtgtattatcaagtttaccgagtttaggtttttcattgcctacttggggcaaagttggacttggactagcaggcaccatgcttctgacgccgacgtgtactcttacaatacgctgctgctgctgccgccgtcgttgttgtggctgcaactgctgctgccgttgttgtttctgctgtagaagaaaaagaggatttcgtattcaatttcaaaagaaatctgaaaaagagaagacaaacaaagaaactgagacagaaagtggaaatgaaaactccggctacaattcagatgaacaaaagaccacagaaaccgcttctctccctcccaaatcctgtgaatccagtgatcctgaacaaagaaacagtagctgtggccctcctcaccagcgggctgatcaacgtccacccaggccagcaagtcatccacaggcttcttttaatctggccagtcctgagaaggtcagtaatacaactgtagtatagcaaagccttccccaagctccactgagcacttggctgacaattcaaaacacggcgatggcatccttcctttccatcctaagactggcctgcagctttgccaacattacctgaagaggagatgtcggagtcatcagaactgatacttgacagtgagagaaggaatcgattttcccagagttcaaagtagaatgtgacttttaagaggtttcatggtttttgtgaattccatgaagttactaagtaaaagctgcaaattcatcataatttttctcaacattcaacactcctacttgttaatccaacaaatggtagataaaagtctgtattctaccatgcctttcaaaagtttttattatctgaaagcatatgaagatgatatttatgtatatttaatatgtaggggtattattacatattatcagtgaaatatgagtataaaaattagggtcaaccagaaatctgcaattgactgtcaaaactgagctcagttaaagtaagattcaattctaacatggatgtgcacgttcctaaatatcttatgattgaatatttacatgaaggcattcatttttatctgcccctttatcagacctatttgcatctcctcaaatgaattagatgtggcctatgctttgcagaggatggacctcacctactccgcacaccgtgaaaaaactggaaatgggcattgtagtctttaattaataaaaacaccaaaaatgtg

SEQ ID NO: 1105 - DNA, 2151 bp, Homo sapiens
agacagtcacagttcgctggagagaacaaagccaactgttgtaggggtggatactcacatggaacttgatgaagttcattgctgccctggaagagattcgggaggaggcttcatcaaaggtcccatgctccagggactccagggtgagggtaaactggccccaatcccaaaacccactcttccctctccctctcgcctcaccctgttcgtatctagttctcaaatggaagaccatgggtttccagccaggagaaatggattgacccaagcaagcttcatctaccagatgcccgcaggctggggcagtcccggcggcctcttcctcccttgccagccagtgccaacccccgtggttctcaagcctccgctgccaccctgtcccatttcctggggagagtctggccctgctgtggatggaatccggaggaccccagctccctgagcagcccctcctctcccctggtgctgatcagaggtccttgggcagcatcagtcaaagcaagagcgcactcactttggagtcgctcacgaccaggacgcagagaagcaggcgcgccagcagggctctcatggtggcgaggtcggggcgctagacggcggctctgcaaaggaaggagaagtcagggcaagaggcggaggaacgggaaggcaggccaggcgggcgactgcagcgcaggggagatgcccgcggtgaccaggctccccagctgtctctctcctctctgggctccggactccgggcagcctggatcggcacccgcgggggacgcccgggacggggcgccttgactccgtgcagccgccggggagcccagggagcccgggcagcccagggcgggggaggcagacgctcgggagctggggccgccgcgcatccggcccggggatctcaggaccgcggcactcaccagtggctgcggcaggagggcgcgagccggcgctgcggggacaggtggaccctggcccgggctccggggctgcggtctccgcactgtgctgcgacccgcggcgcctgctctatatcagggcccgccccggcgccgcccctccctctcccgcccggctccctcccctgtcttgcagcgctcagcgacccggaccccgcgtgcttccgcaacgctcacaaagatttgggggaagcgcgatctccagcggaggggacccaacagcgtctggactgaggaatcgagaggcttgtaaattctccgtgcttcctcccatgcacctggccgggggcctgccccagtgcaaggagtccccgaattgcagagaggagagaaggcgcacaggagactctctacctcgcccagctctgaagcctcctggggtcctctaatcagttcttctgcaacttctccccgctgggccccaacttgcctaagactgcctcagacccccttgcccgcagctgatggagctgtgaagtcttcatcaacgcgacaaatgtacgagacatactctcccagaagcacagacagaaaaacccctgcctgtaggggctccctctgtgcgtctgttcagtggcagtccccagatatcaccaacacaaccagtggatggaacaaagccgggcttattgctttcggcagtaagggggtttgtttgatggtgctatcagagggggaaaggcaaggccagattactgaaaatttgcagcttggtttaaagtccgtttttgacagggcttgataaggattgggttaggtgtcgtgatatgacgttacaggattgtggggacaaagtcctagggcataaactgttggtgcttcctattgaagtgttaacgggtcttttgggaagtttccataatgagcaattcatttatttgtgcaggcaagaataaaagtaaagacaatggaaacatgtagacagttctaactgtggaggttctggagggtgtggaagttctgttctcacctctgagtagaggaattgggagactggaggacaaaataagaggaagatttatttttcactgtttgtccttttacactcttaacattttaaaaagcacatctctgtatagcccattccaaaaagataattatgcattttttaatgcatgtgtatttagtgttttacttcatcatagagccttgtttattctattcagatagaaacaattgtttatcaaataaaattgtcctccag

SEQ ID NO: 1106 - DNA, 1672 bp, Homo sapiens
taacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcaaaatgtttgttgaataatgcattacctgtcaaagaaaaagaagacatttttgcagaaagctttgaacagctctgccttgtttggaataattctttgggctctattggtgtaaatttcaaaagaaactatgaaacagttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttcatgttcc

SEQ ID NO: 1107 - DNA, 1723 bp, Homo sapiens
atagcttgagcctgtgagatcgagattacagtgagctatggatcggccactgcactccgggctgggcgacagagcgagaccctgtctcaaaattaaaaaaaggaaaaaaaaaaaaaaaaagtctgcgctccccggggcccaaggagaggacccaggagaggagtctggctccttttgcctcagacgagtccagggcgccgggttaactggtctaaagtcccaggcgctttctgggactgctcagccaccggccgctcccggcaccaggggacgccggacgccctctggacaatcggcgcacttgccacgatcttggacgggcctcgggcctcgaccttaagattccccgctccagctccgagatgtcagcaacgctgatcctggagcccgcgggccgcggctgccgagacaagccggtgcgcatcaccatgcgcggcctggcttcggagccgctggacacgctgcgcgcgcgtccctgcgcgacgagaaggctgggctcttccgctactgcgccgacgcccgcggcgagctggacctggagcgcgcgcccgtgctgggcggcagctttagggggctagagtccatggggctgctctgggccctggaatccaagaaacctttttggcgctttctgaagcgggacgtacagattccctttatcgtggagttggaggtgctggacggccacgaccccgagcctggacggctgttgtgacaggcgcggcacgagcgcgacttcctcccacaaggggtgcggagcgattcggtgcgcgcgggccgggtgcgcgccacgctcttcctgccgccaggacctggacccttcctagggatcattggcatctttggtaatggagggagcctgttggaatatcgagccagcctccttgctggccatggctttgccacgttcgctctagcttgttataactttgaagatctccccaagaacgtggacaacatacccctggagtacttcgaagaagccctatgctacatgcttcaacatccccaggtaaaaggcccaggcactgggctttggggcatttctctaggagctgatatttgtctctcaatggcctcattcttgaagaatgactcagacacagtttccatcaatggatccgggatcagtgggaacagaggcataaactgtaagcagaatagcattccaccattgggctatgacctgaggagaatcaaggtagctttctcaggcctcgtggacgtcgtggatataaagaatgatcttgtaggagggtataagaaccccagcatgatttcaatggaggaggcccagggccccatcattttcattgttggtcaggatgaccataactggaggagtgagttgtatgcccagtctctgaacgattacgggcccatggaaaggaaaaaccccagatcatctgataccctgggactgggctttacactgagcctccttacttccccctgtgcccagcttcccttcacaaattactgaacaaacacgtgatatgggttggggagccagggctcattctaaggcccaggtagatgcctggaggcaaattctagccgccttctgcaaacacctgggaggtacccagaaaacagctttccctaaattgtaatgcgtttgtctgttgttgacatgagagagtcaagatcagattctagtgttcaataaccctatgtgaatcagctgtctcctggataacattaaagccatgtctttgtcatt

SEQ ID NO: 1108 - DNA, 1402 bp, Homo sapiens
agaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttgaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccaccacc

SEQ ID NO: 1109 - DNA, 2294 bp, Homo sapiens
aaaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggtctgaggaagccttgccgggtggggtgtggcaggctgggggctgggatgtgatgggtgtctctgctcaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacggggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggaggccagggccggcttcaacagcagctccacctgtggttgtgcccacccgtcgcatcaggcaagatggcccatggtggtctagtcctgtggctaatgccctgatgagtgtcactggcccagtcctagatgccccgctcttctcccctgctcatgggtgctcctcctcagggcctccattgagcagctggggctgggcagccggcgcaaggcagcactggtggtgccggcatttgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatc

SEQ ID NO: 1110 - DNA, 2374 bp, Homo sapiens
acctgattccataagacattcatcctcccggaggcccgcgccgccctcgccctgcacgcctagcgttgtcccgcggccaggcccggccggagcggcggcgcctggatgtggacctggctgcggggagacgggcgccggccccaaagcgactttcggtcctcgacgcgccccgccccacccctgcgatgaagagggcgtctgctggagtccaagggcagcctggacccgctagataagccgctggacttggggccggcgctgcccccccaagatggaggctggcacgttcagcagtgacctgcagaccccacgcccaggcagtgttgagagtgccctgtcggtgcagaggaccagcctccgccaccccccgacgcctgccatgtacaagtttaggccggctcacgggtcctaaggcaccttctgtggatgaggcgagcaggttccaggccccgattcccttatcctgggggacgacagcatccatagcctggactttgtgtcgagccgagcctggacttccctgactatgggcccgggggcctgcacgcagcctacctgccatccccaccgctcagcgcctctgatgccttctcattgctttgtgctccctgagcctcaaggcctcaagccggcagggcggggactacctggccctgcagcccctgtgctccgagggtgggcctcccatgccccaccgtagcatctttgcccccccatgcactgcccaaccacaatcgcagcctgtcctacaataatgtgctcaaccctggctcgcctggtggccacgcctgcctcgcccatccagcagttggcgtggccggataccactcaccctacctgcaccctggggcaacgggcgacccaccatggcccctgccccacagcttcagtcccgtgctgggcccccggccccaggagccctcgcctgtgctctacgacatcctgtccaggaccatcatggcatccatccaggagcgcaaggacagggaggagcgtgagtgcctgctgcgctcccaggccgactcactcttcggcgactcaggcgtctatgatgctcccagctcctacagcctgcagcaggccagtgtgctgtctgagggcttccgaggtcctacgctgtgctacagctctacagatgaccttgtggccaggcccggcttcggcggcgcctgcaaccctgtcctgcagacatcattgtcctcgctttccagctccgtgagccgtgcactgcggacgtcgtcctcctccctgcaggctgatcaggtggggaagctgaggcaggaagccctttagtcacttgccaaaggccacgctgttacccatgggaccggttttgggcggccgaagagcactcatccgacagtggggccggattcacgccccgggcccgttccctcctgctctctggtgctcctcacgccattggccccactgcctctcactgcccgtgagtccctgtgcccgtgtcctccttcttgaacccctcagccctcagttaaccctcagaaagctggctcggagaagtccttgtgtggtatctgggaggcagagtttgccgtaagccgagattgtgccactgcactccagcctgggcgacagagcgagaccccatctcaaaaaagacgctcacgggactagaagcgtcttaccctgacctcacacctgctggacatcaggctggggagagaatcggggaagagggcattttccaacaggactggaaggccagtcgtggtccttggtggtgagagttagccaggccaccggccttctccccgtaagcctgcagggtcccctctgatccctgcacctctagggggtcacaccaactgcgggtgtttcctcaccacgctgggcgcttggtgagcacgttctgccttgagacctggcatttctttgataacatttcttctcgtttcctgctcattctggaactcctgtcagatgttgggccttttggatagattctgtgagtccttctttctacctttgcttgtagataagactttccttgaatccaaacacacacactctctctgctttttaaaaaattagttttggggctggatgtagtggcttacacctgtagtcccaggcactttgggaggccgaggcaggcagatcacttgaggtcaggagttccagaccagcctggccaacatggtgaaaccctgtctctactaaaaatacaaaaagtagctgaatgtggtggtgtgcacctgtaatcccagctactcaggaggctgaggcaggagactggcttgaacccgggtggcagaggttgcagtgagccgaaatcacaccactgtactccagcctggtgacagagccagactctgttttaaaataaataaaaataaaaaattggttttgg

SEQ ID NO: 1111 - DNA, 2031 bp, Homo sapiens
ctaaagaagttgaactcacagaaatagagagtaggacagtggttatcaggggctggggtgaaggaaagggaggggataggagacactggtcaaagggtacaaagtttccaataggaagaatagttttaaacaagctaaactcctctgaaagctcagttcctcatctgtagagcacggatacatcattaaccttctaaggatgttgctgtgagagtaagagatgatgttcagcacaatacctaacgcacagtcaggtctccttaagcttgaacctgcatcgccatgacctctacatctcaggacagaaaggctcacagccagtgtctcagttcccaatgaaaagtggatcccagaccaggctggacagcaggatccctaggggataccccaccctactgagtcagaatcaatcaccagaggtagaacctgggtatgtatgtatgtgtgtgtgtgtgtgtgtgtgtgtgtgtgtgtgtgtgtgtgtgtgtgtatgtacaagagacagggtcctgctctgcagtccaggctggagtgcactgtcacaatcatagttcactgcagcttcaaattacccctggtctcaatccatcctcccgtctcagccttcagagtagctgagactacaggcgcatgccaccaagcccggatactttttttttttttcttccttttggagagagtctcactctgttgcccaggctggagtgcaatggtgcaatcttggctcactgcaacctctgtctcccgggttcaagtgattctcatgcctcagcctcctgagtagctaggattacaggcatacaccatcacatcagcgtaattttgctctttcattgttgtttcttgtttgtttttcacaaataggactttttatttggtactgttttaagtctgaactttaaacagattcttggactggtggttcctatccatcagctcattcaactttagcatgtgtctcgtccctagtgggttttccagaactactacctccaccacgaagctccatgcctttcaaacccagggttctccagcatttttacttttctaatgaagacatcatggagaggataaattggaaaaccttttctgtatcttttccaatgttgtctggaatcaatttattgaccacttctttcaagtcatttgtctgcacctctcaggtcatgatttccatcatcttcttctggatttggcagactgttggtgctaagcataagaggtcttcagtatctgattgttgtgttttttagtaaaaccaacacaaaacagatgaaagaagtaaccatcggtagtcctgacatcaacatgagcttcaaccatcgttgaacatttttcaaccatggaacatattttgtcacaggtaagacccatgccatagaaattagtcaggcagtttttgtcctgaacatcttcagtaatcagcttgaattttctaaatgcaacttcatcattctgcaaatcagcaagactcacttcaaacagaagacccttgagaccatcagatgcaatttgggttccttgggtcctggcgaccaagtctttccagtatttcttatattgaacatagcaggtgctttcacatcatactgatctttcttagagaatggaccaactactttcttcttaactccctttttgccacctttcataaggcacttgttcttaacaaccgccatggtgctgcttggagtaccaaaaggctaaattttatatttttggtagagacgggatttcaggatgttggccaagctgctcttgaactcctgatgtcaggtgatctgcccgcctctgcctcccaaagtgctgggattacaagtgtggaccactgcacccagctgttatttattttttctttttttgtacagacagggtcttgccatgttgccaaggctggcctggaactcctggcttcaagcaatcctcccaccacagcctcccaaagcactggggtttcaggtgtgagccaccatgcccagcctggaatctatttttaaagccaatcaagcgttgaataaaattgcaacttgg

SEQ ID NO: 1112 - DNA, 3204 bp, Homo sapiens
gaagtgccggagcggctgacagagcggctgacggagccgggctcaccaggtcgctgctgcgagggagttgctgtgctggggcctgggtggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagactaacgtggggcaggatggacggcaagcgcttgaagaggctcagaaagctatccaacaactctttggcaaaatcaaagatatcaaagacaaagctgaaaaatcagagcaaatggtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaaggaaacccaaaacactgcagctgcatggattgaactggacgtgatgtgaaatgaaataagccagacacgggaagacagattcctcatgttctcactcatagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctgtataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatacgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacaggtgagatggacgtagtatcaggcatttgcctggcagcttttgttgtagatcaagcacatattcttctagtccagatctacttggcaggaataaaattgatgatgtcccctgtttggggacagtataatgactcacccggaaggtttcttaattcgttcttccatttatttttaaaaattttgtttgaacgcctactaagttctgggtgcagggtataacacagcaagcaccatggaaaggtccctgctcctagtgctcacactccaataagaagaagtggctgggccgggcacagcggctcgcgctgtaaccccagcatttcgggaggcctgggcaggcagatcacctggggtaaggaatttgagagcagcctggccaacatggtgaaatcccatctctactaaaaatacaaaaattagctgggcatgggggcgggctactggggaggctgaggcaggagaatcacttgaacccgggaggtggaggttgcagtgagccgatatcacaccactgcactccagcctgggtgacaaagtgagactccatctcaaaaaaacaaacaaacaaaaaaactagcaaaaaacttggaatattggccgggcatggtgtctcgcgtctgtaatcctagcactttgggaggcccgggcaggcggatcatctgaggtcaggagttcgagaccagcctggctaacatggtgaaccctgtctctactaataatacaaaaaattagccgggcttgatggtgggcgcctgtagtcccagctactcgggaggctgaggcagaattgcttcaacccaggaggtggaggttgcagtgagctgagatcacgccactgtactccagcctgggcaacaagagcgaaactccatctc

SEQ ID NO: 1113 - DNA, 2228 bp, Homo sapiens
ttcagtggcggtcatttttgcagcgcttgggtgcatccagaccgtcagagctttgggagcgctttgtttggcgacagtcggaaggcgcgaggggaggggtcctcccgctgaacagtgggggttctaagggtcggcggcggcggggttgacggctttgcctaggtccctccgcccgtagctgtcgggtcccggccccgctctgcccacagactccgatggctgcggccgcgctgagggccccgactcaggttactgtgtctccagaaacacatatggacctcacaaagggctgtgtgacctttgaggacatcgccatttacttctcacaggacgagtggggacttcttgatgaggctcagagactcctgtaccttgaagtgatgctggagaactttgcccttgtagcctcactgggttgtggccatggaacagaggatgaagagacaccttctgaccagaatgtttctgtaggagtgtcacagtcaaaggcaggttcatccacacagaagactcaatcctgtgagatgtgtgtcccagtcctgaaagatattttgcatctagctgatctccctgggcagaaaccatacttggttggagaatgtacaaaccatcaccagcaccagaagcatcacagtgcaaagaaatccttgaagagggacatggacagagcctcatatgtgaagtgctgcctattctgtacgtcattgaagccctttcgcaaatgggaggttggaaaggaccttccagccatgttgcggcttctgaggtccctggtctttcctggaggcaagaaacccggcacaattactgaatgtggggaggacattcgcagtcaaaaaagtcattacaagtcaggtgaatgtgggaaggcttccaggcacaaacacactcctgtttaccatccaagagtctacactggaaaaaagctttatgagtgtagcaaatgtgggaaagccttccgtggcaagtactcacttgttcagcaccagagagtccatactggagaaaggccttgggagtgcaatgaatgtggaaaattctttagccaaacctcccacctgaatgatcatcggagaatccacaccggagaaaggccttatgagtgcagcgaatgtggaaaattatttagacaaaactccagccttgttgaccaccagaaaatacacactggagcaaggccttatgagtgtagccagtgtgggaaatcctttagccaaaaagccacccttgttaaacaccaaagagttcacactggagaaaggccttataagtgtggtgaatgtgggaattcctttagtcaaagtgccattcttaatcaacaccgaagaattcacactggagcaaagccttatgagtgtggccagtgtgggaaatcctttagtcaaaaagctaccctcattaaacaccagagagttcacactggagaaaggccttataagtgtggtgactgtgggaaatcctttagtcaaagctccatccttattcaacaccggagaattcatactggagcaaggccttatgagtgtggccagtgtggaaagtcctttagccaaaagtctggtctcattcaacaccaagtggttcacactggagaaaggccttatgagtgcaacaaatgtgggaattcctttagccaatgctccagcctcatacatcaccaaaaatgtcataacacatagaggcctcatgaatgcagcaaatgtggaagcgccttcaactcaagatctatcatcatttagctcctgaaagtccacacttaagtagagccttagacctacagggaaagtgctgtctctgtagtattgtagcagtagagagcctttgtgagggagccatctgcctgaagttgaacctcattcttccttgtttctctggtagaaaccatctaccctctaccaccttgcacagtgggcactggtcactcctatgtgctaagacaaggcagacatctgtgtgttctcttaagtctttggaggaaatcttgagcagtctaagcctttagagaaaattcattcttttttctgactgatcacagcatacgtgtgacccagtttgggtcaggagggcccagccttggttctgctggacacttatgtgcaaggattcccttcatgtaaattcttggtctcacatgacacttggtcattcttccagcctccatgtcaccacgtggtgaatggctgcctcacattgctccagtttgtgcactaataaaagccttatatttg

SEQ ID NO: 1114 - DNA, 2680 bp, Homo sapiens
gtgcggaaggggtgcccgggacgaagccatggccctggaggcggcgggagggccgccggaggaaacgctgtcactgtggaaatgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcagcactttgttgaacgtggtggtgagagcacacgtcctcgtctcattcctgatcgaacgcggtggtgagagcacacgtcctcgtctcgttcctgatcgaacgcggtggtgagagcacacatcctcgtctcgttcctgatcgaacgcggtggtgagagcacacgtcctcgtctcgttcctgatcgaacgtggtggtgagagcacacgtccttgtcttgttcctgatcttaagggaacgtttgcagtctttcaccactagatgtgatgtgagctgttagattttcaaggatgctcttcatccagctgaagacggtcccttctagtcctaatttgttaagtgtttttatccttaaagggtactggattttgtcaaatgcttttctggcctctattgaaaagatcctgtgttcttctgtgaatatgaggtgttacattgattgattttcatatgttgagccagtttccatttgtggaatacatctaactcggtcatggtgtataatccatttactctgctgctgaatgtgatttgcttgtattttggtgcggatttttacatctgtatttataagggatattggtctggtgttttcttatgatgtcttcctttggttttgatatcaggataatattagcctcatagattgggttaggaaatgttctctcctccgttttttttggaagagagagattggtgttaattcttgctagaacctttggtagaatttgccagtaagcctatctggtcttgggtctttgggaggattttgattcgattcaatctatgtatttgttatagatcgttcggattgtccatccttgagtcagttgctagcttgtgtgtttcttggagtttttccgtttcgtccatgttatctcatctgttggcataccgtcgttcacgggattttattgatgtgtgtgaggtctctgagaacgtccctgccttcactcctgcttttagtcactggcatcttcttttaacttgggccatctggccgtgcatggttttgggagagtcctccttgactctgcagatgctgagcagtgatctggctgggaaaggggaccaggagtgcagggcacctgctgaggactcacctaagcccaagagtcagagagtcggagctccaaccacatctgcctgcatgcctttcccaggctctccccaggcggacagccagcaccccctccccaaagaccgggcagttcctgaccagcaccccaccaagtcctcagtaaggcctgtctttgggggagcagggtttcaggaggacagtgggggtggtgtagaactcatggctggcggttccgggcctctcaggaagctttgccactgggcttggggttaagtgggtgtggggctccgaaccctaaatgggtgagagttgaaatgaaagcggcacctgtagtccgtttggggtgcaggtgtgtgccaggggtcttcagccccggctgatggccacatgaaccacatgaggagaggcagggcgtgtcagcagcaaacctaagtgtgtgctcatttctgtgggcccttactctgtgacactgcagctctccagagagacgctttgaaaacaaaacaggaaagaacacacggccccgcgtctgttgcctgagtcactgtattccttaaaaggtgaaggaccctggtccttggcttttcgtgcacatgagaaaatgttggccaaggttagcgattatgcttctgtaatctgtaaccagaagtgctcttatgcccaaaccttgatgtgattctgctgtaatgtaacttcggagccagctggatggatgtgactgtgcaggtcctgagccccggcccccgtaaccaagcagtgggccgagacactgagccgggcagtcaaacaggagctctctaaggctgctcccgggctgggacctgggtctaggattctcagtaagacctttgaataaaactaacttgaattctt

SEQ ID NO: 1115 - DNA, 2986 bp, Homo sapiens
ttgttagcaaaaccatctcttgagtggagctcaaagatttgtaatttcccactccccagaaagataacttcagactcagcttagaagtaaagatcctccagatatggcctcaactaccctccaacccatgtccccagtgcatccctttgatgcccccttcagtggagttaaaatggagtgagtgtttttcttttcacatactcctggtgttcttccacaaatacaattttcacctcttgaatattttcaaggattctccatgctacacacagagaaatccaaactccccatcaggaccccagtcttcccaaaccctctttgcacttttctgcctccatgcttttccctgggtcatcctcttctctaatataaccttgtgtattattctaggttctccagagaaagagcagagagatagaggtagagatatacacatagagagagacagattgatttgttgtaagggatggctcacctggttatggaagctaaggagtcctggagtctgcagccagcaagctggagacccaggacagccaatgatatagttccaactcgagtccacatgtaaagtcaggagaagattgatgtcccagctcaaatataatcaggtaaaaagagcaaattctctgtgattctacctttttgttttgttcaggccttcaatggattggatgaggctcacccacactggggaggacaatctgctttattcagtctaccaattaaatgttatcctcatccagaatacctcagagacacacccagaataatgtgtagccagatatctgggcaccccacaacccagtcaaattgatacataacactaaccatcatgtcttgcttctactctcttgccatttctgcatggccaaatctttcccttatttcaaggcttagttcaaatgttacctcttaactaagccttccctgctaaccccaaatattaatagaattggtttctcccttctctgatgtctcaaaatatattgtgtttctcttttattgtatttattacaaactcccttacaaatcaagacagtgattcccagacaaattatcacgagagtataaaagaagtcttctttgagtgtgaaatatctcatggaatatagcacatggcctcttcatgaagaaactactgggagagaagaagacaagctggaagaggccagggaaagggggttagtacaaagcacaatggggctgggctcatacagtggctcacgcctgtggtcccagcactttgggagcccaaggccggtggatcacgagatcagcagatcgagaccatcctggctaacacggtgaaaccccgtctctactaaaaatacaaaaaagttagccaggcgtggaggtgggcgcctgtggtcccggctgctcgggaggctgaggaaggagaatggtgtgaacccgggaggcggagcttgcagtgagccgagattgcaccacagcactcaagcctgggtgacagagcaagactccatctcaaaaaataaaataaaataaaataaagcacaatgaaatgtcagtggatgggtgcctataatttctaagggaaatagagtataatccaagaattttatagccagctaaattattgcccaatcaaaataggcaaaagacacatgctgaagaacttaaagaatacagtatttctgagctctttaaaaaaaaaagtcttcataataaaatttagtcagccaagaaattaaaaaataagcaacttgtgaattgaatgaccatgacaaaaggctagtgataggactatgattgcagaacagaaagagaaggtggtcaaccttaacaacataaaacaacctagaaataactagtttccacaggtaaagagagggactgtaggaagtagaagtgctaatgccctttattaagtcaattaatcaggtctaaaattgaaacgtgattttaaatatataacttcttgtttattttcctccctaactacctgaggatcaaccaccaacatgaatgacacagtgactacctggaccaggaagttcatgaccaatcgaccgttccagaggaaacaaatggtcaccaatgtccttcaccccggaaaggcaacaaaatgtacaagaccacaatggatgtcatcttcatattaatagttggactcagaacccattttggtggtggttaaacaatcgtcacccacattggagtgcagtggtgcgatctcggctcaccaaatctctgcctcccaggcttaagcaattctcctgcctcagcctcccccgcagctgggattacaggcgcgcaccactactgcctggctaatttttatgtttttagtagagatggggtttcaccttgttggccaggctggtcttgaactcctgacctcaaatgatccacccgccttggcctcccaaagtgctaagattacaggcatgggtcactgtgcccagccttttctgtattaaattttttaaaacacaacatttaaaataatcaagtcattctttttgaatctactttgtattataggtatccaaatactcacctattctctctcacatgatgacaaactcgttgaaatgtcatttcattttgtggctccagccccagggattctgagtctgattctaaagggcctgcatgcagagcaagcaagccgcctggatgattctcttacaggtgttttaagggcatcagtttgagacaccctgatgcaaaagaacggaccctcaaggaagttggctgtacatgtattttccttcctagcacaggaaaagacagaaagattatccaatcagcaccactcctagcacctgattatatatgtatgaggaattcagaaatggtttgatcaaggttgaagacctaaaaagtagcttttctctcggacaccaagtccccatctcatgcgtggttgagttagtagaatctgaggatgatgcttcttcctccaggattggtatcctatggtttttgttgttcagtaaatgaagtacctccatccccc

SEQ ID NO: 1116 - DNA, 2409 bp, Homo sapiens
aaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcctctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgac

SEQ ID NO: 1117 - DNA, 3885 bp, Homo sapiens
agggcttgcctgtggagaggctggagtcagccgtcagcgcggaactcctggtcttcccactgccacctctgcagcccccaccagagatatcagaaaacatcagctccagcctgcagcccagacacttgaagtcaccttggctgcccctcctcacacccgtgcccacgtcagcaaaaccagggccggcttgttaaccgtgtccagaacccacccttcccaccctgcccaggccacctccctcagtggcccagggggctccaagttgaagagcccaagacaggtcagagatgggctgggcggcctctgccactcacctccggagagggcagggagcagaggcctcagtcatgaggtggggctgtcctcggcgtgggcctcgagactgggagccactgcccatacccaagagacctctgcgagcactggggtgcagagccagctctgagaaaccaggaggctgggattttgaagaggacgccggtaaacaggctcagctgtgggccaaggaacgcgaaggacacagggcagagcgcccacaggacggacgacgacaagcgacacgaggcccagcgctgccccctcccgcctcctgacagcccggaccagtctctgcagtgccagggccaccacacagatgcctcctccacacactctggtccgagggtttccgggccctctgcccaggcgccgaggctggagagctcctcccgggccacaactggtcactggcgtggtctctatccgcctcgggcttgacggtttgaccaggagaaggggcgtggggcgggtgggccacagggggcaggccgtgggacagggacatggcgctggggacgataccttccacagcagctgggatgccagtgggggccacgcccaccacgcccggagggtacctgctgggagagggtccatccgtgaggcccacctgtaggcggcctggccaggccccacctgccctcctagcatcggcagcaccgagggggcctctccaggaggaccagcagtcagggccccgtgcccatggcactcctgtgtccactgagccctgaaggccaccccagcccaggctccttccaagaggccctggttctcatgggcctttcagctgcagatgtcagaggccgacctgagcacagccctttccagctgcagatgtcagaggccgacctgagcacagcccgttccagctgcagatgtgaaacctgaacctggcagcacggaagtcacaagggccgacccaacgcccccagaagtagagtcctgtgtccccggctccacgcacctgcttgacggtgaagtcgttgatgaggtggtggttgtgctcgttgaggccgcagtgcagggtcacgcagtcgctgtggaagagcaggtcctgcagggtgctgacacgctgcagccccagcgcccgctccacgccatccgacaagtaagggtcgtagaagagcacgttgaagccgaaggccttggcccgcagcgccactgcctgccccacgcgacctggtggcgtcaagacacagtgtgagacccttgctcacccgtggccgggaggccggccccgaaagccagggtcggagtggcctctgtgcctcagtttgaccatctgccaaggatgacaccagctgtggtcaagccaaggtgcccacgcacgctccacacgagcgctccacgtccgctccaacgcgcccactgccaaggcggaggagatgcacaggggtggaaagggtacactagcccctcggcccacaccagctgccagccacaccactcccctgcagcctgtccacaggacgtgacatgaaccactcagtgtcaaacggactggtcagtgggtctccacccacccaacacatgtcctccgtgcccaggcccctccgctggcctttcgatccacccatcaatgtttccggcatctcaattccagccaccactacgtggagacggcaaagggggcaggagggaaacttccagaccagggaggccccgctgggctcaggtcctgaccccttcgagtggagcggcagagaaagccatcccaggcagacgtgcctgcccccaccccagcagtccaaggctggcacgggtcccagcacaggagccgtggagcttgagccaccgtgtctggctggggccggctcctcctcggggaagggtctgcagagtgctcgtgcccactgtgagccaacagcatggctgcaaaggacacaggaccccaagcccgcgaacgtggtgtctcctgcattgcctcagagggaaccgctacacaggaaggaagcaggttgagcgccggggcgggtgggaagtgggcgcagtttcaaaggcggcagccagggcaggcctccctgagaagaccaagcttgctggagacataaggggacaggaagggagccagagagctggaacaacacgtgcgaggggcccgcggcggcctgagggccaaggagaccagaccgccaggcacacagggtggccggacgtggcccaaacgcccaggggacccccagtcactctgggaagaggactgggggaggctgggaggccagtcagaagagctgaggaccgtctaaacgcactacatcctagaaagggaggcgcctgttctacgagaaggaacatggtggctccttccatccccagggacgaggctgctgcaggagggaggagggctcggcaggcggaggtgggagcagcagttctgagggttgcagccacggccggagtacccgggcagctccccaggtgcagaacagcccgtctgtcaacgccccctgccagggatcccaccaaatggggaggaagagaacacaggcagacacagagaaaggcgtctcccacagcgcagaaggcggacgacacgctgtttcccactgcgcacaacacaaagccccggaagtcgggctgccggtggcgaaaaccagctaaagccgcgggccggcgccggccacgcctgacacgggagagcagcggctgttcggggcgagaccattcttcacttctgtctctgccattctcttccacatgatgtctggcttaggataagaaattatgatgatgcaggtgaagagacaggaggatgtagtttctaattagaacaaaacactggaagcggacagacgcacagatgaccgaggctggaatcagccagcaaaacctcttaataactactataaacatgctcagagatgacaacaagtgtggatgtaaacagcagaaaaatggaggcttccggaagatgaatggtaactctataaagaaccacatagaaattccagaacgaaaacatccctctgaaacggaactccctggacaaagctaactgcaagaaaaggatcgggagcttgaagggaggggctcaaagtcagcagatggcatccaaacagaagcagagagaaaagaatttaaaaaataaattttaaagaacaggccttggtggctgacgcctgtaatcccagcactctgggaggctgaggtgggcggatcacaaggtcaggagttcgagaccagcctggccaacatggtgaaaccccgtctctactaaaaatacaaaaattagccggacgtggtggcgggcgcctgtagtccaagctactcgggaggctgaggcaggagaatggcgtgaacctgggaagcagaggctgcagtgagccgagatcgcgccactgcactccagactgggcgacagagcgagactaccttccacaaaaaaaaaaaggcaacacattttcggacaaagaaaagcaaaaggaatcggtcactggtgagccacatttctaagacagtctttaggctacaggaacgtgacgcccgaggacagccagaatcggggggcgtaaacaaggcagaaagggtggatgtgtcggttgatattcaaaagaaaaattactg

SEQ ID NO: 1118 - DNA, 2278 bp, Homo sapiens
tttatccatattgtctcaaatgaccagatttctttcttttttaaggctgaatagtattccattgtacatatatactacattttatttatccattcatctgttgatggacacttaggttgattccatatcttggctattgtgaataagctgcaatgaacataggagtgcagatactgctttgacatattcatttcattttctttggatatgtatccagaagtggaattgggctggaatataggcagttctatttttaatattttgaggaaactccatattactttccataatagctgtgctaatttacattcccaccgccaatgtataagggcttccttttctccacatcctctccaacactggttatctcttgtctttttgatatgttttctcttctctgtaaagctattggttgtagcattttactttttccaaatttttttaatcaaacttttgaaatgtatagctgaaatgaaagaattttagcatgaatgctaatatacactcagcacctatattcttgctttttcatgtatttactcctgaattaatatattacttgttatatgcttttgaaagtaaactgcaaacaagtgcatgcttctcctagatctttccacatgctctgccattaattagagttcaatgttcaattttttccttttgatgtacaattaatacacaattaatttacacacacattttacttagttctgaaagatgtatatacttttataacccaaagcccatcattatacaacattactatcaccctagcaaaatcttttgtgtcccttctcaatcaccaatcctgaccacaccccaagaaaactactgttcaaatttttctccatcattgattggctttgtctgttttagaacttcataaaactaaaatactgtagtaaattatgtacaattttatgactagcttcctttgctcaatataatgttttcgagatttattcatattgctgcatgtcagtagttggttctttttattgctgcatatttcattgaataaaaatgccaaagcttgtttattcattcttgtctcacatcaaagtatctgggggatgttttccacttttggctattagaaatgaaacagatttgaatattgtcgtacaggctttttatgcatatatatgccttctttgagtaaatacccagaaattatgttactggatcataggttaatatatgtttagttttagaagaaaatgctacctcttttttccaaaatattgtcccattttacactcccagcagtaatgtatgagatttccagttgctgcacatccttaccaaaaattagcttttctaattttagtcattgtaaggggtgtgtagtggtggctctatgtagttctaatttgcatttctctaatgactaacgatgttaaacatatttttatgtacttgtttcatgtacttgttgatatgtctattcaattcctttcaccatttttatggagctgtttttttattattgagttgtaggatttctttatatatgctgcataccaggcctttgttatatacatgctttgcaatgtacattgtcttaaaatctgtggcttgcctgttcaattcattagtggtgttttgttaagcagtttttaattttgatgaagtgtaacttattcattttttattatggttattgctttatgtttcaggtcccaaattttgccttctcacaaatcacaaacattatcctatgttttccttcaaaaattatatggttttatgtattttcaatctcaaaatattctctaatttttttgctgatttatttactaaagaaatttgagggatttgctataatgttagggatttttctagatgccacattgttattgatttctaatttaattatattatgctcagaaaacatattctgtatgctttcaacacttttaaatttattgagacttgttggagggtccagcatataatctatctcagtgaacacactgtatttacttgaaaagatgtatattctgcagttattcagtgtagtgttctataaaatcatttaggtcaaggtggttgatagtttgttcaaatccatctacgtcttcattaattttatttatctggctctatcaattgctaaaagaatgttgttaaaaattgtcaactatgattttagaatcatttatttctccctttgattaatgaatgttgtttcatgaattttgaagctattcagagacaaaaaaaaactatttatgaatattgtcttcctaaatgaactgatgattcttttggc

SEQ ID NO: 1119 - DNA, 2046 bp, Homo sapiens
ctactgtcatacatgctggcgtgcagtagtgggatcttggtgcaccataccaaagtgttgcagcctggaactcctaggctcaaggcatctccaggagcgcgccacaagcctggctgattttttttttttttttggtagacagagtctcgctatgttgcccaggctggtctcaaactcctgagctcaagccgtcctcctgcgttgacctcccaaggtgctgggattacaggggagagctgctgcgcccagcccagtctactccctcgagttccctgtccagagacccacatctggagcagggtggggagtcagagcaggtcccagcccacgctctagggctcagctcagatgatgtgagcctggggcagcacctctgggcatagtgggctctggctggcaggacaggacaggctggcccagatctgggggtctctgctgggtgttagatttgtggagtctttgtgctgcttctggggtggtggggcaattccgggcctctccaggcctgtcctgccttttcttttttttttttagatggagtctcactctgtcagccaggctggagtgcagtggcatgatctcagctcactgcaagctccgcctcccgggtacaagcgattctcaggcctcagtctcctaagtgggattacaggcacctgtcaccacgcctggctaatttttgtatttttagtagagtcaggcttcctccatgttggccatgctggtctcaaattctgaaagaggagaattgcctggacctaggaggtggaggctgcagcgggctgagattgcaccactgcgctccagcctgggcaacagagtgagactcggtctcaaacaaacaaaaaggcaggacaggcctggaactgcccctcccccccaggacgggtgttgtctagggcttgctgacctcacagtctgtgagatcaggcagccccgggccttggctgcccaggagtgaattatttccaggcgccatcatcactccgactatagaatcaacaggatttgacaggtgcagctttcgactgctctgttgagagggtggagacagaagcaaaagctgcccacagaaaggcgacagggaaccccagagctgggtcccaagagcctcttggtgatggaggagagccaccaagggacaggagggttgggggaactggagctccggcccagggacagagccccaaaccacctccagcccaggcacagagccccagaccaccgaagccctatgccaccatggcagagcccagggcagggcaggggtcaggctggcccccccaaacacctccccaccattcccacatgcatacaccaggacctggggggttgcaacagtgccagaggtcacgggttggcaggggagggagaggaggaagaaagcagaagagcagagggatgcgggtgaggctgggcttgtctcagacagtctggcactggccctcaaagctcagaatccctgatatgggggctaagccccactgccatactgcccctcccagggaaattgccccccagggaatatggggggaacctctgagtgtagctcccctggggcctggagggcatatcaagacatgcgggatagtgaacagcatcattgctctaagtgtccctgatctggctgggcgtggtggctcacccctgtaatcgcagcactttgggaggctgaagggggcagattagctgaggtcgggagttcaagaccagcctggccaacatggcaaaacccgtctctactaaaaatacaaagattagccgggtgtggtggcgcacgcctgtaatcccagctactcaagaggttgcagtgagctgagatcaggccactgcactccagcctgggcaacagagcaaaactttcaggaaaaaaaaaaagtgtccctgatctgtaaatgtgtagtggaaactacagaaaggcactgcaggctgggcgcaggggctcacacctgtaatcccagcaccttggggggcctaggcaggagatttacttgacaccaggagttagagagcagcctgggcaacatagcaagaactcatccctgc

SEQ ID NO: 1120 - DNA, 2353 bp, Homo sapiens
acttctggcagcttaggtctcacttaatggctgagggctccaggactcaggcccctgggaaagggcccccactcagctccagttcctgcgagcccagtatgaaggcttgaagaggcagcagaggacccaggcccacctcctggtgcttccaaaaggaggaaacacacctgctcctgcagaatcgatggtcaatgctgtttggattaacaaggagagaagaggctcactgtccctggaagaggcagattctgaggtggaggggaggctggaggaggctgcccagggctgccttcaggcccccaagtctccatggcacacgcacctggagatgcattgtttggtccaaacctccccccaggacaccagtcatcaagtacatcataggggcaagcttgtgggatctgaccaaaggctccctcctgaaggagacacacacttgtttgaaaccaatcagatgactcagcaaggaaccggaatcccagaggctgcccagcttccatgccaggtgggcaatacccaaacaaaggcagtggaatctggcttaaaattcagcactcaatgtcctctttccataaagaacccacacaggtctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcac

SEQ ID NO: 1121 - DNA, 2228 bp, Homo sapiens
ataattcagcggcaacgcagctggggcctggcacacagggtccctgtgatgaggaggggctgcccctgccggaatgcaccagaggctgccaccagggagagagttacaaggaccacttccgtggacctggcaggtcctagggccccctttaaaattgtgcctggggagagtccctggcgctgctccggaggatcatggagcccgactctactcacaggggagaccacacagcttctgcggggcaagacagctgaggagcatgtcaggacagtgccatctgccaccaaggcagctccagagagtgggacagctgtgagaggcgggacctgtccaggctccctgatgggcactcacagcccccttcaccctcagcgaggcacttgccccaatgaaaactgagcagttggacaatctgatgtcttggagggtccagagtctcactctgttgcccaggctggagtgcgatggcatgatctcggctccctgcaatctccacctcccaggttcaagcaattctcctacctcagcctcctgagaagctgggatcacaggcacacaccaccatgcccggctaatttttgtatttttagtagagacggggtttcaccatgttggccaggctggtctccaactcctgacctcaagtgatcagcctgcctcgggctcctaaagtgctgggattacaggcgtgagccaccgcgcccggccatagggcatcctcttaattagagtgtgaggcctgcggatatgggctggggaataagttgatgctgacagaaaataacttaaaccattgaaaggaacaggaagtaaacagaagcaaatatttaccgaatccctggtgagaaggaactttccaagaataaagggaaggatgagttcactttgactgtgtggaagctaaattctcaggtggctcaaaggaaaacatcaagctaaaagacaagaaatgaggcgggtaaatttttgacactaacatgacaaaaaattaatagcattaacacggcaggaacttatctgaagcagcaacaccaagggcaatgtgagtgaactgcagacaaggcaacccggacgccatgggacacgccacagagcaggctgccttgtccccactctgcctacatgtgagacccaccagactcacagtgaacacatcccagcccctccggccgggcaccacggaaggccctccctcctccactgagggcagggatcacagggccaggtttttgtcatcggacaaggggtgtcccaagtcatgagatgcttaacccatgaatgccccctcttggagtctatgctaattaaacacgtagaggggcggacttcactctgccagctcagataatgaccacagcatatttataaccacaaagaggtggaaacagctacactatccaacagtggggaaatgtttaagtcaatgctgggagagtaacaccatggaccagccccgaagagacatctgtggtgagtgaaatgcacgccatacaagcccagagagactgtgaacttggaagaaagaataggtgcacacaataagactgggaggaaatgaacaaactatcatcggccatgaggttctcctttacttacaataagtatatgcagcacagacatgagaaaggcattcctggagtgtgaagcccagggcaagaggatgcgggtgtcctgagcaagcaataatgccagcaccttctgcaaggagctctgctgggccacctcttgggcaacaaaccatcctgggacatcttgcagacaaggaaacaggcttcaggaggcaatggtgcctcttgaagggcagggcacacagccacagggccaccttctgcatggctcccaccgcagctgagtctccaaggaagctgggtttttacaggggcaggtcctcaaggtggatacccctttgctaaaggctctgccccagcaacccacaagcagccacttgccctgggctccaggcggctgccctccccttgctgtcctctggactgtttagtatgcagaaggaccagccctgcaaggccaccataaatcctgcccctgtcctacagcagatcaattgccaatcggctccaaatcccctagatgtctcagcagcttggcccagctgtaggagccacggccatggttggctctagatgctgctggctatatatattgaacttgaagcatcggattacatgtttgttcaatagcaataaactcccaaagttttatggggtcat

SEQ ID NO: 1122 - DNA, 2172 bp, Homo sapiens
gaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggttgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggacaaagaaaccaaaagaaatgaatccaaagaaaaatatcagaaaaggcatgattctgacaaggaagaaaaaggcagaaaagagccaaaaggattaaagacacttaaggaaatcagaaatgcatttgatttatttaaattaactccagaaggaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcagatggcaggcagcagattctgagtttgggcatggacctgcagttggaatggatgaagttggaagatttccaaaagcaccttgatgggaaagatgagaattttgctgcaacagatgcaattccaagtaatgtgttaagggatgctgtgaaaaaaaaaaaaaaaaaaaagtttcttggaacctatacgttttttttgtttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttg

SEQ ID NO: 1123 - DNA, 1991 bp, Homo sapiens
acaagaactggcggcggcagcagcagcagcagcagcagcagcagcagcagcagcagcaactggatttgctttttcaccagaggatccagatttccctgtggcctcgcaaacaaaaaagaaggaagacggagcagcacagtcattcctttgtgaaaaaggcattcagagacggggtttcaccgtgttagccaggatggtctcgatctcctgacctcgcgatccgcccgcctcggcctcccaaagtgctgggattacaggcgtgagccaccgcgcccggcttcagctggtttttcaaaagtcatggcgtgtaactgtccgaacagtgaactccggagatccaccggaggggcgagtccacagctcgaccgcgagcacctgagcatcctgcaccgcctgcgacggccgtcagggggcgcgatgccgcctcacagaacctcaagaggcgcccgggttccggcacagacggcctgcggctccagggggcggaaccgagccgtctcctcaggacctacgcaggaggcgccgtcatccctacagggacacctgagagggcccagcctcctcctcctcaggacctactcgggagacgccgctggctctctaggaacacctggggaccgtggccagggacgacccagcctccttctcctcagctcctcaggaacgactggggaggctgtggcttcatggtccccgaggctgcccgaggaaaggtatttcaggacagccaggagggggcgcacatccgccgcgaaactgtgagcaagagcgtctgtgctgaaccatggcgccaccagagggcgcgcgatcccgccccaaccaacttcccgctgaagtgccagaagcagcgaggagcttcaacttcctcagggcagcacgggggtcgtgttaatttggtgttcttcattgatgatgattattccccaccttctaagagacaaagaccaacgagccaccacagccaccagtcccagaacctgccaatgctggggaacggaaaatgagggagttcaactctggccctcacaatccagtggaggagacgcaactcatctgcctctgtccctctgggcacgcctcatgccaggtgcatctgtggacaggggccatgctcctgggcttccaaagttggagaaagctgccaggctcaggtctgaaggccagaattctacagtaagtcctactgagtcaaggtgggagcagggtcggtagcttccgaggctctgcgggagaatccgtttcctggccgtagaggtggcctgcactccgcagcttgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgacatgaacttatgaattcaacaggtgaagatttacaacttgataaatcaactttgtcagctcgagctgtaaaagccaaaggtccggtgatgatcccatacccttttttccagtctcatgttgaagatttttatgtagaaggccttcccaaaggaatttttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccataccaggctaatttttgtatttttagtggagatgcggtttcacccttcataccagctccaagccccagaccatgggagctgtctgggatgttgatccttgagaacttggccctgtgctttagacccaaggacccgattcctgggctaggaaagagagaacaagcaagccggggctacctgcccccaggtggccaccaagttgtggaagcacatttctaaataaaaactgctcttagaatg

SEQ ID NO: 1124 - DNA, 2687 bp, Homo sapiens
gaaccttcgaattcatgaaaggacacaaacacacataatgcactctgtagagagaccttataaatgtaagatatgtgggagaggcttttattctgccaagtcatttcaaacacatgaaaaatcttacactggagagaaaccctatgagtgtaagcaatgtgggaaagcctttgtttccttcacttcctttcgatatcatgaaaggactcacactggagagaacccctatgagtgtaagcaatttgggaaagccttcagatctgtcaaaaatcttcgatttcataaaaggacacacactggagagaaaccctgtgaatgtaagaagtgtggaaaagcattccataatttctcttctttgcaaatacatgaaaggatgcacagaggagagaagctctgtgaatgtaagcattgtgggaaagcattcatatctgccaagatcctttgaatacatgcaagaacacacaatggagagaaaccctatgaatgtaaagaatgcagaaaagcattcagcttgcctacttcctttcatagacatgaaaagactcacactggaaggaaacactatgaatgcaagcaatgtagcaaagctttcacttcttccagttcttttcaatatcatgaaagaactcacactagggagaaaccctatcaatgtaagcaatgtgcaaaagtctttatttcttccacttcttttcaatatcatgaaaggactcacatgggagagaaaccctatgagtgtatgccaagtgggaaagccttcatttcttctagttcccttcaatatcatgaaaggactcacactggagagaagccctatgaatataagcaatgtgggaaagccttcagatcagcctcgcaccttcaaatgcatggaaggactcacactggagaaaaaccctatgaatgtaagcagtatgggaaagcgttcagacctgacaagattctttgaatacagataatgaatgtaaacaattaactgtttataataactgtatactaacaaatgatattctttttaaataagaagctataatatcccattggtgtcatgtattagatcagccttatactgttaaattgttattatttggacattgtgagtcagtataaccatgtggataaaatgccagacatctttttattcgaaaattttacttttcatgcttatgtacttacatttttatctcaaccttaatttttctttctttttttttttcccccagaaagagtctcactctgtcacccaggctggagtgcagtggcatgatctcaggtcactgcaacctctgcctccagggttcaagcaattctcctgcctcagtctcctgagtagctgggactacaggcatgcgccaccatgccaggctgattttttgtattttttggtggagacggggtttcaccgtgttggctaggctggtctcaaactccagacctcatgatttacccacctcggcctcccaaaatgctgggattacagacatgaaccatcatgcccagctgcaaccctaatttttcattcagtcttaataccaatagttatctcatgcacctctgagtgccttcttccccaaaaccagcagtgccatacctgctgtcagcaagggtgtaatataccatagtgataaatatgaccaaaagccataaatgactgtgagatgtatgagaattacaagtcacattagtaagaagagaaaaattttggtcatgtttatgatttgaaatatgttttcctctatcacatttagaaatatagttacaaaatgcccttgtttttgtcctgattcatcatggtcactgaggagcatcgtctcatatgcctggtatgtgacacgtgtctctccaacaataaaagacttggccttggctgggcatggtggctcacgcctgtaatcccagcactttgggaggccgaggtcaggagttagagaccattctgaccaatatgatcaaaccccgtctctactaaaaatacaaaagttagcagggcgtggtggcatgctcctgtagtcctagctattcaggaggctgacataggagaattgcttgaatataggaagcagaggttgcagtgagccgaggttgcaccattgtactccagcctgggcaacaagagtgaaactctgtcttaaaaaacacaaaaaaagacttggccttagggccgagtgcggtggctcacgcctgtgatcccagcactttgggaggccgaggcgggcggatcactaggtcaggaaatggagaccatcctggccaacacggtgaaacccagtctctactgagaaatacaaaaaattagtggggcgtggtctcaggctcctgcagtcccagctacttgggaggctgaggcaggagaatggtgtgaacctgtgaggtggagcttgcagtgagccaagatcgcgccattgcactccaacctggacgacagagcaagactccatctcaaaaaaaaaaaaaaaaaaaaaaaaagacttggccttgtggtgaggggagggcatctgtaaactcctggacctgtttttgccttacttattctctaaagactaaaatatttcctaaaatgtacaggcactgtttaccagaaagtaccttagttaaaacatataaatttgtttatgccttataaagctacattttttcaaattgctttactgagtcgtaggaggctaataaatttgtgtaaattgtct

SEQ ID NO: 1125 - DNA, 2455 bp, Homo sapiens
actggggggtgtgaggaacaggggggaccatggacttcatcagcattcagcagttggtaagtggagaaagagttgaagggaaagtgttgggatttggacatggagttcctgaccctggagcctggcctagtgactggaggaggggcccccaagaggctgtggcccgggagaagctgaaattggaagaagagaagaagaagaaacttgaaagatttaacagtaccagatttaatctggataacctggctgacttggaaaacttggttcaaagacggaaaaagcgactgagacacagagtcccccccaggaaacctgagcccctggttaagctccaccgcaccgccttgcactgggcctgtctgaagggtcatagccagctggtgaacaagctgctggtggcaggtgccacagtggacgcgcgagacttgctggacaggacacctgtgttctgggcctgccgcggaggacatctggtcatcctcaaacagctgcttaaccagggagcccgggtcaatgcccgggacaagatcgggagcacccccctgcacgtggcagtgcgcacccggcaccccgactgcctggagcacctcatcgagtgtggcgcccacctgaacgcacaggataaggaaggggacacggctctgcacgaggccgtgcggcacggcagctacaaagccatgaagctactgctgctctatggggccgagctgggggtgcggaacgcggcctccttgaccccggtgcagctggctcgagactggcagcgcggcatccgggaggccctgcaggcccacgtggcgcatccccgcacccggtgctgaccgcagcaccgccccccgccgcgcctttcgcactgccaccattccatcctgtgccccgcccccgcgtctgcacctctgtggttcctgccctcagccctggttcctccctctctggcctgtgccgcctcagcagccctggcagaactgaagagcggcaccgggcccagcaggcaaagagagaggcctccctggcttcgagtgtcaggggagccgcgttccctcccagggctggagcagaggaccacaaggcagcagaaagcgcgggtccagatgagggccaggaaggggaggagagtgagggccaagaacgagccttaagggagcagtcccaagctggagccacccagggctgggtctgggagtcctcagtgtccacttgtcccaggttagggggcttgccttgctctctccagggccagtctgtgtgtgtggggactcagcccgtggccggcagatgccatccaggatgtacaaggtgcagccaaggcaggccatgcaggggccgggcctgtctgcagctggtggatgcctgtgggcatggctttctctggggaccccattcctgtcagtagcaaccctggcagtgtccggagcggctctagacaactttggtcataggaactctggaggtgggttctggtcatctgaggtggctactcaacaggtttgaggccccacagcaacagaagtccaggacccactaggttgcctcagaagccctaagactgatgagctggagcgcgcatttgagagaagcctcgcacccactgtgtactggccccgctcaggccggcctggcacaccgttgcctgctggcggctctcatggggaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaaggtgagcccccgccgccccccagcccttcccatcccttccctgctccctggtggtctaaggacccaagctccctagacttcctcttccaccgtctgtacgtttcaaattacactggtgtaggcctgtactgctggtggggctgggcccctaaacgccagaaagtgaatcttaagaagctctgccctaaactgagaaccacatgctgagggaagggctgaaaggtgaaggctcagcctccctcacatgggtcctgggttacattaggtaccgggctgattgataggcatttggccatggttccttttcgtctacctttgggggccttctcaggcccagaacaaggctgttgttactatgtggaaaagctgaccagtgctgcacactaggggcacacacctttccatgagcagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccatt

SEQ ID NO: 1126 - DNA, 2057 bp, Homo sapiens
aagtgaatagtcctcgcgcaagcgggacactgtggtggatgcaattcccctcgcctccagccgcgaggagctccccggcgccgcaggcagcgtcctcctccgaagcagctgcacctgcaactgggcagcctggaccctcgtgccctgttcccgggacctcgcgcagggggcgccccgggacaccccctgcgggccgggtggaggaggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttgcaatttggtttcttcttgcctctgctgacagcgtggccaggcgactgcagtcacgtctccaacaaccaagttgtgttgcttgatacaacaactgtactgggagagctaggatggaaaacatatccattaaatgggtgggatgccatcactgaaatggatgaatataataggcccattcacacataccaggtatgtaatgtaatggaaccaaaccaaaacaactggcttcgtacaaactggatctcccgtgatgcagctcagaaaatttatgtggaaatgaaattcacactaagggattgtaacagcatcccatgggtcttggggacttgcaaagaaacatttaatctgttttatatggaatcagatgagtcccacggaattaaattcaagccaaaccagtatacaaagatcgacacaattgctgctgatgagagttttacccagatggatttgggtgatcgcatcctcaaactcaacactgaaattcgtgaggtggggcctatagaaaggaaaggattttatctggcttttcaagacattggggcgtgcattgccctggtttcagtccgtgttttctacaagaaatgccccttcactgttcgtaacttggccatgtttcctgataccattccaagggttgattcctcctctttggttgaagtacggggttcttgtgtgaagagtgctgaagagcgtgacactcctaaactgtattgtggagctgatggagattggctggttcctcttggaaggtgcatctgcagtacaggatatgaagaaattgagggttcttgccatgcttgcagaccaggattctataaagcttttgctgggaacacaaaatgttctaaatgtcctccacacagtttaacatacatggaagcaacttctgtctgtcagtgtgaaaagggttatttccgagctgaaaaagacccaccttctatggcatgtaccaggccaccttcagctcctaggaatgtggtttttaacatcaatgaaacagcccttattttggaatggagcccaccaagtgacacaggagggagaaaagatctcacatacagtgtaatctgtaagaaatgtggcttagacaccagccagtgtgaggactgtggtggaggactccgcttcatcccaagacatacaggcctgatcaacaattccgtgatagtacttgactttgtgtctcacgtgaattacacctttgaaatagaagcaatgaatggagtttctgagttgagtttttctcccaagccattcacagctattacagtgaccacggatcaagatggtaagttccactgctgttctctcaaaacagacccataatttcttttgatgcataaatatccctcatgggcatgtatttattgcaggtgctatgcagtcatatacgttatacactgcagaggtaatgcactggttgttgttcttgttctttcctaaaactcagaaagatatttttatattacttctcagcagtatgaataataagatgaaatgcttccctccactgtttatgtactcatgtattttgtataatcatataacaatatatcttaatgagtaagtccatattacttaccaatagaagtcagaaatcaataaaatgttattaaatgaattgaatttcaattgccccacttatgctgccatcctttttgcatgtcaaataaagcaaatagtaagaatttttaaaactat

SEQ ID NO: 1127 - DNA, 2724 bp, Homo sapiens
agtttcctggagacccggaagcagattacgtggagtgacggtcatgctgcggcgtggacacttggcattcagggacgtggccatagaattccctcaggaggagtggaaatgtctggaccctgctcagaggactttatacagggaagtgatggtggagaactacaggaacctggtctttctgggaatctgtcttcctgacctgagtgttatctccatgttggagcaaaggagagatccccggaatctgcagagtgaagtgaaaatagcaaacaatccaggtggcagggagtgcatcaaaggtgtgaacgcagagagcagctctaaattgggaagcaatgccggaaacaagtctcttaaaatcaacttggattaacctttcagttacatctgagtgaactgcagctatttcaagctgaaaggaatatttctggatgtaaacatgtcgaaaaacctatcaacaacaattccttagtttcaccacttcaaaaaatttattctagtgtcaaatcccacattttaaataaatacagaaatgattttgatgattctccatttctcccacaagaacaaaaagcacaaataagggaaaaaccgtgtgaatgtaatgagcatggcaaagcctttagagtgtcttcaagccttgctaaccatcaagtaatccacactgcagataacccttacaaatgtaatgaatgtgacaaggtcttcagtaacagttcaaaccttgtacaacatcaaagaattcatactggagagaagccttacaagtgtcatgaatgtggcaagctcttcaatcgaatttcactccttgcacgacatcagagaatacatactggagagaaaccttacaaatgtcatgagtgtggcaaagtcttcactcaaaattctcaccttgcaaatcatcacagaatccacactggagagaaaccttacaaatgtaatgagtgtggcaaggtcttcaacaaaaatgcacaccttgcacgacatcagaaaattcatagtggagagaaaccttacaaatgtaaggaatgtggcaaagcattttcagggggttcaggccttactgctcatcttgtaattcacactggagagaaactttacaaatgtaataaatgcggcaaggtcttcaatcgaaatgcacaccttaccagacatcaaagaatccatactggagagaaaccttatgaatgtaaagaatgtggcaaggtcttcaggcacaagttttgtctaaccaatcatcatagaatgcacacgggagagcaaccttacaaatgtaatgaatttgggaggccgaggcgggtggatcatgaggtcaggagatcgagaccatcctggctaacaaggtgaaaccccatctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaacaaacaaacaaacaaaaaaaaacaaatgtaatgaatgtggcaaagtcttcagttacaattcacaccttgcacaacatcagagaatacatactggagagaaaccttacaaatgcagtgactgtggcaaggtatttagtcgacttccgtgccttacacgacatcaaagagttcacactggagagagaccttacaaatgtaatgaatgtggcaaagcatttagagactgttcaggccttactgcccatctactaattcacactggagagaaaccttacaaatgtaaagaatgtgccaaggtcttcaggcatagattatccctaagcaatcatcagagatttcataccggagagaaaccttacagatgtgatgaatgtggcagggacttcactcgaaattcaaaccttgcaaatcatcacagaatccatactggagagaaaccttacaaatgcagtgaatgtcacaaagtctttagtcacaattcacaccttgcacgacataggcaaattcatactggagagaagtcttacaaatgcaatgaatgtggcaaggtcttcagccacaagttatacctaaaaaaacatgagagaattcatactggggagaaaccgtacagatgtcatgaatgtggtaaggacttcactcgaaattcaaacctggcaaatcatcacagaatccatactggagagaaaccgtacagatgaaatgtgtgtggtaagatctttagtaataattcacaccttgcacagcatgagaggattcattcatgagagagttcttacaaactgagtatggcaaactcttcatgctaagttctagcattaatcaacatcagagattccatactaaagagaaatcatagcaatgtatgtgaatcaggtctcttgaggcctgccaaatgactagatatcaaaacatacatcttggatgaaaccatacagatggattatgtatgctgaggctattattcaaggaccattactatggaacatgataagatttacacaagcgataattcagtctctagttctccaatatttatgatactgcatgctgcagaaaagtcacagctccaaatacgttgaatctcatgacgcgatgcatgtcgaaggtccaagggcatgtggaaatggtcagttatattcaggcaattaaaaaacctaattatatggggttttttg

SEQ ID NO: 1128 - DNA, 2826 bp, Homo sapiens
atttgtacttagacaaagaggcagctgaacgtctttcaaaaacagtagatgaagcatgtctgttactagcagaatataacgggcgcctggcagcagaactggaggaccgtcgccagctggctcggatgttggtggagtatacccagaatcagaaagatgttttgtcggagaaggagaaaaaactagaggaatacaaacagaagcttgcacgagtaacccaggtccgcaaggaactgaaatcccatattcagagcttgccagacctctcactgctgcccaacgtcacagggggcttagcccccctgccctctgctggggacctgttttcaactgactaggatgggtgtcatgtcccagatttctgtttgtaccagcagaaagaagagggcaagtcatggttggaaataaccttctagcccctggttctatcccttcttccgcccagccccccagcctcaagaaagaacctcagactctgattctcctcttcagcctctcatcttgagcacagttcagaacagtggcgactggaatctggtttatattcatatttgcaaagactacagactttttctcccacttcatattttcatgcccccctgttggttttccattcttaactgtctccttatacctaagaagttatgaaaatcatgtgtacttctggaagctttcgaaagaatcttgtccctcatgacagcattttatcatgaaagcagcttctcctttctgggctgggcttgttcaagttcggtgtgggcttccactaaggcacttgtcctggagacgttggctttcccagctgcatctgccccaaaaggttgtaggcacagctgtcgtagcgttgccataaagagtttgccaaatctctgatcctccctttccattgcttctcctagtgatgcacgaagattaggtgcatttattttgtaaacagattggagaatctagcaataagattcaaagctaatctggagcataaaggcacagttcagagacagaataacagggatcacaagcatgaattaaaaggaatttatttgcttcaaattcctagatacaaccttcccatgctgcacttctccactgtcggagcacgttccgaaaaacagaatgccttgatccctggtgggtgcgaaggcagttgttagggatggcaggcattggtgggctccaaaagatgaaggccccacacacaggtgtgctgcatttgggatctgtgtgggtgtttcttggaccctttcttctgggagtagggtacacactaacgtttaatccgctgtctgggtgcatgtccacagtacggtggctaaactcgaacatcactgcaaataggacgctgagcaggtccgtctgtcatgtcacgccactgcacaggtccttgtccccacacgacggggagtacttgcgtcagatgttattgaatagctcgtctcgggcaggggaagcggggagttggggatattaattgggggttttaattctattatcatgtcagctgacattatgactatataatgtagttagagacaatttttatcttgcttatagtaaaggttcagcctgccaattgtaaatcattctaatttggcaggcttatttttgacattggaaagggcagaaagcgatttgccccagtagtgtaataggagttatagaccagaggctgaaacccaaactatataaaaaggaattcagtggagggggctttgtaatctccattaatttgtgttgctacttccaggatcaccaaaaattacatgtaattttacatgttaaacacattgaaacataggtaacctatgtttataaagcataacgggcttcccttccagaagctctcctgcttgtcatgaagtgagaacaatgaaaagtcatagcagatactcagtttaactctgtgtagaacctagtagtgtttgagctgttattcagatttgaattcagactgtgtgttgtttgcttatggacactgcctgtcgttctgtcactgttaaactaatgagtctataaggtttttcttccagaggccataggtgacatcactaaaattgcaagataaattgtaatctttgctgctgctgcactccccaacctctcccccaccccccgtggtgtgctgctttctagatgagcgtgttttggagcaggcccatctgggacactctatgctttcaccaaggaagtgcgatctgagcagccacaatccagccaaaagaggatcgtagatatttgctctgatcaactagatgaaaatatagcagaatggatttagcccactgctctgttttatccaactgagtctctgaccagcaattggtgcataattattacagcaaaagttaagaaatgaaactgtagcaattatgtaaatgaatgtgttggcctcttaatacctgttactagtggacttcctgtgaggaagttagttttttgttttgatgaaatgctttcgttttttaaatcttaattctgctgtccacatcctcccaaagtgtgcttacttcatttgtttaatttaaatgaactttcctccttgtatgtatgaggtgacttggtgggtggggtgggtggtttttgtttttgtgttttttctttcttagggcatctgtaggcctcaaaggacctttcctttaggtcatattcctcagaaagtcttcaatcttcccttgtttttgtttgtttgtttttcttaaagaatattttcaaagcttaaatttgtatattaatttaggactatttagaagtataggctgtcgttggcggcagcagtatattctgaaatgtctcatagatatatatttttgaataaagatggtgttgttg

SEQ ID NO: 1129 - DNA, 2659 bp, Homo sapiens
tttccgggacagtggaggcgacgaagtaataaacccgtggacccagatttctcaggtcttaacacgttccctgaggcctaaaggtgcccagggccgagcccaaagtgcttgggtcagggctcggtggagcgccgaggtccgagccggggacggcggcgtcggtgggtcatgctccggcactccccctcgctgtgggagctggtggaggagcacgtcccgctccgggagcgacgcgaagtgaagaggattctgggggaggcggcggtggacctgagcctggagctgcgggcggagcccccaccattccggacactcccctccccagtcgcaaggtatcccagctctccttgcaggtggcgatgttacgggcactgctccaagaggctcgatcctctcaagcccccagctcccgccccatctctgacccctcttctcttctggcaccaccgcctctcctaaaggacctcttgcgccaggagctccggcagttgctccagggtctccgccacaaagccatctgtgagggcagggaccaggcccaagcttgggtccagtatagccccagggtcctgcactttgccttggaggagcccaggtgtgatttgccagaacaggagatattccagatgagaggtggtgggcccagcggtcacagagatctcagcatcatcaaggaccaactgaacgtgtccaacattgaccaggtggccagacacctgaggtgaggcccaggggcacctgcatgtgtataggcaggggtggagacaaggatggatcttgaggtgctgggattgtgagacaggaggtgggtagtatacttggcggggaggcccatgtgcgtaaggctgagaggtggaaagagctggctgctatagagctagtgaggttgctttcaggaagcagccaagtacagatgccacggccgagcatgatggtgcatgcctgtaatcccagcaatttgggaggccgaggcaagagggtcatttgggcccaggaattcgagaccagcttggccggcatgggagaaccccatctctaccaaaacaaatacgaaaattagctgggcgtggtggtgcacgcctgtaccagttacttgggaggctgaggtgagaggggattgattgagccctggaaggtgaggctgcagtgagtcatgatgggtggcagagcaggaccctgtttctttctttctttctttctttcttttttttttttttttgagatggagtcttgttctggcgcccaggctggagtgcagtggcgtgatcttggctcgctgcaagctccacctcccgggttcacaccattctcctgcctaagcctcccgagtggctggggctgcggatgcccaccaccatgcccagctaatttttttgtatttttggtagaggcggggtttcactgtgttggccgggatggtctcgatctcttgatctcatgatccgcccatctcggcctcccaaagtgctgggattgcgggcatgagccacctcgcctggccgaccctgtttcaaaaataaataccttgacacaggggtagcctgtgtcagaggattttaagcagcggaagggctgtgatgtgggggaagatggaggcaagaagaatcacagtgcagaagtgtgggagagagaaggatgcctgccagggtgaggcaggcgaggggaagatacttcctgcccagaaagagcctcacaggggccagacgtctatgctgggtcagcccccaagcagcagagggcagtgtgggctgaggaaggacaggttgggtggggctcctgctgaggctggaggttggggccatgtggtggactcagctgagccctggtcctgtgtctcgggttctggctgctgctccctcatgtcccagaggccttctggaggaggagtgtcacaccttggagagggagatcctcatcctgcagcgctgcctggaagaggagtatttgaggccttgccacccctctgaggcagccctggagcccaccctggcagagctaaaggaacagaagaaggccatggagcaggagctgcaggcatctgtggggccttcttgtgtctctcccaaccacaggcagcggcccttggggtcctccacacagggcctcagacccccgcttcccctctgcggggttgcacctctccagtgctgcctgcctgcacctcctctggagccctaccttcgacctcgaggccagtcggctacccaccgctggggacggcagcttcagtgcagccccagggaagggccagcttccacacccatgtccagtgcagcaccccaagccccagcctgaagggctggtcaccgagtaggctctggcttctgccacagcgcacctgtctgccgctgccgcctcagctgctttggcccagccagcttcagatctggtcttggcgagctctcgccaggaccccaaggctgctggtctgtctggcccttgccccacccccttgccagatccctggtgtctggagctgagtggccgggcatcggtcccaagcatcaaagcctttggcctttctcctcccaggcctccacaaaggcctggcagacagaggtctcattccagcctgactcttgtcccctgggggacccagacaaagcacagcagccgctcagagacaggaatagaaatttcattaaaatctatggacttt

SEQ ID NO: 1130 - DNA, 2182 bp, Homo sapiens
atataactttacgagcttcttatgtctacgcttttttgggatatcactcgtcctccttatctcgcctttgccgtcggtgttcagtgcggtcaaaagttccagttcaaggtggacacgctggaggacggaatttgcctgctgaaggatggcgaaacgacgattaagggagaggacgccatctgtgattacttcatttcgaagtgtgcggatcagtctcttctgggaggcgatgatgcggagacggtgaaggaatggagacacattgctagcaccattacgaaggagaacgttctggagcagattgaaaagctcgacacgtatattgccacccgcacctacattgtccgcaacgtgttcacgattgccgatatttccatgtgggccgcgattaaactgacggaagtggagattcctgccaagtgcaccttcgcttctcgctggtacacatacatcagcgccattccctcggtgaagcagacgacgggtcgcgtgggtggctctcttcgcatggcggcgaagcaggcgtcggctccgaagaaggagattgcgacgaagaagggcgaaatcagcctggacggcactcccgagtcgatgccggagcttcccttcgcggagatgggcaaggtggtgacacgcttcccgccggaggcctctggctacatgcacatcggccacgtgaaggctgcgatgctgaactactactacgcgaagcgctaccagggcaagctgctgctgcgtttcgacgacacgaacccgtcgaaggagaaggaggagttcgagacgagcatcatcgaggacctggcgaagctgggcatcaaggcggacctgttcagccacacgagcgactacttcgacgtgattctcgactacgcgcggcagatgattcgcgagggactggccttcatggacaacacggaccaggagaccatgcggaaggagcgcatggagcgcaaggagagcaagctgcgcaacacctcgccggaggagaacctgcgtctcttcgaggcgctgtgtcgcggcgagccagaggtgcaggactactgtctgcgcgcgaaaatcgacatgaagagcgacaacggcacgctgcgcgaccccgtgctggttcgttacttcccgctgacgcacatgcgcacgggcgacaagtacaaggcatatccctgctacgacctcgcgtgtcccatcgtggacagtatcgagggcgtgacgcacgcgatgcgcacgacagagtacaaggaccgcgacgagcagtacatgtggatccagaaggcgctgcggctgcggccggtgcacctggtggagttcgcgcgactcaacttccagtacacgctgatgagcaagcgcaagctcacgtggatggtggagcaccacgaggtggacggctgggacgaccctcgcttccccaccgtgaagggcgtgctgcgtcgcggcgtgcaggtggaggcgctgcgtgcgttcatcctgtcgcagggcttctcgaagcgcgtggtgacgatggagtgggacaagttctggtcggacaacaagaagatccttgagcgcaacgcgctgcgcttcatgggcgtgatgaagagcgacttcgtgacgctgacgctcacgaacgtgcagccaggcttcatcaaggtgcccaaccacccgaaggacgagagcaagggcgtcagcgacatcgcgatcggtccgcaggtcatgctggagcgcacggacgcacaggagctcaaggagggcgaggagttcacgctgatgcgctggggcagcgcgaaggtcaccgccatcgcgcgcgacgccgacggagcggtcaccggcgtcacgggagagtttgtgccgaacggagacttcaagaacacggcgaaggtgaactgggtggcggtgtgtcccgagaaccacgaggtgaccgttgtcgagtacgacgacctgctcaccaagaagacgctcgaggagaccgacaacttcgaggacttcctcactagcaaggaccatcccaccaagatggagtacactgtcatcgtcaacaacgcctgcaagggactgaaggagaaccagatcgtccagctggagagacgcggattctaccgctgcgatgtgcctgacaccgagaactcccccgccaagctgatcctcatccccgacggaaagaagaaggccatgagcaagctctccggagtcctgggacataagtaatggattt

SEQ ID NO: 1131 - DNA, 1839 bp, Homo sapiens
actttaacttcctggagctctaatttctccttctcagatcagcatccccagaacacacctgtgttaagtcaaagaccttggacccaatggtcatcttcttcaccagtgggaccacaggcttccccaagatggcaaaacactcccatgggttggccttacaaccctccttcccaggaagtaggaaattacggagcctgaagacatctgatgtctcctggtgcctgtcggactcaggatggattgtggctaccatttggaccctggtagaaccatggacagcgggttgtacagtctttatccaccatctgccacagtttgacaccaaggtcatcatacagacattgttgaaataccccattaaccacttttggggggtatcatctatatatcgaatgattctgcagcaggatttcaccagcatcaggttccctgccctggagcactgctatactggcggggaggtcgtgttgcccaaggatcaggaggagtggaaaagacggacgggccttctgctctacgagaactatgggcagtcggaaacgggactaatttgtgccacctactggggaatgaagatcaagccgggtttcatggggaaggccactccaccctacgacgtccaggtctggtcctaagggcattggcagggagcagttagggctcagcgggggttggacaatttgacaccaggtgacaacaccagccgcacttccctgctccagtcatccttcctcctctcttctcatttatcccttcagtttcatatggaggcctcagttgaaaactgcattattgtgagcatgaacaccgctgaccctggcagccagggcatcacacacagtaggtaggaaagaatacctagaggctgcactgggagccctctctagcaagtggtgcttttcattttttttgatcactgttttccaacttgaagacacattggtgacatctactaactcatgaaacatagacccttggcttgagtttcacatttgcgtattttaaaggcttttgacagttttattccattttctgacgtttcctctgttatttcatccacactggtgtcccatgcataaaccagacagtgcttgggtggggcagaagggctgcggcctcctgcagtgtatgattcacaggcctcttgctacaggtcattgatgacaagggcagcatcctgccacctaacacagaaggaaacattggcatcagaatcaaacctgtcaggcctgtgagcctcttcatgtgctatgagggtgacccagagaagacagctaaagtggaatgtggggacttctacaacactggggacagaggtatcgcatcgggcctgcagaggttgaaagcgctttggtggagcacccagcggtggcggagtcagccgtggtgggcagcccagacccgattcgaggggagttcctgtcccatgacaaggatcagctgaccaaggaactgcagcagcatgtcaagtcagtgacagccccatacaagtacccaaggaaggtggagtttgtctcagagctgccaaaaaccatcactggcaagattgaacggaaggaacttcggaaaaaggagactggtcagatgtaatcggcagtgaactcagaacgcactgcacacctaaggcaaatccctggccactttagtctccccactatggtgaggacgagggtggggcattgagagtgttgatttgggaaagtatcaggagtgccatgattccaatgttttccttcttttaaattaaattcagttgctctgcttcctccaagtcctctgtatctttagaatttcccaggtgagcactcataacgcaagtaataaaatactgatatcaac

SEQ ID NO: 1132 - DNA, 3084 bp, Homo sapiens
acttccctccctccctctctccccagctgcctcctcctcttctctccccgctctccttcccctttcaccccatcccctgccctggctgcaaccatgagggtcttggcctgcctccttgcggccctggtggggatccaggctgttggtaagtgcccagactcctcccatctgcccgccccccccccaggcctcccccttctgcccatccaggcctggcctcacccccactgggtccccggcccatccgaattccactgtgaccttggccccagctccgcaagggaatcccccaggtgtctggccgcatctctctgagcacccaggagtctgggcccaggggccagtgagcagggccactggcctacagacagtacctgcaggacagccacctgcccctacagttgccctggccttggggcccccaggatgcccctccccagtcacagccattcctccaaccctcagagcgcctgcgcctggccgatggcccccatgggtgcgctggccgcctggaggtctggcatggcgggcgctggggcaccgtgtgtgatgacggctgggacctgcgcgatgccgccgtggcctgccggcagctgggctgcggaggggcactggccgccccgggaggcgccttcttcggggagggggcagggcctgtgtggctcagcgagctggcttgccggggcaacgaggggcagctgggcctctgccaccaccggggctggaaggcccacatctgctcccacgaggaggacgcgggcgtcgtctgcgcaggtcagcgtgtggctaactccagggacgactcaacatctcccctggatggggctccctggccagggctgttgctggagctgagccccagcacggaggagcccctggtgacacatgccccccgcccagctgggaacccccagaacgcctcccggaagaagagcccccggcccaagcaggccaagtccacccgggcccctctgctgacgacaggagccccccgccaagagcggctgcgcctggtctctggcccccacaggtgcgccggacgcctggaggtctggcacggcgggcgctggggcaccgtatgtgacgatggctgggacctgcgcgacgctgctgtagcctgccgggaactgggctgtgggggggcgctggctgcccccggcggtgccagattcgggcctggtgcagggcccgtgtggatggacgatgtggggtgtggaggaggagaacaggccctccgagactgcccccgaagcccctggggccggagcaactgtgaccacagcgaggatgcggggctggtctgcaccggtacgtcgggctggggcctggccccctcctgtcttcctcagaccccagctccctcttgcccctccaggaagctgcagcgggcctgctcccagctctgcctcctgcccgcctgctctctgcatgcccagcgcccactcaccacgctctccagcccctccttccacagctcctgccgttctccttgccaggaatgggaggagcaggcttgaggcttgggctagtgctcagccctgtcccggggcctaggccagtgaccgtttgtttaagcctcagttttcctgaaggagcgatggagctaagaatgcctgcctcaggcttgagccaagtcctggaacgcaagaagccctgcctgccctctgccaccgggctggccatggcaggggaccgtctcggagacctcttgtctctgtggccaacctctgctccttccccatcctcaagggagctggtgggaaggagggagggagggcggtgacttgggggcatggagggagactgaggcagggtggggacacccacgggtgagcctccatctcccctcattcacgccccctcagcgcagggtctcctcccctcatgtctcccagggggtccctcccctgtcctgtaccccttggacctgggatagaacccagcaaacagcggttggggggtgttaggtgagagctcaggggctccctccctccttctctccttccttccttcctccctctttccctttctctttcctttctttccttccacaaatctttacacaccaccacggcaggccccaccctgctggactgcccgatccattgactgtaggaggccggcaggcagagggcacccacctggcatttcatcagcgttggggtggggacagtacagggactgcaggcaaagctgggtgcctgcccaggacgggtaggaaatgctgacatcagtgggtatccaggggggagagaagagagaaagaggctgaccctagtctctgctgtatgctgggccctgcgctgtgcacgttacctggggccgctctgagcctcccgcagcccggacggggtggatcctcatccctctcttcacagatgtggggccgaggctcagagaggtgacgtaaatggcccaagacccaggtgcctagcaagctccagccccagccgctgacccctctgggtctgtatagacccacgctccatgcctgtcccactgcacagtcggccatagggacgtggtggggacacggaggtcagagtgggagtgagcagcagagaaggcttgtatggggtgggggtggtgccttcgtgtgcctagtgtacaagctgtgggggaagaagtgggaccttcagagcagagttcattggagggaagttgaggctctggagaggagagggtgaaggtgccaagaaaggaaacaaatgaactaaggcgcccggtgaggctgggagcttcgccagcatctgatttaattctcatggcaaccccgggagggagacgctcccctcccctgtctgcagatgaggaaaagcagacaggtgtgttagactcctccctagttctgtgctcttctctagaacagtgactgggggcaattctgcacctgcctcgttgggggacagagagagggactccagagtcctccaatgatgagtcaactcttaccccaacagaaatgtacccgaagagccaggcatggttacaggctaacacctgtagcccacgtgctttgggaggatttcttgaggccaggagttcaagaccagtctgggcaacatagtgagaccctttccctac

SEQ ID NO: 1133 - DNA, 2422 bp, Homo sapiens
aactaccgcgcggtccgagccctggtcatggagaccttgaacgaaggccggctccggctggtcctgaagcactaccttcagaggggagaggtactcgacccaactacagccaatcgcatggagccgctgtggacaggtgaccctgcccctggtctcgggtcctgtgtctcaacctctcccactgcctaggcatcctgaccccagcttcccacaggtttctggccagctccgtctctatccctgggggtccccttacaccgcttggtctccaggtgagtggcctagcgtctcccgctcgtcaccaccgccacccacactcccctcactccgattacacactggcctccctggcaaggccccacctctctgtcctgggttcttcattgctgctgaacagacatggggttggtgtgggtgtgtgaggaaggaaagggtgtataacatgaagcagatgtaagagatgtgcttgatgggtgaaggaaggatgggtagatggggaagttggatgactggatacaggaagaaaggatggatttggtgtgtatgggtaatggctgagggagagaggaagcgaggggacctgagtgaagcctggatcatttcagttcactgggtggctgttcagtggctggttgggcatgcctgcctttgctgtcctccacccccactgcactgtcctctcccccacagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccggctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttacggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaggaggcttggtgccggggcctggggctctgagggaaattgaggccctgcagttagtttgcgggaactcagctcctccagccccacctcccagcatggtgccctaccattcatctccatggcactctttgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcctgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaat

SEQ ID NO: 1134 - DNA, 2136 bp, Homo sapiens
aagacattcatcctcccggaggcccgcgccgccctcgccctgcacgcctagcgttgtcccgcggccaggcccggccggagcggcggcgcctggatgtggacctggctgcggggagacgggcgccggccccaaagcgactttcggtcctcgacgcgccccgccccacccctgcgatgaagagggcgtctgctggaggttccaggccccgattcccttatcctgggggacgacagcatccatagcctggactttgtgtcgagccgagcctggacttccctgactatgggcccgggggcctgcacgcagcctacctgccatccccaccgctcagcgcctctgatgccttctcattgctttgtgctccctgagcctcaaggcctcaagccggcagggcggggactacgtggccctgcagcccctgtgctccgagggtgggcctcccatgccccaccgtagcatctttgcccccccatgcactgcccaaccacaatcgcagcctgtcctacaataatgtgctcaaccctggctcgcctggtggccacgcctgcctcgcccatccagcagttggcgtggccggataccactcaccctacctgcaccctggggcaacgggcgacccaccatggcccctgccccacagcttcagtcccgtgctgggcccccggccccaggagccctcgcctgtgctctacgacatcctgtccaggaccatcatggcatccatccaggagcgcaaggacagggaggagcgtgagtgcctgctgcgctcccaggccgactcactcttcggcgactcaggcgtctatgatgctcccagctcctacagcctgcagcaggccagtgtgctgtctgagggcttctgaggtcctacgctgtgctacagctctacagatgaccttgtggccaggcccggcttcggcggcgcctgcaaccctgtcctgcagacatcattgtcctcgctttccagctccgtgagccgtgcactgcggacgtcgtcctcctccctgcaggctgatcaggtggggaagctgaggcaggaagccctttagtcacttgccgaaggccacgctgttacccatgggaccggttttgggcggccgaagagcactcatggggccggattcacgccccgggcccgttccctcctgctctctggtgctcctcacgccattggccccactgcctctcactgcccgtgagtccctgtgcccgtgtcctccttcttgaacccctcagccctcagttaaccctcagaaagctggctcggagaagtccttgtgtggtatctgggaggcagagtttgccgtgagctgagattgtgccactgcacgcactccagcctgggcgacagagcgagaccccatctcaaaaaaaaaaaaaaaggcctcacgggactagaagcgtcttaccctgacctcacacctgctggacatcaggctggggagagaatcggggaagagggcattttccaacaggactggaaggccagtcgtggtccttggtggtgagagctagccaggccgccggccttctccccggaagcctgcagggtcccctctgatccctgcacctctggggggtcacaccaactgcgggtgtttcctcaccacgctgggcgcttggtgagcacgttctgccttgagacctggcatttctttgataacatttcttctcgtttcctgctcattctggaactcctgtcagtcagatgttgggccttttggatagattctgtgagtccttctttctacctttgcttgtagataagattttccttgaatccaaacacacacactctctctgctttttaaaaaattagttttggggctggatgtagtggcttacacctgtagtcccaggcactttgggaggccgaggcaggcagatcacttgaggtcaggagttccagaccagcctggccaacatggtgaaaccccgtctctactaaaaatacaaaaagtagctgaatgtggtggtgtgcacctgtaatcccagctactcaggaggctgaggcaggagactggcttgaacccgggtggcagaggttgcagtgagccgaaatcacaccactgtactccagcctggtgacagagccagactgttttaaaataaataaaaataaaaaattggttttgg

SEQ ID NO: 1135 - DNA, 2241 bp, Homo sapiens
agaatgagctgcagtctcttggcccacagcactggcttccccatctcacctggccacatccttctatgcctgccccgtcctcactcagtgtggcctctcagcccaactgcaggtggtaggataggggtgcccacagagggcaaagaaactgcccatggttgcctggcagagctttgagctcacaggttgccaggcagagcttttgagctcacaggtgacaggctcagggttctcatcctggccccaccagggccttgggcaagtcctgcccaccataggcctctgctacctgccagtcagcggggaagttcaccagatttcggctgctggggccaggacaggcctctcctaggttgtgccaaaccagcctacagatgttcctgccagtggtgccttcaggctgatgccaatctagcctctcctgtctctcatcagccaccctgacaggtgggcgtatgcctcatttttcatctggtgatgccaaagccctatggattcaggtgcagaagagggccaggactaggtcttctgccctttctatgacctcagagcctaagttttcaccttagcagagttctgagactgggtgaggcagggacttctggaaggttctgttcctgccctttttagctgaggacgtgtgtgagccttatctgacccctgtggctcatttttctcttctgacctggcagctttccttgttgctctaagcctgtccatgttgtggtttatttctggatgctcagtggcacggggcctcctccaaagacaggttgtcattttcatggtaacaacactgttctctgttgagtctgccctccgtgttgtagccagaccttgtggagatggctttgcggcggtgtgagctggcggtcaggagtgagggcccagccttcccggcacctcccagccaggtggccctgcccgacctgtggggtgaggcagccaaggttccttccatccccccagttgtggagacacagggctgcctcaccctttcattgccgaggttcctacctcatggacagaacaaacacctcagcaatgaaacctgttcatgtctaagagcagctgggctgggaatcttcccctttgttcaaggccttccagtaaggcccagctgtccccttgccgtgcatggggctctggggagttccactctttgatggagggcagaggccctgagtgcaaactccctgggaagagtcccatgctaacatgtgctcaaaggagccctcctctcacatctcagcgaccaagaaccccaatccctaatcagagctctgcctctgccccacatggggccctaccccacttccagggagcacagcagcctctgaccctagccctgccctggcagcatgggacctgccaacagctgagggtggcagcagtctgtgctgggatctgtgcccggatctgggcccattctcttcagtaaggctggagctgcgagccagtttgctgccctcccagatcctgcgtccattctgaagaatggggacacctccctattacagatgagaacagaggggacatgaactccttggaggcagggctgggaagggaccctgggctgtgtctcctccctgtaccgtgtcaactccaagagctggcaccaggccgggagggctattcccatattcctcacagctggcttgtaaggcaggagctggcccaggccacagcacctgctggggtgggaaagggccccagctgacctggctatgggtgccactggagctagaacagccctcctgcacccaggctggcgacagcccagcagtgcccacacaggactgggccctccgcaggggacttcagagcagcaaggccccagctggcagtagcctgaccatctggacacagcagagccagggcggcccagggacggcaggagagctcgcggcaccttcctgaggccaagcaaggggagcagggttagggctgttcctgaaaggcagagagcctctgccctgagcctcacagctactcttctcagctctctgggtctggaaggagaacaggctgaggggagctgagaggagctgaggtgctacccggagccccattcacccccacctgcccacttgggaatctgaggcagaggagggtgaggcctgtgtgccaaccttgttcacataccaccttcgtccccccaggccccggccccactcctggctctcattatttttatgttaaaactttgaaggaattgaacatgacctgttgaagaaattg

SEQ ID NO: 1136 - DNA, 3161 bp, Homo sapiens
agcttccgggagggcggctcgcaggcaccatgactcctgtgaggatgcagcactccctggcaggtcagacctatgccgtgcccttcatccagccagacctgcggcgagaggaggccgtccagcagatggcggatgccctgcagtacctgcagaaggtctctggagacatcttcagcaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggtcaggtgcctgagattgatgttccatcctacctgcctgacctgcccggcattgccaacgacctcatgtacagtgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggtgtgctcagtgcactcgggtggattttctgtgggtttattaagtggtcagaaattctcaattttttgaatagtttccatttcaaatatcttgttctacttggttcataaaatagtggttttcaaactgtagagctctggacttctcacttctagggcagagggagcctgaacaagtgaggctctgggttccccgttcctaattaaaccaatggaaagaaggggtctaataacaaactacagcaacacatttttcatttcagcttcactgctgtatctcccagtgtaaccctagcatccagaagtggcacaaaacccctctgctggctcgtgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacaataagcttccccagccctgcctgagcagcctttcctccttgccctgttccccacctcctggctccagtccagggagctcccagggaagtggtcgacccctccggtggccgggccactctgctagagtccatccgccaagctgggggcatcggcaaggccaagctgcgcagcatgaaggagcgaaagctggagaagcagcagcagaaggagcaggagcaaggtgagcgggccctggagcttgcagtcggagggccttgggcaagatcgcctcctcccctccagccctgagtccaccgggtgctttctgcccaccccctgctcttgccagctggcccctgcttcccctagggcacatgctggaagccctgggccgccaccagaggtcctcagccctcctgcctgggctatggccccttcctggtttgggagccatagtggagctttcctctctaagctcacccagctcaaactgacaggagaatcttcttcgactgccaagagcggtccaaggcaatggtcagccactgcagcctcctgagatatttttagagactggacctgaggcctctggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatagtacagtggtgctgcacaccctggccctggccccgaggtggctgggaggtggctcctcaaaccgccgctgtctcatcagtgcccggtgctgggtcagggatcgactgaggctctgagctaactgggaaacacagtggccttggagggctggggagcgtcatgggggtggggacagggagtcaccggtcgcatgtgactgaactcttcaccccagtctgtggctttcccgttgcagtgagagccacgagccaaggtgggcacttgatgtcggatctcttcaacaagctggtcatgaggcgcaagggtaggaggcagggccgctgcccgccctgggccagcacctcgtaattctgtcctgcctttttcctcctgtatttaagtctccgggggctgggggaaccagggtttcccaccaaccaccctcactcagccttttccctccaggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttccccgccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcag

SEQ ID NO: 1137 - DNA, 2326 bp, Homo sapiens
tttctcaagccatggctcctccttgctttttatgatccctggtgtccacaatttgaagctctaccctgaagctctatcctgaaatacatttgccctctgttctgccttcatagtgacacaactttaagttcatggctcttttactatccttgtggaatggcatctttttattgtctctgctaaagttcccttctgcgaagagactttcctttaataggactacattactgcattgtccccactttgctcggctggtagccattcccttttacttagaactcttctactgtcacttttgactaataccactgcttatggcaggcagtccatgttcttttcccaaggttctggatatacctagtgctcacttggcagagcccacccgtgtgccaaagactctggtggccccattactcagctggttagttgttaccacttggcagtcctcatgacctttgctgatataactttctgctgaacttttgttctctgctaagcctcctgttttcttctgaagtagtgtgtaccatggctaaatctccttgacttgtttgcacagggataaggcttgtctcagtattttggctgtaaaatgctatcctgaaaggatggcaataagcaatctttacattccactgataagggaatatcgttctctcactgactggcctcttatattgggttaactagaatagactacaggaggtgtgacattgtaagtgaacctggggtgaggcacagggcagacaactccagcaaggcatggaatggatcctgttttgccttccccttaactgagaggcagccacctaacctatgtggtaaatgcctttcctccaaggttaggttcccttagagccctcttcattcactttgtggaatacagagagccaaatacaaatgggcttagttacaatatgtttatacttcaaagttgtctctcaggtatttgacaatcctctccctcactagcctcattcatcttggaaatagaaggagattcctagatatcattgaacattttgaggtaaaatgaatcataaaagagcatatatatcaaatatattttctatggcaatactgaagcccagataggttaagtgttctgctcagagtcttttatctgcttaatggcaaaccttaaactagacccaggcctcccgagtccagtacccttttcattatactgttggtaagactgtgactttaggcactgaatggcataatgaaatcacacagttttgcatgccttatagaaggagggcactctgaacattgtcagttgagtaataactgcctatattttcagggacgtaacaaatcctggaagagccgcacttaccacttgtagatttccatggttatatttctccatacatgctgtcatttaaatgttgtttttcttctcttctcaaagatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggaggcttactcaattccagatatggccgaggatgggttgatcacagacgattagctgtaaacagttttcgatattttggatatggccaaaagtcttttgaatctaaaatcttggaagaaaccaaatttttcaatgatgctattgaaacatacaaaggtagaccttttgactttaaacagttaataacgaatgctgtttcaaacataaccattctgatcatttttggaggacgattcacttatgaagacaccgattttcagcacatgattgagttatttagtgaaaatgtggaactagctgccagtgcctcagtcttcttgtataatgcctttccatggattggcatcctgccttttggaaaacatcaacagctgtttagaaatgcagctggagagacccagaagtgttccatcctgagcgatttctggacagcagtggatattttgccaagaaggaggctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagccaaatg

SEQ ID NO: 1138 - DNA, 2950 bp, Homo sapiens
aaaagaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgaggtatggttgtagccaggatagtgagaaggtggactgagtcttctcctcccagccccaggcatgttatatctcaagggatctggcttctcagaagcaggagccagccctgagccatgtctctctcttcagcattgatgtcagtgaaggagatggctaagggcattacgtatgatgaccccatcaaaaccaggtatgtctgtacagtctgcagttgcccttgcttaggatggtacatgcagggatgctcccaggccagctattcccagggctctcttgatccctgttacccatccacagctggactccaccccgttatgttctgagcatgtctgaagagcgacatgagcgcgtgcggaagaaataccacatcctggtggagggagacggtatcccaccacccatcaagagcttcaaggaaatgaagtttcctgcaggtagtcaggggctggagagagataccacacttttataatcaaatgcctgtgaggttatgtcctggctcccactgagctcagccacatctgcattggatccagtcactggggctggagggatttgaggaggagtttctttaggttccttgttgcctcagctgtacgtgttcattgttctctgctgttacaaagcttcaggaggaaagtgccattgggcatagacactgggtacaaatcctggctgcacctagcctgtgggccttggacaagtctctttttttctttttttttttccactctctctctctctctctgagcctcagtttcatcatctgcaacttgtaggggtagtgccagttttacaggctttggggctctgagaaagtacctgtgagtcatgaagacgatgtcggttggttttcatagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggagtacagctcaccactcctgcgctgcgccctctgcattgggggcatgtccgtgaaagagcagatggagaccatccgacacggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaaggtgccgcccccgcccggccagggcaccctgcaccgccccccactgcacgccacatcagactgcagggaccccatgcccctggccaccccaacccactgctcatactttgtgggctgtgtctcagttgctcagcttccccagaccccatgcccctcagcccagccctgtgtgcccttggtcgcagcccccctcttcctcagggccagcgacagaccctgctcttcagtgccaccatgccgaagaagattcagaactttgctaagagtgcccttgtaaagcctgtgaccatcaatgtggggcgtgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctggaatgggccaggctggtcctggctgcctgttccctgtgctcttcagaattactgtttttgtttccttttaccccagctgccattaaagcccaaacctctagccc

SEQ ID NO: 1139 - DNA, 2423 bp, Homo sapiens
atttaggtttgatccatatcgagttactttttgtatatggtgttaggtaagggtccagcttcattcttctggctgtggatatccagttttcccagcaccagttgttgaaaagactttcttttccccattgaatggtctgggcacccttttcaaaaatcagttgaccaagtattacaaaggtttatttctgtgctctctattttattcccttggtggatgtgtctgtctacatggcagtaccacactgattactttcagctttggaatcagggagtatgtcatctgccattgaatgagtatccactgtgtgctaggccttgtgggtggagcggtgacttggacatcgtccctgctggtccagtgccctgccgtccccctgagtcttgactttattctggatagtggaggttggcacaaaaatatctcccagttaaaggaattataattcagtcacctgactattactgacaagtcaaaaaaaaatgactcagtgggtttagtaccaaggtagcagtgttccatttgatgattcagcatatagcaggttctcttagtgaacatttctctttgtgtatttgtttttcccccacatagcaacgaagttagtttctaatgacttccattctctacttttatcagaagcagatttcacctggaatattctataaaccctttgaaaccctctattttagccatggtgtcttctaagcaaagtaattttcttgaacttaaataacaaattgatagttgaattaaccttttaaaataaaatgtaaagtgtagctaagaaatcattatttaaaggtattccaacgataaattatttgggatggggctggggaggtcaggtatattgaggtgtaagttacatatggtaaaagtcacccttttaaagtgaacaatttgatgaattttgaacaacttcagttatgcaaccaccacaacatgatggattgttttagtaaatgttcttcttaccaggagttcatccttgtttaagtctggagtttgccgtgttaaggttgcaggtgcttgaaagtgtaataaaattgtaggttttttaatcttttttttaatctcttactggaaggatgaattatagtttaaatagtaataatgcattgtcgttgttacacttactctttaagtaagttaggtcattattttccgaaatgaatgtagtagaatttcagaatggcttctggaacatgtttcctgttaaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattggtctgttttgctcatttcttctcttttctttattgagagatttactcgtagaggatatacgttttttctctttttcttgactgtgataacaagttgaaacttgttacaggcttgacagaaatgtagagtgatttccagttttgacaaaagaatggcaagatggcagcatgggaaaatatttctgagcgttggttgatggagagcacgtgatctttttagttaagatcattttaagttatgatgcttccgaatgagcagtgcagaagacacatgaatggtctgttcctgagcgtcagggaaggcatgttgtgtcacatagttgaagtcagtggtcacagacggatgcctcaagagcccataggaatgagatgttttgcttgcggtgaggtcatcttgctgcttcaacacaaatgccaggctccccgagccaggccaacttgtggataagcccagccagagcacagaatcgagtttaaatccagccttccaccccatgcccacaagtggtgtactttagaaatagttacttcccagtagcaccaacatacttcccagtagcaccaacatgaaaatcaggcaaactgttgttgtttagtcccagacacacctggtagtgtttctcttctctgtggatctcctttcctcaaagccctggttcttcacctctcatctctcccgcccaggctgtgccctgcccacccatcaagatggatgtactttgggaggccagggtgggcggatcacaaggtcaggacttcgagatcagcctggccgacatggtgaaaccccatctctactaaagatacaaaaaattagcagggcatggtggtgcgtgcctatagttccagctactgaggaggctgaggcaggagaatcgcttgaacccagaaggcggaggttgcagtgagctgagatcgcaccactgcactccagcctggtgacagagcgagactccatctcaaaaaaccaataaaattgatgtgacatg

SEQ ID NO: 1140 - DNA, 2281 bp, Homo sapiens
tttcttcatctcagagcccagtcctgggacaggcacggccaagccactcagagaacgacgcggtttccgatgtgtgttcactggtctctctctgggtcaggcctctgggtccctcttgttccagtgacaccttcttgacctgtttttaacaaatggcctttgcaaccctgtcttgtcttccctcttctttactctggaggcatcaggatggtagccctgttcccgggggcagcaggtggaattgggcctgtgtgtctctgcagaaagtttctgttcttaactgggctttgtggctcacgcctataatcccagcactttgggaggctgaggcggacagatcgctggagcccaggagttcaagaccagcttgggcaacagtgatacctcctctctacaaaaaatgtaaaaattagccaggcatggtggcgcatgcctgtggtcccagctacttgggaggctgaggcaagaggatcgcttgaggccgggaggcaaaggctgcagagagctgagatcacgccattgcactctggcctgggtgacagagtggagaccctgtctcaaacaaaaaaaagtttctgttcttttctagctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaaggtgggtgggtgggcagctcttcctgggagcccagaggcctcaacccatggcccctggagcatctgctgtgccttatggagccggcgtctccagacagcaacctttcacccctggagcatctgctgtaccacatggagccggcgtctccagacagggacctgtcactgccgatgggcctggcagccctcaaggacaggttggcctgaggccaggggggcagggcagagtcaggccccaggctgtgctgctccccacgtgcccagatggctcagcgctggtgggggtggggtgggcgggcgttacaggagtgagtgccccggggtgtttgcagagactgttgagggcaggcgtctcttgggggctgctctgggtactgagcctcccaacccaggacgctcactggggggtgaggatgcagcggtcaggctgtcactgtgccggccctgagacacgccctgctctgtggcttggccgatgcccagctctgcaggccacatgcgcctgtgaccttggggtcctttcacaggcaccagggaccatccccttctccctcggagtctggggcctgggatgggccaaggggttgcaccaccagaaccagggtttgtgtcctcggtgaacatctggctgagacgagggtccctctggccccaggccctgaaacatgaagaccacctggccctgtgtcatccggagtgggctctatatagttgagggcagggcgtgcagtgggacagtgtctgtgagccgggctgagcccaccccacgtgaccaggcacttcctcagcgttgtgcctcagtttccgcggtgcagaggaggagggcaggcaggtgcccagggctcggcaagctccgtgtctcccgcagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggccgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgac

SEQ ID NO: 1141 - DNA, 3147 bp, Homo sapiens
gaggcaaagccgggagaaactgctgagacgaggtggcagcggggaccacgtgagatggcgtatgtggccttgagcgataaacctcacctgtcgggggaggtgggcgaggaagcctgcagctcctggaacccaccacttttctctcccaggcccttgcccaggctgtggcctctgcctggaaccccttttcttcccatccgagcccttcccttcagtgcctcttcctctgggaagtcctctctggtgcccagcccgtcctcttctgcccactctgggtttcgcaccccatgcttaggccctgattgcctgctttgcacacagggctgtgagctccatgagggcaggaaccacatggctgttcacagctgtgttgccagggcctggcctggagaccctcaggaagtgagacatctgaatcctctgctctgtgaccctggcagccaggtagagccatcttggccatggcacccaggcttggagcaagcagcagcctcatgggtggggaaccacgtttccccagcacatcggcaggccctaaggggacattcgcttggctctgccctcagagcactgatgcccgggagacactgccctttgtgtgtcccatgtaagagaggatgcgaccttagagggggcaggggtaaacatggtcccaggccctgttgtcccctcctaagaaagttcccagttctgcctgtccatccctggccttttccctgtgctgtctgggacagtgggtggagctgccgctgagcggtgggacctagaaaacacatactgacctataggaggcactgcccagagctcctaactggggtggggtgcaagggaaaggtgggtgagggaggcagagagaaatcatattagtagctcacacgtcaacagtctagctgtgtgcctgcctctctcatgcacttcatggggattatttcctagaattcccacaagagccccttgcaggtggtgcgattgttagctataatttgaagatgaggaaactgaggcacagagtagttaagcaatgcacccaggagcccacagctagggaggacagaggctggatccagcccagtcccctgtctcctggggccaggcccagtgctcccacctctctgataaggataaaaaggagggagcgggaagggagatattccagaggcaactaccatgagacctcccggcagagaggcttgaaaacgtcttttgtgtgtggtacgcaaaccatttcccctttggtgtctctttgaaagatttcgggaagatttaaacttttttttcaatgatttggggatgtcagactggtgtttttttgagggtgacaccgtgatgagactggcccccaaggcagccccgttttactcaggttatggtaatagaacttctgcagcctcaaaagcagcttccgccgactgagcgctcaccccggggtccgtgctggactcagccttgactcggatgcccaccctgagccccacccgagaaagggattatttcatccctgcattatttccttagagctgatggcagaatctgctcatctccaaattcgctgtctccccgttaggagtgagcttggtgagggccccaatctggtctcccccgttcattgctgagtccctggcacccagcatcagccccgcatggagcagctagtcaataaagctttgctggacacatttcagatgaagagactgagggtcagagaggtcacatggcttgcttggaagaaacatcagatttgtctggctcaagagtccacttctggctcccccctcacacagttgcttaagagacccccagcccaagacagcctcagagcctgggtcttccccccctccgcccattctcaggcccttatactaaaaccagagaggcctctgaactgctgtctgcccccccaaccttttccttgcttatctgggaatcaggcaaaagttggccagagttagctcagtctcagagaagctgcattcttctagagtcactcggttttgcgtgacctgattcaaattttccatctttgtcactttgattcccactctgagaagttttctcagtacatataaccttactatgtgatgactggcctgggtattcatatgtgcacttgttacctgttgcttatctcctgggggacccctggttcagaggggtttaagcaggtgtcctggtgagaccggggttataatcagagactctcagggttagagcttggccctgccactgagtggccttgggagtctcatttgacctctctgaaccttggattcctcacttgtgaaatggggacaggttgagttcctgcatggaaagtgtcttgcttgatgtctcgccaaaagaccaaaactgccgtcactcactgccggagaggccctgcacgtggatattagagtttgctgggttttgtttgtcctgagcgaatgtccgtccatgtacaggctgatggattttgtaggtgcaaggtccctaacgcaatcaatctctctcctcaaaagaccatgagcatgcctggactcagagagcaccgtgtgtggggggctggcgtgggcacgtgtccgcagctgggactggcttctagggttctgggctcaggcaggagggcggggtcccaggaggtcatctctctctccttaccctggagcctttggaatttggtttccaaatgtcctgaattcctgttcattaatatgtggctcagtacagtgcttgtcccggcagcaggagcttggttggtgttagtctgctggggaatgggataaagcagagaaatgtcaagctttcccttaaaaacaaaaaacaaaagcaaaccctcacatctcccaccaataacacaccattgttatccctgtacttaagacatgttgttgccgggcatggtagctcacacttgtaatcccgacactttgggaggctgaggcgggtgggtcacctgaggttgggagtttgagaccagcctgaccaacatggagaaacctcgtctctactaaaaatacaaaattagccgggcatggtggtgcatgcctgtaatcccagctgctggggaggctgaggcaggagaatggctggaacccgggaggtggaggttgtggtgagctgagatcgcaccattgccctccagcctgggcaacaagagcaaaactctgtaag

SEQ ID NO: 1142 - DNA, 2037 bp, Homo sapiens
agggccaaggagcggcccccgcgcgcgcggcccgccagcacctctccgtccccgggcgcgcacggccggcgcggcggcccagaagggaagagctcgtcgcgcagccccggcccgcacccccgctcctggagctccagccgctcgccctccaaatctcgctcgcgctctgcggagaagcggccccacagccccagccgctcgccgtcgcccaagaagcccctcagccgggacaaggacggcgagggccgcgcaaggcactctgaggccgaggccacccgcgcccggcgccgctcccgcagctactcgcccatccgcaagcggcgccgggactcgccaagcttcatggagccgcggcgcatcaccagcgcccgcaagcgtcctattccatactaccggcccagcccctcttcctcctccagctgcttgagcagcgactactcgacccggagccacagccgcagccccagccccggccacagccacgggagctacagcagtcgcagccatgggacccgcagccggacacgcagcccctcgaggacccccagtcccagctaccacagccggagcagctctgagagcgggggcttctgagcccagacagactcagcttggtgcccccctggcactgggagaggcgaggggcgggccccaggaccccagtggggagggggctatatctccttgcccccaaggctacaaagaggtctcagggccagtgcacgggcagatgggaccggggaagactttgagggtgggcatccagtggacaaggagaagccagatgtgctgcttctacgggtgtcctctcccacctcctgtccacccactgtgcccggggaacaaagagccgttacgaacacaggaatctccccatcccccttcctgctgatgccaactcaccaggcttgggactgctgccggtggatggtaccagagtccatgatctgctctgtcacttcaccttagctcagtgcagccagggacaccttgcaaggtgccagccctgggagcccctcttccgcactacacagctccctccactcctctcttatcactgggcagacgaggaggtggtacagcacatgggtttggagctagacagaaggaagaacagcctaacccttggtgcacccccatccaagctggggagctgcatccttttgagctggctgcaggaggaccctggctgagggctggtggctggccccacagcctcccccaagctcctccactgacccaggagtgcccagacgggtggcccccaaaatcccagcctggggagctaggcacctcactcttggtctgacctctccaggccaggctctcctcaccccatgccctgggccaaggtcctaccagccatgactactgcatgacaagaggtggggggtacagacctcaggtacatttgaccctgaggttaaaaggggttcaggtcaagaggtgggagaggaaaggggtagatgggaggtggaatctgtaggaaagagaaaaagcaaagtcgttcactgactgagtagcccccagggagtggagacgggtccctggggagggagcagctgacaggtcagcagtgcccccagccccacccaagaggagggcagcgtgtgcctgtggtctgggacgtgggctggatggcagcccagggtcacaggcataggataacatgtgctttggacctgacaagggagtaccttgggggtctgatggggtcatggccagccgagcctctgtagagatggaggctacagccctcagaagggaggggaggaaagagactgagggccctggcctggggcgtcgatggggaagcggtggcccccagtcctcttctgctgctcccagccccctcctcctggggccctcagggatctcatgaagtcttccttggcccaaccaggcagatgccccgggctccagtggggggaggggtctggggtctggtccgggttccccgctttctctatgtcccccctccctctttctccgcagtgcggataaaaattggactcgaataaaacccttggtgcccgg

SEQ ID NO: 1143 - DNA, 2685 bp, Homo sapiens
ctttagctgtaactccggcgggcgtgttgggtgtgtcgttttaggctctgtgacccaggagcaagacgcaataagcgggtgcagtggaggtagaaacgggaaatgcagtaccctttccggaagctactccgcccctcgacagagtcttgctgtgtcgcccaagctagagtgcagtggtgtcatctgggctcattgcaacctccacttcctggattcaagcaattctcatgccacagcctcccaagtagctgggactacagatggagtctcactctgtcacccaggctggagtgcagtggcgcagtctcagctcactgcaacctctgcctcccggatttaggcgattctcctgcttcaacctcccgagtagctgggacgacaggcgcgcaccaccatgcccaggaacctgtggtgataaggaagatgtgagcctggagatacagaagctaccacatgaatgttaaaaatgaagctgacgcagcaaaaggcagtgccaaggaactaaaagaaaacaaattttgattacatttttggagttcctgggtcaagcagttcatgacactgaggcttttccgctacatgaataagtactttttctttcccgttaaagtgggtttgtgctggcttctctatcactcacaacaactggatactaactgaggcaacacttcctacctcttacacacattacacccataaaacagaaacaacatctaaaattagatttcaacacagctaccaagcagaaaagttcaaatcaacaagttatggataatgttttattgaaactacatttctcctcccaatgtgagtatggtgttggccaacatgttgcgtgttgattctgcttgcctttgtgtcctacatataggatgtgtactgtgtaatgaatcgtttcttcattatttttctcagcttgcatggttgcctccctcacctccattcacagagctcactgtgacagcattcaaccttgtcttggtacaagtgtgtaatttacataatagtcgcctctgtactttcctcagtaacttaaacaaagaagaccatcactcactgtgcttgcctttcaaattagatttgatatcaaattaaagtctcattttattaagtttctgaagccaaagtctttgacctatgaaagtatgtttcaattatgaatggaaaagagaagctttgtgttattaacaggaaaagaattcaagtgtgatggttgtgtcaatgccattgggacatgccagtagtcagtaactcaacagacaagcctgctagacctgctttactcatttgtggcgctgtttcttcactttctactgactcccacctgtgtttcataattctctacattgatatggtttattacttctcatagggatcttaaattaattgtgcaactcgttagagtctctttatgtaaaatacatagtcttcatactattagaatgttacaatctggacctaccaatgtgaacaagtgaaaaaatgtgctgtttattttaaccagcagtggtgttttagttagctatttatctccttatctcccaaatctcaaaaacactcagtagtttacaacatgaagcttttttttttttttttttgcttacaggtctgtgggtcagctgggataactctgcttcagactgtgggtcatcttggcttggcagactttaggttaaacataagactgtgtgtctcattctggggcccagactgaagggatagcagctagctggtgcatgctgtcttcgtggcaatcacaggggtgcgagaggcggagctgaaggacgcaagcacatttaagtcttttgcgtgtgtcatgttcaatgacattccatgtccagagccagctacatgggtggatcatgaatagaggggagaaatacaccccacccacttcagtgagctttaggtttacatgactgagggatggagggaagaattttggacaataatctcatctagtacatatggcttcaatttgtatgaaccctatctctactcctccaaccttctgatctcaactgctattgctaatatgacctgtgggagcgagaggactttctataactaggctgaattttaaaggaagagaatgacttccagatagcttattggctatcaatctaggagctcttacagctgagaaacattttgacccaaccctctggcttctttgttgatttatttttctgataaaattcatttttttaaatattaagctttaagaagtacatgtgttttaatgcagtaaaaaataaagcatatatgattcaatcatttgtaaatatacagtataactagtaagaaataaggggtctcattcacacccagatttataggagccagcactatgtgctcggtatataatagaagctcagttagtatttgttgattgaagtaccttttcttatttactaatgattattattaacagataataatttgggcctgaaatagacatttccttttttaatataattatatacatgtgcatatatatatcatcaatatcctctgactttattagtgactgttaaccacgtcgaaaaaagtaaaggtgtttattatgcatgcatagaaaaatgatatgtttgtgttcgctctttttaggaccaagaaaaaattattggttgctgttttctcagttttggttttttttaaaataaattttactgtgtgtatttg

SEQ ID NO: 1144 - DNA, 3354 bp, Homo sapiens
aactttttccaagacttggtaacaaagcattatctatctgtatgagagaaaaggggaggaggactgctgaaaaaagggacgggttaagggttttgcactatagtttagctcttccagcagaacgcggcgctgtcaagctgtcaatgtctgtctaccgcctcggagacacaggccgccgggaaaccacagggtcgacgggaacggcggagtgtagcatccccgggccccaagtccacagtgcctctcccacttgacctgtcggcgccccttctcaaagtacggatctccaagaggaaggacctcctccctctccactctcagagtaaagcaagccagcagcgcaaagtgcacctcccggggacgcacagacacgactgaaagccaccaccccagaaacagacccttcctgggaaaatgctccttccagaaccttctcaacaccacccgtttcccctgggagcgtttactttggatcagcgagatggaaaacaaaggctcaggagaacaggccgggcccctccccagagcccgccgccagctggcccaggtgcgccaggtgcgccctggaggcgtggggacgagggaccggggcctgcggggggggaagcaggagggccctgcggggctgccccgggaggatgcgcctctgggggctgcggggtgatgggtgtatcccttacggtctccctcagcttcctctcgtggtccagctcgcgctgcggggtgcccgcgcgctcctcagcggcgtccgcctgctcctgcaggctccggatcttcctgcgcaccgcctccagcgagctactccccgccatcgcgccggacggtaggcgggcgggagggctgcagtgggagaggccggctgctgccctgcggacccggctgccgcggctgtcctggctgcccagcgccggtccgccccgcccaggcctctctgtgcgacggcggcgccccctgcggccaggagcagtccggaagtcgcagcctccagggctgcgcagacaaaccgcaggcgggcgcgcgcggctgggaggggcgcgcgccgtggatcccgggactggctgggggcactgcgcatgctcgcggcggcggggagaaaggcgctcccggcgcgctgcgggggtacctggtgagctgggcgctccgggaggccactgcactagggctctggcttccacttctagggcccctccgcggcgcggtggtgacccggggtaacggagctggctgctaagggcaatagcgactcctgctggccgcgggagcgctccgctcccgagtccagattcccatgcccaggagccagagaagctgagcggcgggtctggagccggaatatgccctaaagggcctgatcccaactgcaagattataacccaagcactacccccattccccaaaacttcacgaagtgaaaaccacccgcgtgtagagcacagtggttagacctcctgttctaaatgcagttttcctaggttgactctggctcctagtttcctgctgcgtgacttcggacacattacctgtcttctctgggcgtcatctgtaaaagtgggaataataatagtactttccccatggggctgctatgaggattatgaaggactgtaaagcgcttagcacaataccttgtacatagttaaaaactcaaatgatagctacgattaagaaatacacaagcgttgttttaagagtcaggctgaggcccataatcagctgtgtaatctcaggccagcctccctggggctcactttccatgaaaacagtcatccaaatggtctcttctctttacagccttctttggtgtcagaccagcctctgagatctcctggaatccagtcagtcctgggctggactgggatgcctttaaaaggcaccccaaggaaagccacagaaccctatgagagagcctctggctacaggtggagaaaaccaccgcagatacagtctccaccgatttcccccttgagctgtattcttaaatgccttctaagtctcagggctttttctcctcaggtttgtcacagaaagctcttaaagccagctcccttatgtgtgggaataataaagaaaacatgcttgacaaccctctcctcctccaagccctaacaaggaacttttgctttcctgcctcattttctgtggagttcttcacagcctctgctgagactctcacaaatcccagcttgggtccttgcatcctgtaggtgggagcttctcgctttgtttccccgcggttcatctggtcaggtggggaggttacagctggtcccctaagtgcagagactgtgggcctccaacattgagaatgggggaaccgggtgtctggcaacctccaggagcagccaggaaactgctggacactggcaagtgccataagcagccaactagtgacttaatgtcctgggaaggtcagtttcaggtgagttcattttcatgccgatgtcattatacaagagtttaggagagttttctcatccttgtctgtaggttggaatcacttgggtattttttaaatgctgccgcctgggttgcatccccagggattctgatttaactggctttgggtgcatcctaactttgggttttaaaagctccctaagtgattatgtttagagaaggttgagaatccctaagttaagaagtaaagacctacaaagggataaagactcatatgctataaatatcagatatatcacagttactggggaagagattgggggccagaaaaaaatggagtcttcgatccccttcagcctcacttttgacttaggtggaaagacaacacaaaattcgaaacaagaccatcagggatactactcctgaatgacaatcttctaagctaggtagagcccacttccagaataggatttgtaaagtagtagaaaaatgtttttagtaataatagtagaaaaatgtaaaagtgttttacactggtgaataatgacaatgaaatgtcctaatcccaaaggtaatacgattccacctcaggaagctgacttctcccttaccggacttctccctttttctagtgacatctgtctcttcctcctcaagttttgactattttttagtaaataaaaaacgaatactctcaatatggtcatgcactgcataatgatgttttggtcaatgaggggctgcatatatgagagtagcctcataagattacaatagaactaaaaaattcctatcgcctggtgatttgtgttacaattgttgacagtattcagtacagtaacacactgtacaagtttgtagcctaggtgtttagtaggctataccctctgggtttgtgtaagtaccatacactctaaggtgtttgcacaatgaataaatcacctaacgacacatgtc

SEQ ID NO: 1145 - DNA, 2112 bp, Homo sapiens
ctccttggaggcaagagctacaacagctgagacagaaaagaggtaaggaagtgttgggggctgggacaaccagctccccaacaactcctaggtgtttaaagaaggaggcaggaagacttgtgaagatgggaactatacaagaggcaggaaaaaagacagatgttggggtcagggagattgcagaagcaccagaactaggagcagccctgagacatggggagttggagctgaaggaggaatggcaggatgaagaattccctagattgcttcctgaggaggctggcacttctgaagatcctgaagaccctaaaggagattcacaggcagctgcgggtacccccagcactttagccctgtgtggccagcgccctatgcgcaagcgtctttctgccccagagttgcggctgagtctgactaaggggcctggaaatgatggagcttcacccacccagtctgcaccttcctctcctgatggcagttctgacctggagatagacgaattggagacaccttcagactcggagcagctggacagtggacatgaatttgaatgggaagatgaactaccccgggcagagggtctgggcaccagtgagacagctgaaaggctgggccgaggttgtatgtgggatgtgactggagaagatggacatcactggagggtgttccgaatgggaccacgggagcagcgcgtagacatgactgtcattgagccctataagaaagtcctgtctcatggaggttaccacggtgatggcctcaatgctgtcatcctttttgcttcctgttatctacccagaagcagcatccccaactacacctatgtcatggaacacttgtttaggtatatggtgggaactctggagctgctagtagctgaaaattacctgcttgttcatttgagtggaggcacaagcagggcccaagttccacctctaagctggatacgtcagtgttaccgtaccctggatcggcggctacggaaaaacctgcgagccctggtggttgtccatgctacatggtatgtgaaagcatttctggcactgcttcggcccttcatcagttccaaattcacacgaaaaatccgttttctggacagcctgggggagctggcccaactcatatccctggatcaagtccacatccctgaagctgtcagacagctggaccgggatctccatggctcaggagggacatagcacaggactggataaagggccttagaaccagttagtgatctgcctacacctgaatccctgaaacatctgaactgttttgtaaatcatcttatccccaacctcagtaccaccggatcttcacttctcagtgggattttgtcctttgcatgaccctactttcagcagggctttgaggctgggaaactcatctgctgggtgactttcattccagttgctgggacggaaggctgaatgtagggtcattttgtatgggatatgcagagctctgggtttttttgttttttgttttttgagacggagtctcgctctgtcgccaggctggagtgcagtggtgcgatctcggctcactgcaacctccgcctcccggttcaagccattcttctgcctcagcctcagcgagtagctgagactaccggcgcacgccaccacgcccagctaattgttttgtatttttagtagagacggggtttcaccatgttggccaggatggtctcgatctcttgacctcgtgatctgcccgcctcggcctcccaaagtgccgagattacaggtgtgagccaccgcgctcggccagagctctgggttttaatcctactttagctgtagaaccttgggcaaataacttcatctttttgggtcctaattttcctcctgtctaactggagggactgtgatccttccaccttggatggaagaggcttacctgacagccagcctgcctgctgggagccaggagagtcagctcattaaatcttgaagaaccgctgtatgccctttttccttctaagtcatgtctgctgcctgtgagcctgggaaggagtgctttcaaaacctgtatttttgccctctttagtaaatttagaactgtagaggctaataaactgcgatgagacatttaagctctgctccaaag

SEQ ID NO: 1146 - DNA, 2293 bp, Homo sapiens
aacaataccttcctggtcctaaatataactatatccatacacatatgtaacccacctttttgacaatggagccactgtcttctttgctgttttcatggcagtctgggcaacagttttcctggagttttggaaaagacggcgagcagtaattgcttatgactgggatttgatagactgggaagaagaggagatctgcgtggtgattgctgccgtgttcgggatcgtcatttaccgggtggtgactgtcagcactttcgctgcctttaagtgggcgttaatcaggaataactctcaggttgcaaccacagggactgctgtgtgcatcaacttctgtatcattatgttgctgaatgtgctctatgaaaaagttgccctgcttctgacgaatttagaacagcctcgcacagagtctgagtgggagaacagcttcaccctgaaaatgtttctttttcagtttgtcaatctgaacagctccacattttacatcgcattcttcctcggaagatttacaggacacccaggtgcctacttgaggctgataaacaggtggagactagaagagtgccaccctagtggatgccttattgatctgtgtatgcaaatgggtattataatggtgctaaagcagacctggaataatttcatggaacttggctacccgttaattcagaattggtggactagaagaaaagtacgacaagaacatggacctgaaaggaaaataagtttcccacaatgggaaaaggactataaccttcagccgatgaatgcctatggactcttcgatgaatacttagaaatgattcttcagtttggattcacaactatctttgtggcagcttttcccctagcaccacttctggccttactgaataacataattgaaattcgacttgatgcttacaaatttgtcacacagtggaggagacctttagcttcaagggccaaagacataggaatttggtatggaattcttgaaggcattggaattctctctgttatcacaaatgcatttgtcatagcgataacatctgactttatccctcgcttggtgtatgcttataagtatggaccttgtgcaggccaaggagaagctgggcaaaagtgcatggttggctatgtgaatgccagcttgtctgtatttcgaatttctgactttgagaaccgatctgagcctgaatctgatggcagtgagttctcggggactcctcttaagtactgcagataccgggactaccgtgacccgcctcattcactggtgccctatggctacacactgcagttttggcatgtcctagctgctcgattagcttttatcattgtctttgagcacctcgtgttttgtataaagcacctcatttcatatctgatcccagacctcccaaaagacctaagggatcgaatgagaagagagaagtacttgattcaggagatgatgtatgaagcagaactggaacgtctccagaaggaacgaaaggagaggaagaagaatggaaaagcacaccacaacgagtggccgtgaccataaaatagtccctttccaggccaaggacctgaattctgtttacttcttctggctgtgcaaaagcacactcaagtgaatgactaaaaatgcaaccacagtgcatgttgcagataccggcggccgcaggaggggcagcatccagtagaggactggcgttggagtcacactgctgtgaaatcacgttgcagtccagcgcacaattgctatctatccatagaccattcttgaccaagcaagcatgcacattatgggcagttacattctcaagtttttaaaatcaaggggaacttgtatactgggcctgtttttcagcctgtttgctaccttttttgcattctatcccatgtgaattttacagacactgggctaaaaagggtattcagacacatggacacacattcctagaatgtcatcatatggtcctaattccatgtcaccaacaacacagacaagaccctgtttacaactttttctttccttttttttaattttagacctttctgagaagattattatatatgacatatctatagctatgtgtatggccatagatgtatttctgtgtgtacatatgtatagtcatgtattcctgcatatgtacatacaaatacagagatatataaagtacatagaaattccttacttgtaaatagccaaaaagtactgacatgagtgaattttcacatttaaatagtcatcaatatgaagccatggttaatgcttgtataatgtgatgcaataaaatttaaaataaatttctgcacatgg

SEQ ID NO: 1147 - DNA, 2776 bp, Homo sapiens
atttaacattgaagagcggaaggtggcggagactcggcgcgccccaggccccgggtgcacgtgggggcgccggtgcccggatgatggagtgtcccgatccgtgcaatccctggcggggctgggttctcagagaaagaaaacgtgatgcagcagaggatgggattgaagaaacaggagagtgaagtggaaatagcctggcccgcgtgacttaaaccggcccggagatgtgcgggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtggtgctgtaaggggtgactggagggagaagcctggctgctggtcacaccgcttcccttgtcctggccggcatgctctggtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggctttgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtatccagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaaacatttgcctatgactcc

SEQ ID NO: 1148 - DNA, 2349 bp, Homo sapiens
cttttattttctgttcctctaagggaagagagaccaaagagaattctactttgaccctggcttaagagtggaacatagatgtctataaaactatgtggtaccagcatgttatgaagaataagcaagaagaaagagaaggagaagaagcaggaggaggaggagagaaggaaagggaggaggaggaggagaaaaagatggtggtagaggaggaggagaagaagaagaaggaggagaaggagaaggagaagaaggagcaggaggaggaggaagaagaagaagaggagaagggaactcacatgctacctgtgtgagtcacatgtcagtgcaatttctggaggtcaattgtagccctgaagtctcagaacaatggcaaaaagaaatacggagggcatgatacatttggcagactaaaattctcaagattcctatgcagtcgagttttaccatatgactgagttccaacaaagaaatatgagtagaagattgtataagcatcatttttgacccagggctttaagaagcagactatggaaatgatgttagacaaaaagcaaatttgagcaattttgttattcgggttcaaaatgggtcgtaaagcagcagagacaactctcaaaacatcagcaacacatttggcgcgggaactgctaatgaacgtacagtggagtggtggttcaagaagttttgcgaaggaaacgagaggcttgaagacgaagagtgtagtggccagccattggaagtagacaacgacaaattgagagcaatcattgaagctgatcctcttacaactacaggagaagttgccaaggaactcaccatcaatcattctatagtagtttggcatttgaagcagatcggaaaggtgaaaaagcttgataagtgaatgcctcatgaacagagcaaaaattttaaaacattgttgttttgaagtgacgtcttctcttattttacacaacaatgaaccatttctggatcgaattatgacatgtgatgaaaagtggattttatatgacaagctgcaaaaaccagctcagtggttggatggagaagaagcttcaaagcacttcccaaagctgaacttgcaccaacaaaagctcatggtcacaatttggtggtctgccgccagcctgatctactacagctttcggaatcccagcgaaaccattatgtctgagaaatatgctcagcaaatcgatgagatgtgccaaaaacttcaaggcctgcagccggcattggtcaaccaaaaggatccaattcttctctaccacaacgcctgaccacatgtcacataaccaacccttcaaaagttgaataaattggtctacaaaattgccttatctgccatattcacctgacctctcaccaaccaactaccacttcttcagtttgtctcttccagaatcaaagctataaaactacaaatggttctccaaatggagccccagatgcagtccatgactaagatctactgcggacctctggaccggcctgctagcccagctcccacattaatgacatcaaaggcacccctcccgaggaaatctcaactgcatgacacctactacgccccaattcagcaggaagcagttagagtggtcgttggccaacctccccaacagcacttgggttttcctgttgagatgggggactgagagacaggactagctggatttcctaggccaactaagaatccctaagcctagctgggaaggtgactacacccacctttaaccactaggcttgcaacttagctcacacccgaccaatcaggtagtaaagagagcttgctaaaatgctaattaggcaaaaacaggaggtaaagaaatagccagtcatctatcgcctgacagcacaaggggcgggacaatgatcaggatataaactcaggcattcaagccagcaatggctacccactttgggtcccctcccattttatgggagctctgttttcactctattaaatctttcaactaccaaaaaaaaaaaaaaagaaaagaaaaacaattaacttttttatatatcagttaaattcatccatgatgttttttatgttatgttttctgtattcttactggtcatttttctatttgttctatcaagtatccaggaatatgtgttaaagatgtccacttcaattgtgaatttcttgagttgttctttcagttttgttctttttttaccttatgcattttgaagttgtattatttcctgcatacaaatgtagaattgtggtgtcattcttttggagtaaaccatgatcattactggcatgacttacttactatctatctagacatgttgattgcttcaatttctactttaatcttaataaaaatacaccaacttttt

SEQ ID NO: 1149 - DNA, 3046 bp, Homo sapiens
atttaatctggccaaagcctggtagaagatgtccctgtagagcagccccagggaagggggattcaagaagctataaatgcctctgggctcacctgaatgtgtttgactgatgagtggggttttttgtttttttttttcttcctaggagtgcctgaagctgaagtcacttggttcaggaataaaagcaaactgggctccccgcaccatctgcacgaaggctccttgctgctcacaaacgtgtcctcctcggatcagggcctgtactcctgcagggcggccaatcttcatggagagctgactgagagcacccagctgctgatcctagatcccccccaagtccccacacagttggaagacatcagggccttgctcgctgccactggaccgaaccttccttcagtgctgacgtctcctctgggaacacagctggtcctgggtcctgggaattctgctctccttggctgccccatcaaaggtcaccctgtccctaatatcacctggtttcatggtggtcagccaattgtcactgccacaggactgacgcatcacatcttggcagctggacagatccttcaagttgcaaaccttagcggtgggtctcaaggggaattcagctgccttgctcagaatgaggcaggggtgctcatgcagaaggcatctttagtgatccaagattactggtggtctgtggacagactggcaacctgctcagcctcctgtggtaaccggggggttcagcagccccgcttgaggtgcctgctgaacagcacggaggtcaaccctgcccactgcgcagggaaggttcgccctgcggtgcagcccatcgcgtgcaaccggagagactgcccttctcgtgcaatgggccttgcatcgggcctcacctagctgtgcaacacagacaagtcttctgccagacacgggatggcatcaccttaccatcagagcagtgcagtgctcttccgaggcctgtgagcacccagaactgctggtcagaggcctgcagtgtacactggagagtcagcctgtggaccctgtgcacagctgcctgtggcaactacggcttccagtcccggcgtgtggagtgtgtgcatgcccgcaccaacaaggcagtgcctgagcacctgtgctcctgggggccccggcctgccaactggcagcgctgcaacatcaccccatgtgaaaacatggagtgcagagacaccaccaggtactgcgagaaggtgaaacagctgaaactctgccaactcagccagtttaaatctcgctgctgtggaacttgtggcaaagcgtgaagatagggtgtggggaaaaactctaccctggccacacgaaggactcacgcaaccacctcggacagaacctaagctttcttcattttatttatttatttccccctccccactccacacacacccttccaacctcctccacctccaccttcaagcataaggacgtccgcgtgttttctctttcagttagctggaggacaggatgttgggaaaggaaaggacagatgtctaaaggaggttgcagagcaggccaggcagacagtgggggctcccttgaagagcttcctccctcccaaacctgggtctcaaagacctagaaagaggcaggcacagcccctgcggacagcagggagccagaaggtttgtagcctattggtgcaaacattggacaaattcctgtgtctttcctagaagcgcactatcacaaacacaggagtgttttgctcctttgtctcctcttccccatctatgtccctttagtcacagttaggacaaatggggaggggacaccatgctgaggcagaaactagcccagaactcactcagttcttctagtgggtgagtgcagagagagaagaactcagaccaccagtagggagaggtaaaaaagcaaacaaagcaggctctaaggcacacaacattgcagaaaatgaggaagggaggggagggaagggacagaagcaaaaaggagcctgtggtgttccccagtggggcagggtgagcaggggcttccaggctgcatgaggctcatggaccagctctgatcccatgcatgtgcgcatgctcagagccctgctgcccacaacagagcactgcgctgcgtgggagtccccacttcccaggctatcagagtcaacgtcctgcctgtgcagctgcagcaaagccagtgagaggtgggtctcgccatgcagtaaggccaccctggcacctctttatctaaatccgaagtcccctagccccgcactaactaactgctgctgtgggccagggccattttgagcatgaatggcccaggttttttgccttctaggacctttgctgctccaccgaagggccagggactatggttaacttatcaacatcaacccattaactagtcactgtgccagagagtatctgtcaggctgtcaggctgtcaggttgtagcaacctcttcattccagagctagcccagggaccggggtgggacaatgggtttatgcgtgtccacagtacaccctccctctcccagcctccaccccagggtctgcaggtcctccggcatgtagtatttatctagcaaggcggggtggtggaggcagcaccctggcaaagcagctcacacactgcagccacactcatcagctgtggtgaggcggctggagcaaagtcaaagtcatgcagcaaaatgaaaactctgggactcttcggcaaaatcctcattaagccgagcagctttggccaagtaatttttgcctccttccctcgcgtggcctgagtttaggagcaagggtggccagagtcccttacccacagataagcctcccctcatgaaatgccactcaccccgggctaccattgacatcagggctgcatttccagccagcctggaagtaaaatttgagaggaagacaatattaatctgtgtccccacctagtgagctgtggacaggtttaagttgggtctccttcttcttcaccacaaaaacaggctctaagaaatcatgttactaaaaaatcagtgtaaagtctgtttaaaataaaaaagaatgttttct

SEQ ID NO: 1150 - DNA, 2835 bp, Homo sapiens
ctctttagtgaggcacgcggccgggcggctccaaggctgccggctagggtgagcagcggagcgcttgggcttggagtagcaaagaacgcgctctccagagaaagtatagccactgcttagacagccagggaaacgtgtgcggggaagtggaggactcaggctctcgtgcgagagcggagttggacgtgcagggccgctggggtcacgcggagctctcccgcctcccctccgcgtgagctctgggatggtccgcgccgggagcgcgcgcgaggcttgaagcgcgggtgaagcgcgcaggtcggagtgacagctgcgctgccggcccggctgcggtcagcaacgcgccatggacgcagagctggcagaggtgcgcgccttgcaagctgagatcgcggccctgcggcgagcgtgtgaggacccaccggcgccctgggaagagaagtcccgagtccaaaaatcttttcaagccatacaccaattcaatttggaaggatggaagtcttcaaaagatctgaaaaatcagcttggacatttagaatcagaactttcatttctaagtacgcttactggcatcaatataagaaatcactccaagcagacagaagacctaacaagcactgagatgacagaaaagagtattagaaaagttctacagagacacagattatcaggaaattgccacatggttacatttcaacttgaatttcagattctggaaattcagaataaggagagattatcttctgctgttactgacctcaacataataatggagcccacagaatgctcagaattaagtgaatttgtgtctagagcagaagagagaaaagatctgttcatgtttttccgaagcctgcatttttttgtggagtggtttgaatatcgtaagcgcacgtttaaacatctcaaggaaaagtacccagatgccgtgtacctctcggaggggccctcctcctgctccatggggatccgcagcgccagccggccagggtttgaattagtcattgtttggaggatacaaatagatgaagatgggaaggtttttccaaagctggatcttctcaccaaagtcccacagcgggccctggagctggacaagaacagagccatagaaactgctcctctcagcttccgaaccctggtaggactgcttggaatcgaagctgctctggaaagcctgataaaatcgctttgtgcagaggagaacaactagttccaaaacagtgaacgtggaggatgaagatgctgcgtggaggaacatgcaattttattcaatataaacatttgctattttctgcttagaaaccacaccctgaagacgtgctgtctatgcagttatggcacattatatggaagctctcatgacatgaaaaataaatacaactagttaagtataaaatgccaaataaaagtgacacgtacaatgtggtttataaaaataagcttaacatctgagaaaatgtaccaagtggttgtgtgtcctcagatgtgtggggaggatccatcccccacccactgcagcctcacaccgagtccaccttggacatggtggccacattactcagctgggagaagccacccttatcctggttcctgcctcctgggggctctggagacggatgcctatggcgcctcatctttaaactgtccttagtagcccaggggagccacaccctcactccctgcctccccccggtccgcatggtggcaccgtgaggcagtctcagcaagtcctcatgctgttcttggtcttccacaagaaagtgaagctgtcagcttaataacaagaatggcctaagacagcaaagacagcactgttcctgggctgggacgcaaggaatgaggtcctttatgaaagaaagacccccctgcatagcctaagtgctatatcgatcgtcccggatgtgccttaagaaccgtgacctcatcagtcgcccatttagcattgttaagatctgtgaacgcgtgttgtctcaaaccagtcagggccgtcatgactacgcagcagcagcagtttccaagacgggccagaaacgcatccacagcagtggcacccgcggctcaggggctcctcacagcccgggctggtgggagccaagaccagacagagtgggggtctccatctgttttctcttctccctcaaatacaggctgttttcatcgtgtctagtccagccctgtctgggccctgtgctaggcaataactcttgcagccctgaaggacctagggagcccagcccaccttcccacggactggggttccctcacatgtgcacttgaacccaggacccagcatcctccacacaccgtgacaatgggcaaaatcatcccaaaccaggctgccccagccccagcccagcaacagtgaactcccttgggtcaagacagtactcaacggccactacctccacgcttcccagagcctgcggcttgtccgtgagctccgtgcacttcaccaaagcccccatcccagcacacaggacccgtgtgtatgagacggtgtcattggaagtgagaagaaaacagtaaaagtgtccagttagataagtatctttttgcacctctgagagtagaattagaagtaaatatgacagaattgaacaataaattctagaagagttgccttgattcaaacaagtataattctcaagttatcacaaaatttcccacaaaaatttacaatcagcaaaatagtttccttatttctcatgtatcattttcatataattccatggtttcactaatattatatgttacaataagcctccattagtccctcaaaacgatgatataaataagtctgtacaacctagcatagaataaaaaactgaaacc

SEQ ID NO: 1151 - DNA, 2612 bp, Homo sapiens
agcgctggaagcaagatggcggccgccgagagggttcacaaagggttaggaattttagacccagttctgctactgactttctctgtggacacaaactcactgagccttcagttcttcaaatcatttttttttcttttttttttttttttgagatggagtctcactctgtcacccaggctggagtgcagtggagcgatcttggctcactgcaacctctgccttctgggttcaagcgattctcctgcctcagcctcccaagtagctgggactacaggtgcctgccaccacccccaactaatttttttgtatttttagtagagacggggtttcactatgttggccaggctggtcttgaactcctgacctcgtgatccacctgccttggcctcccaaagtgctgggattacagatgtaagctgctgtgccagctttttttttttttttagagacggggtcttgctctgtcatccaggctggattgcagtgtcattgatcatagctcaagcggtcttcctgcctcagcctcccaaagtgctgtgattacaggtgtgagccactgcacctggcctcttcatatcttacaacgaagagcaccaaggattctcttttgttgaatttgagttggcagaggatgttgcagcagctgtcaacaacatgtttggtcagatgaagactgggtggagaagtttgctgggaagaggataaagaggaaggtggttgagacttcccaaagcagaaagccaggaggtaagaatgacagttcatgcttccataggagaggctgctgctttccacatagggaatttctgaggtgagtggtgttgggtgaatttaaaggagaagttttggctttcttatctaggtgagaaatatcttatgtgggctcaggtatttgtgattgctgctgagcaaggcggatatctgaggtgagaaaggatggtgagtactctgcatcaccagcatccgctatcctcctagtctttggcagcaggctcactgtcttcctgttcttgccctaattccaagggggcagaatcatgtagaggtcccttcccctcagtcagtacacaggcacaaggctctccctgccctctccacttgctcctgcttctccatcaggccatcctgactgttgcttcccaggataatttaagggctcctcctcctcagtccaccctttgagcagtgatatttccctgaattccttccttagccctcagcacctctctccacattatccttatgccatgtcagccccttctatctcctaaggttataacgatctttcattgtccgaatgatattctgatctctatccctagccctgacctttcacatatttctgtttgggtgtcttataggcaccataaataaagcatatcccaaatgggtttcatcacctttctggtctttttttatgcccaatcttagttcactttgccatcttcaacatagtcacacccaaaccagattccttggtgccagcttagatccctcactgtatttcatacctaatgcattaccataccctgctaattttatcttttaaatcttgcgtttctcctctccagttttcttctgccactgttgtcttggctgaggccttatcctctctcctgtgaataattggagtagcttcctaactggtctccctgccccaggcctgttttcctcctatccttagcagccagagggagctttctaaagggcagatctgactatctcactctccttaagcattctagggactcccttgatttataggattgagtccagcctccatcaaaagggacagaagacctctctatgttctgattcctgcttatgtctccatattttatctccattttatattctaggaaacaagagtttgtagatacctgtaaatctctgttttgatgtaagtcattcctctgcctgcagtgtccttttccaatttattttatgtggctaatgcctgctcatttctcatagcgcagcccatttactgccttctccaggaagcttttctgaatcctccagtgagtaagggagagcccactgctaaaaaaggcctagtcaaatcctcaggtgtacatggacatcaagattgggaacaagccggctggctgcatccaaaccctcctgcgttccgacgtcgtgcccatgaccacagagaattttctctacatgtgcacccatttaaaggactcggcttcaagggaagcagcttccaccgcattatcccccagttcatttgccagggcagtgatttcacaaaccacggtggcaccaggggtctgcgcaggcatggcactaagtgtcccatggcacatttggccctcatggaggcctcaaaagggcaggaccagcaccctcttctacggaggaaggaacgggtacagcagaaacaaggagagtcagcaattaccagccagccaaggtcctggaagctgacgtagagctcgtgccgacggcagacctgccggccgtgggagccgcggacgtcatctgcagggacagaaggggcaaggtcttttctggggttcctgctgtgtgcagctactatggggtaccagggtgggggatgccctgatgagcacatttgtcaaataaatgaatgacaggaaacc

SEQ ID NO: 1152 - DNA, 2371 bp, Homo sapiens
ctgccctgaggactatggcgaggagtagcatcagctccgggtgctgaaggaaccccctgggccttgtgcaggacactcttgacgggatggctgggcgacggagcagggtggcatcatccatcaaattcaacacaagccccacgtggaattctaaattttctagacaccatgttaaaagagtaaaaaaagcagatgaaattcctttttttttttttttttgcccaggctggcttcgaactcttgggctcggtgatccgcctgcctcggcctcccaaagtgctggggttgcaggcctgagccaccacgcccggctcgttcggctttattgtactcagtcttcagaacccagtgcaggttttattgttagaggcctctctgctaggactctctgctaggactccctgcctttccagtactccctgttcacatgtggctggcggctcccacagaggccagggcagggccaaaggggaaggagtacagtgacttggggcaggaggaatgggttggggcagaggacgtcgccagggtctgggcctgcgaggactggatggtgagaatcctggggagtagcaggtttggggaggacacacagcaccgctgggacaaggtgggtggagggtggtgagtgccatccaggggacgggcgggcactctgagtgggtggcgatgatgtaggccgccaagcctcagccccctctgtcctgctctggcccgcagggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatgctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtttctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgag

SEQ ID NO: 1153 - DNA, 2852 bp, Homo sapiens
ttagtagagacagggtttcaccatgttggttgctttttctttggggtttgaaaaacttccctgtgttagcaacttgaccaccatgttggtcaggctggtctcgatctcctgaccttgtgatccacctgcctcggcctcccaaagtgctgggattacaggtgtgaaacaccgtgcctggccttctgctaaattttttaataaaaatgtttaattgtggtaaaatatactgcttcagcgtcctgagtggctgggatacaggcgcccgccaccacacccagctaatttctgtatttttagtagagacagggtttcaccatgttggccaggctggtctcagactcctgaccttaagtgatccactacctcggcttcccacagtgctaggattacagtcatgagccactgtaccaggcctatagtttcctttttttgttgtgtctgggtaatactggcctcaaggaatgagtttggaagtattccctcctcttctttgtttgttttgttttgttttatgcatttgagtatgattcatatagaattcagtagtaaagtcattagatcctggacttttctttggaaaagaaatgggaaaagatgcaaggtttttgtttctttttttttttttttttttttggctctgtcacccaggctggtgtgcggtggctcagtcttggctcactgcagtcttcgcctctctggcccaagcaattctcctgcctcaacctccaagtagctgggactacaggcatgcacaaccatacattttgtatgttttgtagaggcagggtttcaccatgttggccaggctggtcttgaactcctgggctcaagtgatccaccttctttgtcctttcaaagtgttgggattacaggtttgagccaccatgcctggctgggagatttttaattaaggctttgattccattatttgttactggtttgttgaggttttcttttctttcctggttcaattttggtaggttgtgtgtccatgaatttatccatttttctgggtttttcaatttgttagcttgtatagttgttgatagtagtctctaatgagtctttgtatttctgaggtctcagctatatcttttttttccatttctaatttatttgggtcttctcctctttttcctcagtctagctaaatatttattgattttatctatcttttcaaaatccagcttttcatttttttaaaattttcttctgttttttgtttttttgtttttgtttttttttttttgtctcagtttatttccgttctcacttttattatgtccctcttactactaattttggatttagtttgttcttttgtagttccttggagtgcattgttgcgttgtatatttgaagtctactttttaaatatagatgtttattgctgtaaactttcctcttagtatcgcttttgccaaatcccgtagattttgtgtttggttttcatttttttcaagaaattaaaaaaaatttaattaagtttctttattgacctattcgttgttcaggagcatgttgtttaatttccatgtatttgtgtgttttcagaggtttcccttgctactgatttctaggtttattctgttgtggtcagaaaagacagtttgccgtatgattttcgcttttttgaatttgttgaggcttgtttcgtggcattgtattgtctgtgtatttgattttaccagtagcttttatatttttaaatattttcttttttgtacattatttgtttttctttctgattgaagaacttatatcttacattcctgtaagatgagtctggtggtgataaattctctcaggttttgtttcttaggaaaaaaaaattctctctccattttatttgaagtatagctttgctagagacagtattcttgcatgtcagtgtttttgttttgttttgttttttatttttattttcatcactttgaaaatgttgtcgccctcccttcttacctgtatgatttccattgagaagtctgttgggagccaaattgaatctctatgtttttacttttctcatgcttcttttaggatcctctcttcgtttttgaccttttgagagtctgattattatatatgccttggggtagtcttatttgggtcacatctgtttggtatgtctgaccttcctttacctggattttatctccttctcaagttttgaaaagttttctgttattattgctttccactttctgctgtttctccacttcctcttaaataccaataattcttagatttggtctttttaggtaattttgtatatgtcttttaggttatcttcatttcttttcattgttgtttttttcttctctgacaggattcttaaatagcctatctttgagctcactgattctttcctctcttcattctgttgttgaaagtctctgatatgtttgcatgtgtccccacccaaatctcatcttgaattgtaactcccacagttcccacatgtcctgggagggtcccagtgggaggtgattgaatcactggagtgtgtctgttcttgtgatagtgaataagtctcacgagatctgatggctttaaagagaggagttcccggccgggctggtggctcacgcctgtaatcccagcactttgggaggccaaggcaggaggatcacctgaggtcaagagttcgagaccagcctggccaacatggtgaaacctcctctctactaaaaatacaaaaattagccaggcatggtggcaggtgcctgtaatcccagctacttgggaggctgaggcaggagaattgcttgaacctgggaggcagagattgcagtgagctgagatcccgccactgcagtccagcctgggggacaagagcaagacttcatctc

SEQ ID NO: 1154 - DNA, 3115 bp, Homo sapiens
ggtaaaaattgacctagcttggatagggcatggtggcttatgcctgtaatcccagcactttgggaggctgaggcgggcagatcacttgaggtcaggagtttgagaccagcctggccaacatggtgagaccccatctgtactaagaatacagaaattagttgggtgtggtggtgcacacctgtagtcccagctgcttgggaggctgaggcacaagaatcgcttgaacgcaggaagtggaggttgcagtgagctgagatcaggccactgcactccagcctgggtgacagagtgagaatccatctcaaaaaaaaaaaaaaaaattgacctagctcttgatgaactttaaaattccttcaattagaataagatttcaaagttccaaaaagaatccagctagatttttattaattgcatgaagtatattgattagtttagaaataattgacacctttacaacatatggtcatcccaccctacagtgtggagtggagattatttattcaaataactttataagccctttgtagagatgtttttttcctgcttttgttacctctttatataattttaaatactttttcacacaaacaaatgaacacttttgtttttgagatggagttgctctgcctcccaaaccgagtgcggtggagtgatctcggctcactgcaacctctgcctctcaggttcgagggattctcctgcctcagcctcctgagtggctgggactacaggtgcccaccaccatgcgtggctaatttttgtgtttttggtggagatgggatttcaccatgttggtcaggctggtgtggaactcctgacctcaagtgatcctcctgcctcaggcttccaaagtgctgggattacaggagtgagccactgcaccccgccggaatgaacacttttaagagacaccctctgaatattgttttgctcagaaatacctctaaaaacaccaggtcaacttttcttctagtagttttgtgactttggttttctaatgcttacatctttgttgcttctggaattaattttgttataggactgagggtcagagggaggtggtgagagggtctccaggggcagcaggagggccgtgtatgctccctggataattgttgggtgtttccttagggacgacctggcccagttgcccttcctgaccatgtgcctgaaggagagcctgcggttgcatcccccaatccctacattcgcccgcggctgcacccaggacgtggtgctcccagacagccgagtcatccccaaaggtgccctccatggcaggggaggagggtcctgggcagggcggtggtcccagcaggcagctcggaccttgtccttactgtcctctcctgcacgacagggaatgtctgtaacatcaacatcttcgcaatccatcacaacccctcagtctggccagaccctgaggtgctgcccctccctgtttctccatcccccgggcctggtcgggggaggggtcttgtcccggaaaaccagatactccctctctactccacccacatctgttttatgtgggggtggctgggtgtcctgagaggccccatcagcagccttaacttgcctccaccccaggtctatgaccccttccgcttcgaccccgaaaacgcccagaagaggtcacctatggcttttattcctttctcggcggggcccaggaactgcatcgggcagaagttcgcgatggcagagatgaaggtggtcctggcgctcacgctgctgcgcttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaattaccttttcagatttccggtaataaatctgtgttggcccctgtgcctgagtcccacggatggccagtagggggcgctggaggactgcggggatctagggcctggctgggaagaggcggggagatgtctctgtgcccaagatactcactgcctctctgggtgagcacaggagccccgtgctgagggtgggatctcccagagtctaagtaaagactttttccccccaaaaataattgtgtattctgatataaatttttgccaatttagaatccctgttttttagctaggtgcatagcagcctgaaatacagatcacatttgaaagcctttcttgaagctcaattggttaagtgactgtggctgtcccatgtgtagaagccaaagattatgtggtaattctggtaacctttcttaagagaaagctgctacagtctgtctgctcagtcctcccctcttccttcctgctgcttggaagatttttttttttttgagacagggtgtctctcgtcacccaggccggagtgcagtggctcactgcaacctccacctcctgggttcaagtgattctcctgactcagtcgcctgagtagataggataacaggcgcctaccaccacccggctaattgtatttttagtacagatggggttttgctatgttggccaggctggtctcaaactcctggcctcaagtgatcagcccacctcagcctcccaaagtgccagaattgcaggtgtgagaacaaaaattcttgagtttcaatgtttattttagaatcaggtgctaacatgcaaatttattacaaaggtatattgcatcatgctgaggtttggagtatgaatgactccatcacccatgtagtgagcatagtatctaataggcagtttttcagcttttccccctccctgcttcccctgtctagtagtccccaggatctgttgttcccatctttattaccatgtgtatccaatgcatacctcccacttataagtgagaacatgcaatattttgttttgtgttcctgcattagtttgcttaggataatggtccccagctgcatctatgttgctgcaaacgacatgattttgtactttttaatgactgcatagtatttcatggtgtatttctacacattttctttatccactccaccattgatgggcgcctgtgtagattcagcatcttcgctattgtgattagagctgcgataaacatgtggatgcttgt

SEQ ID NO: 1155 - DNA, 1879 bp, Homo sapiens
cctttgcaatctccacgttgcgatggatccttggacccacttttgttaactcttaaactttgtgtctttgtctttatttcttttctcattccctcgtctccaccgggaaggggagagcctgcgggtggtgtatcaggcaggttcccctacatctttggcacccaacacggtctcctcgaacccaggtgaagttacacctgagcgtggtcgttgtgaagaacggtctgtccaggaactcccgagaacgtgtggtcggccttgcggtaagcttgtgcactcggagcattccagggacaccatgggacaatccaaaagtaaacattctgcatatttacattttattaagctcctcttaaagagggcaggaattaaggctagcacagaaaatttgattactctgtttccaacagtagagcaatattgtccttggtttcctgaacatggtaccatggacttcaaagattgggaacaggtgggaattgccttaaaacaagtttgtaaggaaggaaaatttatccccctaacagcctggtcaaactgggctatagttaaagcagcctcggaaccgtttcaatcggaaaatgaggcttatcctccagcagaaagaatttctgcagaggaaggtggtgatgctgctgaaggaggagaggatagtgaagaagattttgaggaaaatacagacaaacctggagatgagttaatttcttttgaggagcacgtgggaccttcagctgctcctaaaatagagaagccatatatgccaagatgtttaaaacaaagaagggccttgaggagcagtcggctcctcattgggatcatccggagtggccgcctccaataaagcaatgtagcttggagccttggaggtctgaatctcaaatttgccctgtttcacgaatgaatgaattgtggcctcaggaaccacaagcgcatggtgtagcaccagtacaatataaggctgcactgccatctaatgttaatgaatcgccattacagtttattattcggcaggctagattagccggagatcttgatgcctggcagtttgcagtagttttgcaacccccacgacagcaaggtggagcccatcaagcggtatgggaaccattttcttttaagctgctcaaagatcttaaagcagctgttggtcagtatggtcccaattcgcctttcatccgatcgctattgcaatctgtggctcagaataagctattgactccgtgtgattgggagattttaacgaaagttacactttcgccctcccaatttcttcagtttaagacttggtggaccgacgaggctcaaaatcaagatcgaaaaaaccgtgctgctaatcctgctattgccattacatttgaacaacttctaggaatagggggtcaatggggaactgtaaacaaccatcaggacttcgagatgatgccattgaacaaattcgcaattgctgtttgagggcatgggagaaaattcaggatctgggaactacttatcagtcttttaattctattagacaaggctcaaaggaaccatatcctgatttcattgctcgccttcaagacgcagcacagaaggctctcactgatgaaagtgccaggaaggccgggtgcggtggctcatgcctgtaatcccagcactttgggaggccgaggtgggcggatcacctgaggtcgggagttggagaccagcctgaccaacatggagaaaccccgtctctactaaaaatataaaaattagccgggcgtgatggcacatgtctgtaatcccagctactcaggaggctgaggcaggagaattgctgaacccaggaggcggaggttgcggtgagccgagatcacgccactgcactccagcctgggtaacaagagcgaaactccgcctc

SEQ ID NO: 1156 - DNA, 2365 bp, Homo sapiens
ttcccttcccagcgattccctctccttggtgcaagccctgctcttcccacggatgcttccctagacccatgtggcatttcagatgtcttgcttatggtttaattaatagtcctttgatttcattctcagagaatgaaattggcagtgcctgggaggccacccacatctgccaactgctctgatttccgttctaagagctttgcgtcagaaagagaggtccggggaccagcaaggaaaggtgggggtaatcccagggcagccccagggcctcaggacaaaccttttccacccttagaagatgtttacacagagtagcacaaagcatagagtaccaaacaaaaccctcaccccttcctccggccctggaaactcaatgggatctgtctcccaacccccttccctccctgacctgcctctgtcccatgccctggctgttccctgtgcctggaatatgcctcgtgagcttcacagctcagcttaaatgtcacctccttggaagaggcaccctgaccactatctgaggatttcacccaccaattctgagccccctcccttggtctagtgatctgcatggagcactgtcactctcatcctgttttgcgtatgtgtttgtttgcttatgaactctcacccctactgaagtgggagctccatgtcagcaggcactgggtcttgttcaccaccatatcctcagctctgctccaaatggctggctccataattactgttgagtgagtgagtgagtgaatgaatgaatctgggggaaagagtgctggcgagaaggtcaggaaacatggttaactggctctgtgagtgaccttggataagcctctacattatccgtggagctctgtttgtcagctgaaatgaagggaacagacccaatgatcccgagtggctcctccatccctgatattctcaggtgtcgttcagaggatagccatgcctttgggcatcttggctttcaagctcagagatacaaagggactgaataagaggtgatacaagaaagtgaggaagagaggcagggaggctgtgcacaaggaaggaggtggtctttcttcccacaccatgtccacccctacccagaggttctagaaaaatcccactggcttgtacttgtctgttgtttgtctttcttccccactgatgtgtgaaccccccaagagcaggaatcatgtcctatatacacccttgactccccaggtcctagagagcatctgattcattgcatgggcttagggaatatgtctgaatgaatgcagctgtgaatgagtgaatgaatgaatgagcacactgagcttctcacagaagcagctgatcccaaggatgttgattgctagactagaactttctcttccatgtaccctgtccctcctttccttactctctctgacctggcctttctctccctacagttgcccccaaaggacccaaaattgtgatgacgcccagcagagcccgggtaggggacacagtgaggattctggtccatgggtttcaggtcagcctctctctgagcatctgggagggtggtgggaggtggtagaggcaccgacccagcaccagcattcctggcagtcctctctaacactcttccttcgatccccagccacatccagtgggtttcagtttcccaatgtgtaattgggagaatcagctcccatgaggaatggcaaagaggtgcatgcatgtttcacaccttctagaactcagagtaaacctagctcttcaacgagacattctcttaagtcccagactcctcctcctcctggagttcagggcagccactcctaacccgtcggatgagaatgctgtgccacccctggccaggcagcccctgaccccttgctgatctggcagaatgggccctcctgtgacccacctctcccctgatctggccaacagaacgaagtcttcccggagcccatgttcacgtggacgcgggttgggagccgcctcctggacggcagcgctgagttcgacgggaaggagctggtgctggagcgggttcccgccgagctcaatggctccatgtatcgctgcaccgcccaacccactgggctccaccgacacgcacacccggctcatcgtgtttgaaaacccaaatatcccaagaggaacggaggactctaatggttccattggccccactggtgcccggctcaccttggtgctcgccctgacagtgattctggagctgacgtgaaggcacccgccccggccactccatcaggcactgacatctccacgaccggttttcatttcttttctaaactatttccagtcttgttcttagtctctttccatctgtgtcttggcttcttcagtcggtttaattaaaacaaacagaacaattttcccc

SEQ ID NO: 1157 - DNA, 2048 bp, Homo sapiens
ttctttgttgatgtgtcagctccgcaggggtttggggaaacggccgctgagtgaggcgtcggctgtgtttctcaccgcggtcttttcctcccactcttggctggttggaccccgctatggaaaagttggcccctgagccagagctccagcagccttgttagggcgtggcctgaggcttggataagtgggaggaaaaagtcctggatttcgagtcagaacatctggattagaatcctacttctttcacttgataatcttgttacctgtggaaatcagaagagagaatatagtaaaaatacgcagtacagtcccagatgtaaaacgaagatcaggagcagatttgaagaattacaaagtgaattggtgccagtcagcatgtcagagacagaccacatagcctctacttcctctgataaaaatgttgggaaaacacctgaattaaaggaagactcatgcaacttgttttctggcaatgaaagcagcaaattagaaaatgagtccaaactattgtcattaaacactgataaaactttatgtcaacctaatgagcataataatcgaattgaagcccaggaaaattatattccagatcatggtggaggtgaggattcttgtgccaaaacagacacaggctcagaaaattctgaacaaatagctaattttcctagtggaaattttgctaaacatatttcaaaaacaaatgaaacagaacagaaagtaacacaaatattggtggaattaaggtcatctacatttccagaatcagctaatgaaaagacttattcagaaagcccctatgatacagactgcaccaagaaatttatttcaaaaataaagagcgtttcagcatcagaggatttgttggaagaaatagaatctgagctcttatctacggagtttgcagaacatcgagtaccaaatggaatgaataagggagaacatgcattagttctgtttgaaaagtgtgtgcaagataaatatttgcagcaggaacatatcataaaaaagtaagttttttatacctttaggttattttttttccctcacaggcacagggattcgagataaaattctttaaaggaaaataccattttgttcatttttacttgcacattagaatcatgcacatagtagttgaacaataaatgtatagttgctgaatgtgtgagcaaatgtcgagtttttcagatatctgagttcaatatgttaaatagtgtaaatgtattaacgtgctagaaatttttatagacaactcaaaatttttcacttttgaaagaatgtagaagtatattgtcaaaactaagagaaactcaaaaggaaataacaagtcataaaattccacaactttttcttaaaatctgcattctgaattcattggtttaaaacattaaaatttagagaacagaataattgattatcgttcagtaaataataatacagttttggatatgtgaagttctgttttcatgatagtttaaaatttaccatcttaaccatttttatgtgtacgtttcagtagtgttattatatattcacactgttggacaaccaatctgcagaactttttcactttgcaaatctgaaacactgtattcgttaaacaacactatttccacttgccctcagtccctggcaaccaccattctactttctgttgctgagtttgactactcatgatacctcatgtaggtgaaatcatatacttttcatttcatgactggcttatttcatttagcctaatgtcctcatttatccatgttgtaacatgtcagaatttcatttctttttaaggctcaataatattgcattgtatgtatataccacattttgtttattcatccattaatggacatctgggttccttctgctttttggctgttgttaataatgctactgtgaacttgggtttgcaagtatctcttcaagactccaaggcccttcttgatattacccccaaacaaatgcctgctgttgctattcatatccttactgtaatactatattatgtgaataaactgtatgcttttgtacttgaaaaaaaaaaaaat

SEQ ID NO: 1158 - DNA, 2428 bp, Homo sapiens
atctcctgccccgccgaggcttgacccgtgagtggggacgcccaaaacgggccagaccgggagccccactcccggctgtgggagggaagggaaaccgagattgggcagaatcagcgccccaccacccgctgcggcgctcgggggtcgggggggcggggtgggtaggactgtgggccccgccctgccgcaggactctcaagctctgggactgggtggagggaggtaaggggcggggggggaaaatccgtgcagtcgcacatgcgcaaaggctcttcactgtcccaagaccctggcttcctggccaaagagcccgcgcagcgaggtggggttgggggctgggacccagctccgtgccccgccacctggctctctgggaagaatcggacctgtcaccctcgaaggactggccgctaaataacttcggtattgagagctgtgtgagcctcaaagggagggcccagaccagctggagtctctacccccagacaggataaagggcaggacttggggtcataggaggaggcggctaacatgaaaacaacttaggttggagagaaggaggggccaatccaatctgcaccctccctgtgtctgtcccgagtaggtgctgtccccctctcccttcctttgcccaccgattggagggacactctggaaaactcagttgaagaaagcggagagtctgcgtgtacacagtgcaatgatgtcagttaatgcactagtgagggcatgtgttgttcacggtacacagaagaaggaaccaccagcccttgggacacttaggcattggtgtagacaagggaacatttgagtcctggacgatggataggtccacggagcggagggaggagaaaaggattccagtcttagcgatcagcatcagcaaaggctccgaggtgccagaggcatagtgagttctccgatccctggctggtggagggaagctgggaagggcctggctgtccagggtggtgggaggaggctagagtagccagaccagatattttgggttgtctctgatgggcagtggggtgtgggggggaggtagataggtatttaggatggaattctgctagacaggaaaatatagttcagttcctcatagttcaggctggagcaagtaagattccagttttaccactgaatctctgagcctgtctcctcatctgtaaaatgggaacagcaatcctagcccagagggttgtcaaagtcactgtgctatcgggcctggcagaatgggagtgagaggggctcagagggactgttacaggacatgaggtgacgatggtggggtggcaaggcaggagctgatggagactcactgagaagtggagaagcaagattcatcacatacgggacataaagggagatggaggggcagggggtagtcctggtctcggcctggtggggaagggcttcaatgggaggaagccagggtgtgaagtgacgggggaggtatagtgtgacaccagagggtactgagaaagacctgggaggcaggatggcggctaggactaaatcctctctcccagagaaggccgagcctcctagagccagggaaggaggcagaggagggacagcaaagggaagaagagatgggaggatgccgtgtgaacaaagccaaggcggggaggagaagaagttattatcagggtgggggtgggctgagggcatggttcaaggcctgatgtctttgcctcctaatgccgggggtcttgctggctgggtcaggccactcacaggaatgggccataatccttggttgacgataaatggacaaagcagctgggtgcggtggctcatgcctgtaatcccaacactttgggaggccaaggtgggtggatcacgaggtcaggagttcgagaccagcctagccaacatagtgaaaccccgtctcaactaaaaacacaaaaaattagctgagcgtggtgcgggcacctgtaatctcagctactcgggaggctgaggcagaagaatcgcttgaactcaggaggcagaggttgcagtgatgagagaatgtgccactgcactccagcctgggcaacagagtgagactctgtcaaaaaaaaaaaaaaaaaaatggataaagcagattgactctccctaatagccgctgttggtagagatagtctctcaagagccaggcatggtggttcacatggtggttcacaaagtgctggtaatcccagcactttggaaggctgagatgggaggattgcttgaggccagcagttcgagaccagcctgatcaatatagcaagaccaggacaggcgcggtggctcacgcctgtaatcccagcactttgggaggccaaggcaggtggatcacgaggtcaggagttcaagaccagcctggccaacatagtgaaaccccgtctccactaaaataaataaatacaaaaaatatatatagcaagaccccacctct

SEQ ID NO: 1159 - DNA, 2437 bp, Homo sapiens
gcgccattggagccggcttggctggcgagcccggctgaggagcctcttgggtcgcacttaccgccgcgtccgctcccggtccctggcccctcagcggcatggcgtgcggggcgacgctgaagcggcccatggagttcgaggcggcgctgctgagccccggctccccgtttcagacgcagaccccaccgcagagtctgcagcagcccgccccgcccggcagcgagcggcgccttccaactccggagcaaatttttcagaacataaaacaagaatatagtcgttatcagaggtggagacatttagaagttgttcttaatcagagtgaagcttgtgcttcggaaagtcaacctcactcctcagcactcacagcacctagctctccaggttcctcatggatgaagaaggaccagcccacatttaccctccgacaagttggcataatatgtgagcgcctcttaaaagactatgaagataaaattcgggaggagtatgagcaaatcctcaataccaaactagcagaacaatatgaatcttttgtgaaattcacacatgatcagattatgcgacggtatgggacaaggccaacaagctatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgataattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctgtatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcacgcctgtaatcccagcactttgggagtccgaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgttttactttgaatatagaatagtttttttaattagggcttattttgaaaaattctgagtttaattcaaatgtatgccaataccttccaaagtaaggtaatattcagagacagttgttgtgatcagatggcttagagaaatttctggaatattcacattcgaagattccttattaatgaatgtctttgacttaaatctaaccaaaaactgcaacattattctttgtacattttcattatatagtgttaacaagcttagttgcaaacaaataaaatacttaagctatttgttt

SEQ ID NO: 1160 - DNA, 2185 bp, Homo sapiens
ctattttggctcggctcctgcccagcacctggcggcctttgtaggcctaaagcttcctcaagtcaagcgttccaggcccagatcatgctgcccaggggccttcacaggcccagctactgcctgacgatggcttccccaggcccaggtcttgccttcccccagcctcccgaggcccagcccttgcctcacagttgctttcccagtccacgttacagcctgttacccgacggccttgacagaccaaactcttccttcacactggacagtttaggacaagctcatacgtcttccagcctctccaggtcaagctcctgcctcacactggcctctataggcccaggtgctgaatcgcaatggtctgtttaggtccatctcatgcctttctcagactctccaagcgacgatctggcctgacacttgcttctgtgggccatgtgatcactcacactggcctctttaggatcaggggatgcctctccacaggccgagatcctgcctgttgtaggccccttcaggatgcgccgctgcctgacagtggaccctccaggcctagatgttacgtgatcatggcctctgcaggtcaagaatttaaattttcgcagcctctataggccaggctactgcctcctgataatggcttctgcaggcccaaatcgtcctgaaataagcctcgccaggaacagcgcatgtgtgttggatgcccgaacaaccatagcttctcccgcacagtggcccatgggggccgggctcttgcctcagcctggccacctcaggcccagttcttgcctgttggcggccgctccaggcccggctcctgcccctcggcctcctctccaggcccagaactggttcccgtcggcctctccaggcccagctctcccggccacctccacgggcccagctcctgcctcacgacaaccacgttcggcccagctcctgcccagctcctggcagccgttgtaggccccaggcttccctgcgttcaggcctcccggacccaccttcggcttcccggcggccctgagagacccggctcctgcctgccagcggcctctcccggcccagctgcggcctcacgtcggcctccccaggccacgtttccgtctgcctcacggcagccccggcaggcccggctcccgcctgccgggggcctcttgaggaggctcatctcgtgcccggccgcggcctccccaggccaggctcctgcctgccggcaggcgccacaagcccagctcctgcgtcccgaaggcctctctaggcccggctcgtgcctcgctgcggcctcttgaggcccagcttttcccttgtggtggcctctccaggcccagaacttcctcaagtcggcctcccccggtccagtggctgcctcccggcctcctctccgggcccagctctttgctcgcgtctgcgcccgtgggcccagctcccgtctccaaacagcctccttcgactcggctcctgcccagctcccggcggccttcgtaggcccgaagcctcctccagtccagctctccagggccgcgtcttgcctcgcctcgcctcccctcaccttgcctcacctcgcagcagcctttccaggcccagctcccgcctcccggcggccttcccctgccacgctcttgccggcctcccggcagcctccaccagcccggctcctgcctcacgctggcccctctgggcccagctcatgcctcgcggtggcctctccgggcccagctcccacccagcctgacggcgcctcccagccccaagctgccttcctcgatgtggcccaaagtggcccaaagcgtcccaaagtaggcctcgccaggcccacctcctgcccggcgtaggccctgaggggcgcggcccctgccccatactggcctcttttgggccctctcttacaccagcccctgtctcaggattgtctcttcacgcccatcttctgcctcatagtggtcactcaaggcctcgcttttgcctgatgattgcgttttctggttttgctcttgccttgtattcccttcttcgggatacagcttttacgtcttccatggtgaacctcatcaaggagactaaatcttccctggtctgtcatttttttcacttcacaccagagtgccttgggaaaaccccatctcttcttttaaccttgagagtggatttctgacgaattgataataaattttttctctgtggtttc

SEQ ID NO: 1161 - DNA, 2314 bp, Homo sapiens
agttaattggtgccctcaggttcccccgttgggtgctgggcttgggtaggcctggctcccccagctccgagccgcgctctcggcatggacctctcactgcacgtggcctctctctgccttccccaccacccgtcacctgcgcagctgaagccggctggagcgctgtgccgccaggccatgggtgactgtgacctccctgagttttgcacgggcacctcctcccactgtcccccagacgtttacctactggacggctcaccctgtgccaggggcagtggctactgctgggatggcgcatgtcccacgctggagcagcagtgccagcagctctgggggcctggtgagaggacacgagcacccttgcaccctgccccccatcctctggtggggccagttttctactgtggggaagatgggcaggggaaactgaggcccgctgagcgcagcccctctccgagctgcccccagcctggcccatgcttcctcaggctcccacccagctcccgaggcctgtttccaggtggtgaactctgcgggagatgctcatggaaactgcggccaggacagcgagggccacttcctgccctgtgcagggagggatgccctgtgtgggaagctgcagtgccagggtggaaagcccagcctgctcgcaccgcacatggtgccagtggactctaccgttcacctagatggccaggaagtgacttgtcggggagccttggcactccccagtgcccagctggacctgcttggcctgggcctggtagagccaggcacccagtgtggacctagaatggtgtgccagagcaggcgctgcaggaagaatgccttccaggagcttcagcgctgcctgactgcctgccacagccacggggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggcgccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagatcatgccaagatcctgcctctggtgagaggtagctcctaaaatgaacagatttaaagacaggtggccactgacagccactccaggaacttgagctgcaggggcagagccagtgaatcaccggacctccagcacctgcaggcagcttggaagtttcttccccgagtggagctttgacccacccactccaggaacccagagccacactagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacacccccctgcagcctggctggcctctgcaggcaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagctggggtaggaggatcaccagaggccaggaggtccacaccagcctgggcaacacagcaagacaccgcatctacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaagacatatt

SEQ ID NO: 1162 - DNA, 2364 bp, Homo sapiens
agactttagacttgaggctggaggaaagggaactgaacgcggttctgggagcagcaagcccacgggtagcagccgaggccccagaatggccaagtttctttcccaagaccaaattaatgacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgattttattaactaccgtgagtccggccctttcaagcatggaaggagcctgcggtttggagtctggcctgggttccagtcctggctctgctgcttcccactgtgactttgggcaaatcatttcactcctcaaagcccccccacacaagctggattcccacttcttacctcatggagcctgttgaggaaggattgagctgatgacttaagggcaatctaccaagagacttattctgtatttgggggctagaaccatcttccatatttccaagattttccaagatgaagccagtgctagctgagaagcagcaatgaacagaaagctgtaacacttatgacaacaattcttgcagtgccagaggcccatttacaaattctcatttccatctcaacagatatagtgacatagctcaggctattcattcataaacacagagtgtagagtgaaaacactagagtgaaaacacatgctacaatgaggcagcatcagctgagagcaggaagagcgatctactttacaccccacaccaaaggaaaccagatgtgagctgctaaattgactggccttgcagagctcaagaagggggcttccaatgctgtgagaattccgagctgttccctgggctctgttaacaggcagagaggttccgggatggtctgctcaagtggcccacactggtcattgccttaagccacctccccaggacttacggagagaaataaggggatgtaaccagcaatggccagggtacaacagccctggaaaacagtagtaggagcactaggctttctgggagtccatccagctggagtggctttgagtgagttacacagctagaaggtgccaggttggtgctgccagagattcagaggtgccatacacttgtcaaatctggatcattcgtagtgccagcacagtcctaaaagggctggagtaccacaccaacacaggtaggggtgcagggcttcaagtacaaagatttgcatccatgtatgtatcaaaagtgggttctctgggctgtggctttgtctagtagtaccacagtggctaaagtagaagaaaaccaaatcaaatgggatgtgtcttttgggaggatgtacaagacacaaatctttcactaggcaccgggcacagggaaaactgcagggaacaagagttgtagtgttagtgcaactgtctcaacgatgctgtgtggcttcagacccaaacaaggccctgaggagggagactctcatttccccaagcataactgcaaggagaggaggaattcctaggagccaaagagttttgtggggtgagggtaaataaatggcccaaatgccaactaggtgaagttgtgaccatctggctgggaagcccaggtccacacagtgtaggagcagatgttttgtggggtctgaggtttacgagatttggctgccttaagaatacaaaaacagaaatgcagaatttctggggctgctcctaggaccagaacaagtgaagggtcctggtgcttaaacttcattaccttcatggtaaatccaccagagggccggttagatgctggccccgccgagagaactgctgtcactttcaggcaaagctcaaaggtcctaggcccacagttcttttgagctccagtcatggacattaggaagtaaatcctgcacagccaacctggaataccaaagattagatgggagatagataccaatgatttagatggcacaggaagagcaagttctggatataataaatgagggtactttccgtc

SEQ ID NO: 1163 - DNA, 2130 bp, Homo sapiens
gctttttcagccgtgcaatattccaaattataggactctcagtcaatttagatggccacccacaggcaaaggagacagaacttctgttaacaaacctttattttcttttttctatttatgtttgcattccaaccagttctgaataaatctcttgcttgtaggacttggttgagtgcagcaagaaggcatctacacatgcagtttcttactgggttgattcatttgttccacaggtatttattaagcacattctatgaatcaggccctgtgctaggggtactagaaatagagtgtaaataaaaaaccatagagttcttgcccttacaatttataatctcacgagttcacctgttgcccattctttatcttctctcttttttcctctacgatgtcccccttggtgatggcacctgttcccatggcctcaactcctacctcaatgatgacgacttaggaatttctaactcttaactccctacctctctcctgacctgcaggttcatatgtctcactctctttttgacatctttacccagatgtcccataggtaactcaaattgatcccttttcttggtcatgattttccctaagaaatatgccctttgtttgctgattctccctaacctggttagtatcatcaccatctacctaccaggtttcctaaggctgaaacattatcatcctccattcctccttttccctcacccttatacccaggcattcacccagtcctagtgattcactctcatgaagatctcagcccagtttcacctctctattcctactgccatagttaatcttccttcagacctagactattactaggtcctctccttgccacaaaacacacccctacctaatctatcctttaccaccagaattatcacgctaaaaattacattcttgcttaatatctgtattcccagttgcctacgggataaaagcccaaactccttagcagagaatataaggccctagctcccacattatttcagcagtcatcacccactatgttcctcaagactgcagccattaactttttagagttccctaaacatgctgtttactttcatgcctctatcccgttgtctgtggaatgacttccctccttgcccttttcagtgctacaaacccctattctttaagacatagtacaaatggcatctcctggttggcatctttcctgcaggcctacaggcctagtaagtatcttcctcctctgtgctcctgcatacctccattcctttgttatgacatctataactttaataagtactaaaatctgtagtcctacaaaactcaggcatagaactcatttcctttatggctctataatggaactttacccaactctcacgttccccatgaccacagatgtggaaaatttgaatcttgacagttcaaggtgaactcagtcattttcagagttttcatagtcccttcaagattgaaactcagttcctgcaatgtttgccccttttctcctcttttgtctatgctgggagaggcattgtggggagggttgtctggcttatggctcccattgtcctctgcttgataaaccacctgagctttggtcattagcagtctcctgtgcctttcacactcaggtagtgtctgcacaggccactctatgtcttttccatgctgaagaaattcctttccaggccatgtctgtgttcctcctgccacacaggaaatttttgagcatgttcatcctccaagctgaatgcagggtcttgggtagtggtcctcacctgctccagagacttctccagccattgccactctccactcaggtgatgaagctggatgagggactgcacccaccagagtcaggccagggtcctgtctgctctgtgagtccctccaattgttcttattccgagatttccattgttctgccccctcttgactcccagggctctcaagggagtgggggtagtgaagggagccctttcccaagctcccccaagagctctagtcacatcacttctgatacttcttttcccaccagctggaagaaagaactttcatttgtcttgaaatgagaaaaatgttcttagaatattttgtattactctctgctctgtcatttatggtaaacaaaataaaataataaaaaaaaac

SEQ ID NO: 1164 - DNA, 2485 bp, Homo sapiens
ttatgtttaaaggatgggcaggggtgctcgagaggtccccaggagtttccctctggggagagaggggcccaccccttcccagcagccctctgagccccccgatcgcttggccacagcctctgcctggagaaagcatccccctcggagatatatggacatcagaagaaacctttctctgtcaccaggacaaatcctgttcttatttgaaccaaggccagttttcctaatgaatgcagggaggacagcacagatcaatgaaaccagcagataatccacaagactgtttcccagagctgggagatttccttccctgccaacacttttcctgaaaggtcttaagaatgaggcaaacagtttaagtctctcttgcactgttcttttagtgaaagagttcaatgaggaaggagaggaagtggagcatatgcttagtttccaagctggaaaagtggcccatggttaaccaagactagatgtaaaagcacaggtggccgcgggtccaggtgagtcggtcctacgatggcacggctgctaatgccagcagatgctcctgtcctctcctttcaagactgacttcttctggtctttcattcgttaaaataaaattgacagggcatcatccaagaagctctacactttcccttacttggatttcagactctagattctgctgagatttgagcttcatggtgaacacattcttgttgtgcttgctgctgaggggtgtggaggacagagagatggtgaaatggcaaagtggctcttgagcatgggtgggggaagcccccacatatctgagtcagtgccacctggacactacccttggagcatcctgctgaggtggccattcaggttttctttcctttccttttattccactgtttctgaatgtgctgtttgcctcggacatgaaacatctcacagactgcctggaagaaggtggagcagactggggttaatggtcagcagcagcagcatccccaccactggggctatccctttttaggcccttaccatgggccaaacactgagccgtgtgcttcgtgtaacttctaagcacgcttacctgatagagtgccagcaaagactcaaagaggtgcctgggcttggcacatagtagctattgctactattatgaatgttgttttgtctttgtttttgttttgagacggggcctcactctgttgcccaggttggagtgcagcggtgccatcatggctcactgaagcctcaacctccctgggtttgagcaatcctcccacctcagcctcccaagtagctgagactacaggtgtgcgccaccaagcccagccaattttttgtattttcagtagagactggttttgccaagtcgcccaggctggtttcgaactctggggttcaagcaatctgcccacctcagcctcccaaagtgctggcattacaggcgtgtgccactgcgcccagccattatgaatgtcaatattgacatgatcttgtatccttatgcccacactgggagaggtctgattgtccccatgttcctggtgtggaaccacatggaagaggcctatgttatcccaacagtgcagaagcacagcctgagtctcttctttggctgagccaagggcgtgctggagaggcctgacagaagaaggagcggcccttgtgaccagtgcccttttggttcacaaggaacttctcctcttgttgaagtgacttggctgagcttgctccttctgctttgagagtcaaatatcaggatcaagactttaattatccccaatttacagatgatgaaaccatattgggcaggaaagaaagtcaccccaggagagcaagttggacctgagcactggctgaggacaaaggggaatgataatttgggatgtaacttgttaaggggtctcacaagtgttcttgtgatccaggtgtcgagaggatacagcagaaaggttgccagggagatgagggtagggtacaccacaagagtgggagaaattaaagagaacacgcaacaaagccttgggacactgggagggggatggaccacccagttttgtgctatgggagaagagagcaagaaaaggaatctgtgttaaatcccgacagcctgcatgagaagcaaatgcccttcattttcttcatcagcggcgagactggcatccctgcagctttgggaaaccatgctagtgtagatgccagctcacgccagcgggcctgactgggagaccttgggctggggttctggtctggggctcctaggcctgatgggaggagagttcagccccaggtttcctgtacttcagctcgtatccacacaatggtaattattgaaatgagagactcaaaagaagatggaacgtgaacttttttgttgtcccatgtggacacctgtgttcggtttccagttctacctttgctgtctgtgtgttcttaagtaactcacttaaacctttctgagtctcattttcttcatttataaaataaaagacgtaacatttatgtc

SEQ ID NO: 1165 - DNA, 2542 bp, Homo sapiens
agaggaggcgtgggcggctccgggaccacggagcctggtgacgcggcgctcccctgcccgggtcgggttgcccaggcgccgccgcggcggctgctgctgctgctgccgctgctgctgggtaggggacttcgagtaacggccgaggcctcggcctcctcctctggggcggcggtcgagaacagcagcgccatggaggagctcgtcactgagaaggaggcggaagagagccaccggccagacagtgtgagcctgctcaccttcatcctgctgctcacgctggccatcctcaccatatggctcttcaagtactgccgggtgcactttctgcatgagaccgggctggccatgatctgtgggctcatcgttggggtgatcctgaggtatggtacccctggcaccaggggccgtgacaaattactcaattgcactcaagaagatcaggccttcagcactttagtagtggatgtcagcggtaaattcttcgaatacaccctgaaaagagaaatcagccctggcaagatcaacagcgtaaagcagaatgacatgctagggaaggtgacattcgacccataggtatttttcaacattcttctgcctccagttattttccatgctggatacagcttaaagagacacttttttagaaatcttgggtcactccttcttggggactgctgtttcgtgcttccgtattggaaatctcaggtatggtatggtgaagctcatgaagattatgagacagctctcagataaattttactacacacattgtctcttttttagagcaatcatctctgccactgacccagtgactgtgctggtgatatcaatgaattgcatgcagacatggatctttatgtacttctgtttggagagagcatcctaaatgacgttgttatgttgtactttcctcatctattgttggctaccagccagcaggactgaacttcaactcacgcctttgatgctgctgcctttttaaagtcagttggcatttttctaggtatatttagtggctgttttaccatgggagctgtgactggtgttgtgactgctttagtgaccaagtttaccaaactggactgctttcccctgctggagacggcgctcttcttcctcatgtcctggagcacgtttctcttggcagaagcttgcggatttacaggcgttgtagctgtccttttctgtggaatcacacaagctcattacaccttcaacaatctgtcggtggaatcaagaagtcgaagcaagcagctctttgaggcagagaacttcatcttctcctgcatgatcctggcgctatttaccttccagaagcacgttttcagccctgttttcatcattggagcttttgttgctgtcttcctgggcagagccgcccatatctacccgctctctttcttcctcagcttgggcagaaggcataagattggctggaattttcaacacacgatgatgttttcaggcctcaggggagcaatggcatttgcgttggccatctgtgacacggcatcctatgctcgccagatgacgttccccaccacgcctttcatcgtgttcttcaccatctggatcattggaggaggcacgacacccatgttgtcatggcttaatatcagagttagcatcaaggagccctccaaagaggaccacaacgaacaccaccgacagtacttcagagttggtgttgaccctgatcaagatccaccacccaacaatgacagctttcaagtcttacaaggggacagcccagattctgccagaggaaactggacaaaacaggagagcacatggatattcaggcggtggtacagctttgatcacaattacctgaagcccatcctcacacacagcggctccccgctaaccaccactctcccgcctggtggagacacagcggctccccgctaaccaccactctcctgcctggtgtagacaaagcggctccccgccaaccaccactctcccgcctggtatagcttgctagcttgatgtctgaccagtccccaggtgtacgataaccaagagccactgagagagggaaactctgattttattctgactgaaggcgacctcacattgacctatggggacagcacagtgactgcaaatggctttcaggttcccacactgcctccacgagtctggagggcagctggagaatgaagagcagctcagaggaagtgctggagcaggacgtgggaatgggaaaccagaaggtttcgaaccagggtacccgcctagtgtttcctctggaagataatgtttgacttcccctgcaaaccctggcacgatggggtaggctcccaatggggtgaggatggcttcaagccctaatgttgcttgaggtggggcagtgactagattgaattaactcttctattttattggggtctgaagttattgtaacacttaaaatttaactcatgatgcagatggtgaggcaaaagtgtctctaaattcagacaaatgtagacctatttctactttttttcacacagtagtgcgctgtttcagagttaaacaaacaaaaaaatagcat

SEQ ID NO: 1166 - DNA, 2332 bp, Homo sapiens
agtgtggtctctgttttgcaactggtcgtccgcgtcaggagacttaggtccaggcgactgcccagacaatgactggtcccgcataccgagcagagcatgatcagcagcagtctgagtggaagagtgcctgtgatcttagggaacctgatgggcgttggagcagcggttcgacgcatgggtttctctttaatccttccgacttccccaagcccagcgcactcaggttccgctccaagtgcgggacccgcccggggtgtgtcgggggtactcggccggaggcggccggtgagtgaggcttacagggccccgggaccaaggtgggtgctcttggaggttctggaaagcggaaacacgggttcttcgagggaaacgggcgaaagggtcgcgggtggtttggctgcaggtcgggtcaggaggcacctccacggttgggacgccgcgtggcgtggggtcatgaagcccccagcgctcgtctcactggcgggccagcctagtccctctgcggcagtgacagccagtggttttccccgggtgtatccctgggagatgaaaaagagcagggttgctccctgcttcccctctagcttggcgagggaggtcttcggtactggggtgtttcccaggtgcttactgagtgcaggcactgctccaagagtttttacctgcattaactcatttaatccttgcatcaaccctatgaagtaatgtactattattatgcccatgttacagataaggaaattgaggcacacagagatgaagtacttgctcggccgggcgcagtggctcacgcctgtagtcccagcactttgggaggccgaggcgggcggatcacctgaggtcgagaccagcctggccaatacggtgaaacccgttctctactaaaaatacaaagattgggtgggagtggtggcgcgcccctgtagtccctgctactcgggaggctgaggcaggagaatcgcttgtgcccgggaggcagaggttggagcgagcagagaccacgccactgcactccagcgtaggcaacaagagtgaaactccgcgcccctcccccccaaaaaagagaagtacttgcttaagttacagaggctagtgagtgccagtccttagtttatgtttctgatgatgaaggttggtacttgaataaagtggttgttaattatttgttgtaggtgtattgacagttactgtggatcattgtgtttgagtttgtgctttatgtgtgagtttgtgctttgagccaatatctgggaacattgttacctgaagatcacctttggtaggacaagattttctctattctgtgattaaactgaggctgcccaggcagttctgctgattgctttgtggattggcaaaggctccaggaagcaatcaacctagtgccacaaaacaaagcacccagagaagccctattcctgacccttcaaaaccttcttccttctgaagggggtagaaaataaaggagaattatccctggatcaggaattgattataggagagacaagcaatgtcaaaagaattttagataattagggtaactgtggtggccagcgctgttagtgctaaaaagtttgagtcacataaaggaatagcaaaccaccaggttggctagggctgcagcatgttgtgaccacttaagagaataatgattttgtagggatacagtatccagagagcagtaaggtgactcaaataatgaaagtatgaggaagaaaggagaaaaggagaggcaactttccacattatggtggaggaatcccttggatggactctggataaaggtatagccctaacctcctagcatctctgaaatatgttttgggggctatccctgaaacttttgtcacatccgctagactttcttttcccatcttatatacatcctccaaagccaggaaaaagaatgcatctctccatgctctagagcagcagctgctgaagggagcctcataaatcctctgacagcatctttccttaaacatacaccatcacagttttcaaattcattgatgtgagatgagcacagcaatagcatcatctcccttatactatatatgatattctttattgtaaatgttttgccatagtttaacttgcagtattgatgaaagttttgtaagaaaagacaagcacatgctagtaatggtgttttataatgtgggacgagatttttcagaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgt

SEQ ID NO: 1167 - DNA, 2482 bp, Homo sapiens
tcttttgccaaccacttgaagaagtctgcgaaaacgccaaaaaatgcagttcgaaatgacagtgccatttcgctattgcctattttgtccttgattttattctctggcacttttgtctttaatcgtcgtatttttccatctcttgttctcatacccttctactctatttccgtcttacacaagttctttaaccttagtttatttctttgtcagaatcgccaagaagccagttatcaaatagcgagccttctccccccaccttttttttttttttaaattactgtactgatgtttgttagatattgttcgaatagacctggggtggacatcagcactgccattgtcagccctgtgagggttagaagagcttggtgcatattaaacactgaacagatgttagctgttgttgtcttgagcaagttttcttaccattctgggccttaatttctttttgtttaagatggaagtaatacctaatttttaggttgtgagaattatttgaaatgtgaaaaatattgtcagtgggtctgagccgtagtaaacagtaaatagcagctggttacagtagtatccccttaatggggtaggtatacgttccaagacccccagtggatggctgaaaccacggatagcaccaaaccctatatatacttggttttttcctataccgtacatacatacctacctatgataaaacttacaagttaagcacaataagagattaacaataacataatagaactgtaacaatatactataataaaagttatgtgaatatgatctctttccccttctctcaaaataacttattttactggactcacctattttcacaccagattgaccgcggataattgaaaccggaaagtggaacctcggataagggggtgattactgtatcaccctttaatatgccatctgttagtattcgtatcaccttgtagtcatgtgtagctttcttctacccattctgcaaaattgctttacatcaagtatttactattctttttagcagtttttatccccttctgagttttgttagggattctcttgaggtatatgcaattagctgaagacctactttaatattggattagaatgtttctcctgttttcacacttacaggtttctctggtgtttactcgtttctttgtggaattgcagtttcacctatgcacacacctgtattctttctctttaagaagttacgtgaattgtgtatgttctgttggaaggatggtaaaacttttatctttattcctagaaaaaatgtagaagatttcactggacctagagaaagaagtgatctgggatttatcacatttgatataactgctgatctagagaatatatttgattggaatgttaagcagttgtttctttatttatcagcagaatattcaacaaaaaataatgctctgaaccaagttgtcctatgggacaagattgttttgagaggtgataatccgaagctgctgctgaaagatatgaaaacaaaatattttttctttgacgatggaaatggtctcaagggaaacaggaatgtcactttgaccctgtcttggaacgtcgtaccaaatgctggaattctacctcttgtgacaggatcaggacacgtatctgtcccatttccagatacatatgaaataacgaagagttattaaattattctgaatttgaaacaacatatttttatacttaatgaattgtatctcattaatctcttcccttacatcttcatgtattgttggtttgttttttggttttgggttttttttttttttttttggtataagaactaacatcaaaaggcctgtttaaagggaaaggttaatgggctacttaatattatgaacaaaacaaaaaaacaaggctgccacagtggaatattatcttacaagaataagaactacataaaacagatttgtaaaaaatacatatttgaagtattccctgtatttccattattctttatggaatataaagtaagcatgaaaggtagttaaaactttcaggtgcctgtagagttataataactgtattttatgccttgcattcacgcaaattcacattggatgtgatttaaaagtagacattctctttttcctcttttaggatatgtttgattattggaaaattaatatggttatttgttagaagtctggtttataaaaaagccaaaagtgatggaatttattccatttgtcttaggaaggcccataatacttgtttttcttacatgtgactagcaactttctccacttaaagactaaatacctctttatatgatgtaaattattctaattcattttaaaatcttttaggtcagcaaaatgtgtgtcttcagtgctttctctaaaaacgttcctttatagctttgtacttttttttttagcgttgccattgaaagttaaaatgtttgcatggtttaccctctgagttatgtttcttctagtaagcctctacctgcacgacaacacat

SEQ ID NO: 1168 - DNA, 2679 bp, Homo sapiens
ctactaattctgtccctctagagaaccctaactaatacatctatcttgatttgatttttgaataggatgaaagagaggggtctagtttcttcttctaaatatgaagatccagttttttcagcaccatttattgaagagactgtttttttctaactgaatggtctttgcacttttgtcaaaaattagttggctctaaattcatggatttatttctgggttctctgttctgttccattggtctatgcatctctttttataccagtactatatggttttggctatagcattgtagtataatttgaagttggcagtgtaatatctccatctaagttcttttttctcaggacagctttggctatttggggtcttctgtgataccacacgaattttagaatttttttgtatttttatgaagaatctcattggtattctcataggaattgcattctatctctatattgcttttagtagtagagtcatttttgcaatattatttcttccaatccatgaacatgggaagatgttccatttttgagggaccttttccatttctttcatcagtgttttatagcatttcttgcagagaactttcaactacttggttaaatttattcctaaatattatatatgcacctattgtaaatggcattgctttctttttctttttctgctagctcatcatttgtgtatgggaacactagtgatttttgtatgctgattttgaatcctgctgctttattgaatttgtttaccagttctaagacagttttggtggagcttttagggttttctatgcacatattatgtcatcttcaaacagggaaaatttgacatccttgccctttatttctttctcttgcctgatttctctggccaagacttccagcactatgctgaataaaagtggtgaaggtgggcatacttgttttgttccagttcttagaggaaaagctttcagtgtttccccattttgtatgatggtggctgtggatttttcatgcctatcctttattttgttaggtatacttgttctatatatttattttgttatgtatgcttgttctatacctactttgtttagtgttttttatcatgaagaaatgttgaattttatcaaatgcttttcctgcatttattgagatgattatatggtttttgctattcactctgttgctcttcaataaatatgatgtgatgtcattttttttatttgaatatgtcaaaacatccttgcatccctgggataaatctcaattgatcatagtaaattatctttgtagtgtgctggtggatttgatttcctagtatgtcattgagaattattgcacttctattcatcagcgatattggtctgctgttttcatttcttcttgtgtcccattctggttttggtataagggtaatgctgccttcatagaatgaattaagaagaactctcttttctttgattttttggaacagtttgaaaagaatgggtattaagtattttttttaatgtttggtagaattcagcattgaagccatcaggtcctgggcttttctttgatgagagagtttttattactggttatatttcattacttgtaattagtctgtttagactctctatttctttttggttcaatcttgataggttgtatgtgcctgagaaattatacatttttacttggctttccaatttgttgactcatggttgattgtaatagactccaatgattctttgtatttctgtggtatcaattgtcatgtctcctttttcatgtctgatttcatttatttgagtctttcttttttcttactttgtttagctaaacatttgttaattttgtttatttttttacaaacaaaactctttgttttattgatcttttgtattttatttttactttcaatttcatttatttttgctctgatcttcattagttcatttttcctactaattttgagtttggtttgcttttgtttttcttgttccttgaggtgcatcattagattgtttatttgaaatatttctacttttttcgatgtaggtgtttattgctataaaattccttcttaatactgcttttgctgtatcccatagcttttgatacattgtgtttatactttcatgtgattcaagaaattttaaatgtacttcctaattttttattaatccattggttgttcaagagcatgttgttaattttgatgtatttgtacagttttgaaagttatttctgttattgatttctagctttatttccttgccgtcagaaagtatacttgatgtgatttcagtacttttaaacttgttgagacttgctttgtagcccaatgtgtggtctctccaggagatttttccatgtgctaatgaaaaaaaatgtgtattctgcagctgttgcgtgaactattctgtcaatgtctgttaagtctatttggtctaaagtgaaatttaaatacaatgtatctttgttgacttcctgtctagatgatctgtccagtattgagattgggttattgaagtctgcaactattattgtatgggagtctatctctccctttagatctaataataattgttttctgtagctaggtgctccagttttgggtgcatatatatttactattgttatatgctcttgctgaatttatcccttgtctgttttatttttatctgatataaacatagctactcct

SEQ ID NO: 1169 - DNA, 2102 bp, Homo sapiens
actttaacaatactcctaaacaactgctaggaccacggaactcagaaacacagcaagcgatcatattggaaatatggcccaaagtgacttcctttacccagagaacccaaaaaggcgggaagaagtaaatcgtcttcaccagcagcttcttgattgcttatctgacagcttcgatgtcaccaataagctgactgaggttctaaatatgcacttggggtgcaggctggcctccattgagatgaaaagagatgggaccatcaaagaaaactgtgacctcatcatccaagccattatgaaaatccaaaaggaattgcagaaggttgatgaagcactaaaagataagctagagccaaccctctatagaaaacttcaggatattaaggaaaaggaaacagacaaaattgcaatagtgcaaaaggttatttcggtcatcctgggagaagctacatctgcagccagtgcagtcgctgttaaacttgtgggctcaaatgtcacaactggcataattaacaagttggtcactgtgttagctcaaattggtgcttctctccttggtagtattggagttgctgttcttggccttggcatagatatgattgtccgtgccatcctgggagcagtggaaaaaacacagcttcaagcagccatcaaaagttatgagaagcatctggtggagttcaaatcagcctcagaaaaatataatcatgccattactgaggtcatcaatagtgaaacaccaaatgaaatgaacagccgttttatttgccactgaagtgtttttctgcttccttttcagtaacagtgtttgcttctttgattaggttcattttctataggcttccaatatggacttaaataagataaacaatttggagagggaaactggagatgccaagactagatgactagatgagttttgagtcaacaatgcctggatcagctgatgctagaccctgtgaggtaaaaaaattttctccctggatgttttcacaccctgctctaccagatcaacattggggtaaatgctatcgtagagtagcaagtataggggttacttttctcttttctaatttcagtaaaattcttaaatttcacattgaatgcagagactttcatttctaccaccagcttcaaacatcatttagttataaggggacatactcagtaacttctgcctagacacaaactctaggccttcgaatgagacagaaatactaccatatttttgaccatcagagtaaatctggttttctgtaaactagaagagactgaaaaatggtttgtaacaatgtgcttcaattaggacaggaagctgatctgtaaacgtctactgattacacaatgtaaaccggatggatttgaaaatggtaaaaatcaaaactaaaaacatcaaggtcctgtttcagtcactgcaatcaaccctgaccaactgtgataattaaatatcgctcaagtgaatgttcaaacactgaaacatttagaagacaagaaagcaaaacacagctacacatattgcatttaggatgcagaatagaaggtcactactcaaagcatttgtcatttaaaagaaagtcataatttattataagctttcagaaaaaagaatataatttcattttcaacactagcaaaaaggaggcagctgcctttgctacatgacgcattaggtgggccattttactaattacctgattttagaaagcgccaaaggctatggaagcctattaatggttccgctgaatctctgcagatgtgtttgttttctaaatcctttgccaaccaataattcccatgaggactcttttagtctatactgacaaaattattaatatgctgttgatgccagactgtgtttgttatagttgattctcccatccaagtacaagaaatgtattgaaataaaaactgctcagcatatcttaaaaatagtagctacatataaaattttagctacatgaaagactttaatatttccaacatacactgttttctctttctcttcttgcattgtttttcaaaacgagttgcaaaactatgatcactaatgtgttaggaaagaaaaaaaactagttgcaaaacattacaacttagctcaccttcgc

SEQ ID NO: 1170 - DNA, 2323 bp, Homo sapiens
accaccacccaacccgagggcttggcatctgtgagcccacatcctgcagcaggggccccctctggctctccggccagctaggggacacccaggccctcctctgcatacccccctaccacgtcgcctccgaacttggatggccaggatggggtcccgcggctctctgctcctcgtggaagcagggatctcgctactgggctagcgtgggatacaagaggccctggggagaatgcctggaggagccagcggctgcgggtgcgcaaagggcccgctctagctcagccgccgccgctccgcagtatgaccagtggaccatctccaaggcctgcgggaaaaacttgcctttgcgactggcgcactgccgcagcaccatggaggtaaccaggcaggaggggcctcgagacccaaccctccccacccctgccagcacccccccactagatgttgcggagccgacgagggacggagcaggtgcccagccccaggttccctgtggggttgccacgagcctccacccgcccgcctgctggcgggctccatggcggccccctacgcaaccacgagtgggcggtgcccttcccgacccaggtggtgcgggagaagctgcgcaagtacgtcttcgaccgcgtgaacatgcacaacctactgatccacctggtgcggcggcgcgggcagaagctggagagcatgcagctggagctggacagcctgcggagccagcccgacgccagcaaggaggagctgcggctgctgcagatcatccgccagctggagaacaacatcgagaagacaatgatcaagatcatcaccagccagaacatccacctgctgtatttggacctgctggattatctgaagacagtgctggcaggataccccattgagctggacaagctgcagaacctcgtggtcaactactgctcagagctgtcggatatgaagatcatgtcccaagatgccatgatgatcacggatgaggtcaagaggaacatgaggcaaagggaggcgtccttcatcgaggagcgccgggcaagggagaaccggctcaaccagcagaagaagctgatcgacaagatccacacgaaggagaccagcgagaagtaccgccggggccagatggacttggacttcccctcgaacctgatgagcacggagaccctgaaattgaggagaaaagagacctccacagcagaaatggaataccagtcgggcgtgactgctgtggtggagaaggtcaagagtgctgtacggtgctctcacgtctgggacatcactagccgcttcctggcccagaggaacacggaggagaacctggagctgcagatggaggactgtgaggagcggcgggtgcagctgaaggccctggtgaagcagctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaccttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcgacaccttccagttccccgacatggaccacagctacgtcccttcgcgcgccgagatcaagaggcaggcgcagcggctaatcgaggggaagctcaaggcggccaaaaaaaagaagaagtagccccgccgccccgctccctgctttgctacacaaataaacattttttccagg

SEQ ID NO: 1171 - DNA, 2020 bp, Homo sapiens
atattttccaataattttgaaacagttgcaggagtcactatcatctaaatgtatttagacttagaaattcagatgttacttgatttccttttatttaaaatcattaacttcatgaaatattgtaggttaagatgtaatccagaccaggcacagtggctcatgcctgtaatcccagcactttgggaggtcgaggtgggtggatcacctgaggtctggagtttgggaccagcctggccagcatggtgaaaccctgtctgtactgaagtaacaaaaaagttagctgggcttagtggcaggtgcctgtaatcccagctacttgggaggctgaggcaggagaatcgcttgaacctggaatacagaggtttcagtgagctgagatcgccccattgcactccagcctggacaacaagagtgaaacgctatcaaagaaaaaaaaaagatgtaatccagatatatttgacagtaattaaaatcttttaaatgttacaaatgcagtatgtttgtgaaagtattagaatagaaccaaagtgcctgtctctgtttataaagttacagtttgttagagctaccagaactttggagaatagggttagctactgaatgatggcaagttaaactaaacaatactgcatattactgttttgtaaaataagaggatcagtgagatgattcatgttttttttttttgagatggagtctcactgtgtcacccaggctggagtgcggtggcgcggtctcagctcactgcaacctccatctcccggattccagcgattttcctgcctcggcctccaggtatctgggattgcaggtgcacaccaccacgcccagctaatttttgtatttttagtggagatggggtttcaccatgttggacaggctggtctggaactgctgacctcagctaatccaccctccttggcctcccgtggtgctgggattacaggcatgagccacctcacccagcattttttttttttaatttttttaatgagacagagtctctctctgtcacctaggctggagtgcagtggcacgatctcggctcactgcaacctctgcctcccgtgttcaagcaattctcctacctcagcctactgggtagctgggactacaggggtgcaccaccatgcccagctaagttttgtatttttagtagagatgggatttcaccatgttggctaggctggtcttgaactcctggcctcaagtgatctgcccaccttggcctcccaaagtgctgggattacaggcgtgagccactgtgcccagctgagatgtttcttattattttggaggtggagaggattttagacctctttgagcatctgaaaaaaggctatatatgtatggttttctcttcagaaaaatcttaagactcacaatacggggacttccttgttaccaggaagattttctggcaattcctagttaataaatcttattctaatggaacatacattgatcttgagttaatgcgtggttgaaaaaaaaagcgggggcaacttgaaatatatgcagtaaagtagtccatgcatacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggtgattttaaacctgtttatttgtaaggattaagtaccctaataggcttaaactatgatagaggtttaatacagaaaaaattgacaggtattataaattgtggatccagttacttgcttatttaatttgtaaagaggtaaaattagctctggttgagatatcaagtatggcaggtatttgagaaggctataaatcataattttcatttagttaaaatatggacctgattctgggaaaccctatcattccatctcaatgttttacaataaaataaaaact

SEQ ID NO: 1172 - DNA, 2040 bp, Homo sapiens
agtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctgatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtggggccgccgcccgggccccgccccccgccccggggtttggctctggccccgtggaaggcaccgatgggtaacacgtctcctgagggtcccctggccgggctgggtcgggtgtcgctgtctccagcaatggggtggggagaggggtctggggctgggaggccgggaaaggaggggcgggggtgggggccggcgctggggctccctcagggctgtgttacatccgccttgctgcctgccattgccaatcctgggagtgggggagtgggatcggtggggaggaagggatgggggaggagcggggattgcttggggagttgggaaacttgagcacagcgggggttgtaaaacttgggaacctcatgttgggcgtgaaggctcttgggatttgtactttgtggtctggaagggctggactgcgggtgttcaggcttcgttgggtggacggggggagcatggggtgcggaccccggggtggggtggcctgggtacgaggggggggagtgcatggggtcagcctccacacttgcttggggaggagggggctgcactgctccgagggagctggctggcttctgccaggccctgcgtgggtctcccattaagtccttggcaaagctggctgctcatgccctggcctcatagcttccaggcccctcctgctggaggtgccattgtgtggcaggcctggccccaacccctacctcctgtctgcgcaggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgttt

SEQ ID NO: 1173 - DNA, 2320 bp, Homo sapiens
atttttaaccttcagacaaacctttctgttgttccatagtgaatgaatgttggtgagttgtcttggggtgggggataacacaaatgtccacagtctggtgagctgccttcctttgggacagggatgggactagttcattttgacctcctcagtcttatactacaatgatttctacttctaggcagaaggtttggtaatgcaaggatgatattaggtaaaagaaggggacattggatttttaaagcagatttgagtcatggtcaaatgatactgtacgacaaagcacacttcgtaacaaggaatattactagagataaagaagggcattttgtgataataaaggcatcagtacatccagaggacattaaaaacccttgtcttgcttcaaaagacatgatattaaaactgacaaaagtgaaagaagaaaatggcagattcacgattaaagttggtgatctcggccggttgcagtggctcacgcctgtaatcccagcactttgggaggccgaggtggttggatcacttgaggtcaggagtttgagaccagcctaaccaatatggtgaaactctatctctactaaaaatacaaaaattagctgggcatggtggcacatgcctgtaatcccaggtacttagggaggctgaggcaggagaatcgcttgaacctgggaggcagagtttgcagtgagccgagatggcgccattgcactccagcctggacaataagaatgaaactctggccgggtgcggtggcccatgcctgtaatcccagaactttgggaggccgaggcgggcggatcacgaggtcaggagatcgagaccatcctggcaaacacggtgaaaccccgtctctactaaaaatacaaaaaaaaaaattagctgggcctgttggtgggtgcctgtagtcccagctaactcgggaggctgaggcaggagaatggcatgaacccaggaggcggagcttgcagtgagccgagatcacgccactgcactccagcctgggcgacagagcgagactctgggtctcaaaaaaaaaagagtgaaactctatctcagaaacaaaaacaaaacaaaacaaaaaacatgggagatctcaccactcctcttctgtggttagaacaaaggaggaacacacgcagaaggagggatagggccttacaactctccctgccagcctggcctcatgcatgttcattaaaccccccagcaactgcagggtgcacattcttttcaaatgaatatggaatattcctcaagatagaccatatgctggcccatcagacaggtcttgataaattcaaagggattgaaataatactggatatgttctcagtgaaatttaagtggaaatcaacaacaaaagatagctagaaaattctcaattatttggaaattaaacagtacacttctaaataaaccctgggtcaaagaaattaaaaagaaaatgagaaaatattttaaactgaattataatgaaaacatagcatgtcagtatttgtgggatatacataaagcagtatctagaaacttacggctttgtagcttaaatgtttatattccataagaagaaacattacacaaaatccctatcaaaacattggcaaaaattaaatccactaacatatgtaaaaggataatatattatggtcaagtggcatttatccctggaatgcaaggctggtttatatttgaaaaaatcagttcatataattcttcatattaacagaatgaaggtgaaaaaccgtatgattatctcagggaccacaggaaaaagcatttgacaagatccaatgtgataaaaaaaaatctcagcaaactaggactagaggggatcttcctcagccagataaaggcatgtatgaaaaaccctcagccagccaggcgcggtggctcatgcctgtaatcccaacactttgggaggccagggcaggtggatcacctgaggtcgggagttcgggaccagcctgactaacacggagaaaccccgtctctactaaaatacagaattagccgggggtggtggcacatgcctgtagtcccagctactcaggaaactggggcaggagaatcgcttgaacccaggaggtggaggttgcagtgagccgagatcacgccactgcactccagcctgggcaacaagagcaaaactctgtctcaataaaaaaaaaggaaaacccacagccaacattatcactagtggtaacagggaaaatgtcccctttgacccccaccccaagtacagaacatgcaaggacgcctgttctcactgcatgtcttctgtgttgtactgaagctcctagctggcgcagtgaggcaagac

SEQ ID NO: 1174 - DNA, 2502 bp, Homo sapiens
gaaaaatgaacgtggccttcggacacagggtggtcccttgccagggactggatggaactggttcaattccccgctcctgggcttcctggtgtgcaacgtgagccatgctcaccccagggtggctgggaaaaaacgccggtccgctctgagcattcgtttcagtgatggctgttcttgttcacgtgagatgtgccaattctacaatactaaaccgttgggagaagcttcaaggggacagcacctggggaggggcagtggcgggctccaggttgcccaaggctgtcatggagaggaggagaccccagtccagcccagccttgtgcctgcagtggaggttccagttgtgaaggggctccaagtgccttgtttcatcctttgcttgataatgaaccacctctgccaggtgccagctgtactgtgcacctgcagctccacaccctctaggcaccagcccctccactctttggcctcttcgacagggaaccccgaggggacagtggagcaggcctggggctgttccaggcagcaggggggcgcctgggtcagcgtccccacccgctgccctccccggccttccaacttgctgtgtgcacattaacaacatggacggtctttttcttttattataaaagtgattcattctcttgtgaagatttaaatatgaaagagtggatctccgctaatcccacccggtgatgatagcagccgacagatgggcgagcgtagagctcagacattgccagcagcgtcagatccttatatatccagagcatggctcacacgccaccgccctgctggctctgtcagccgcacggtcctccgcgacacctggggctctccctccttcctttgtgtgcacaacctcaaagccattttttccagacttggcgtgaagatgattttctgacacgttgatgcttctgaagcacaaggagggccctgtctccacggtgtccaagcggaggctgacatcctttcaggagggaggtgattcgggcgcagctgggctggcgggaggcatggaggctgagtccccttcctcactgctctctacctggagaagaaaccaccagaccatgaggccgagctggggaaagttccggggggctgcttgggctctgtgctccctccactggggcaggcggagggccctgcgtgctccttccaggcaggggctgaggggactgtggaagccacgacaggagtctctgtgaacagaagacccaaggacaaggtgccccagcactcccagccactagcaaggacaggcaattttcaaaacttctccccaaactacaacctcaggaaaaggggtggagaaaactcctttgacagagatttggttttcaccaccatgacaggacaatgatgatggatggaagctgtggctgggcgtgggaaggctgagtgtgcaaatgtgggtggagttctgaggccccgcccccgccagtcttccacttggtccctgtgaggacccacatgagggaagtgttgcttctggcctcagaacccaaggcagagcaggctggagtcccaccccatggatcacgggcccacactgtgaccctgagtcctggacatgcgcagagggagggtgtgcacgagcccgggagctcctgtctctgtcttaagagtggagcatgtcttaagagctggcatgaggatcagagggtcccttcagtgcggccttctagaagaactacagcaaccaggccctcgcaggggggagatgcacctgctggggctaaggagcgagtgaagccagcccctgagacacatgctcccaaccccatcctcacctcccaagagagggggagcctcctgttaagcatccaagtcccaagtcaccggccggcatcggctgcagctctctgtgtgtggggacatctcattctggtgtcttctttacacaggtcagcgctcacaggctcggctgtgtctcaagacccaattccttcgagtcactgagatgcccaaggacaagggcaacagagagtgtgaaaagctggagtagacgggacagaaaacagggtgcagcgtcccccaggttggcagatagcccagccccagggaccccacagccatggcaacctgtgtgaatgagccccaggagcagggcagtacacggtctgcgcgactgtgcggggcagccctgggtctctgcctcaggggagagattgtgtcctcgccttttgtggtttctagaggctcctgccctccttggctgcacggcatctcccagcctctctctcccttccgtcgtcccctctcctcctctgaccctgaccctcccagtccctcttagaggggctgtgattaaactgtgcccaccctgaccatccagaataatctcccatctcaaggtccttaacagcatgtggaactgcattagccgccccaaggcccccaaaaggcaaccctggattgggccccccaagttgcctgggattcatggccaccacccggctcgacggctccagaccgaaatgcacccagttatag

SEQ ID NO: 1175 - DNA, 2152 bp, Homo sapiens
cactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtgtacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttttaaaaat

SEQ ID NO: 1176 - DNA, 2641 bp, Homo sapiens
gtcctaagttacgacttttccaatgattctctggttaagaacgagaacttcttacttaatcattaataaaggtgggtagactgaagatgttactgaaatgcttttgtttcaacctcgttgatttaattttctgttatcctttggcagaagttctgggaaatggtataaatatgtataagtacatacatattttggggtttttaatttttttttatttcagtagcttttggggtacaagtggttattggttacatggatgaattgtatagtggtgaagtctgagattttagtgcactcgtcacctacctgagttttgtttttaagattgaaacattatttgatatatccatcatcctcctcttggtgccctttgttcctatatctgaaaaatttttttactgaatttctaggttgtgataattttaattcccattgttagtaccttagtacctagtcatatattttccagttctgtaggattttaagcagaaaaattaagcaaatatgctttcaagtgtctaatatgaagagaaaatttgatcgcttttatgataatagtttttttttctcttcctaatataggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcaggcggaatgggtagccttgaattatgtgccgtttgctgaaaggtctttagaagtagttgtggatttataccaaaaaacagcgtgtcacaaagcagtggtgaatgagaaagtgctccagaatattattaagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggtaaatgccctcttccaaggcaacaagtaacagaaattatatttgttttaaaagcagtcagtactcttattgattcacttaagaaaactcagcctgagaatgttgatggaaatacctgggcacaagtaattgccttatacccaactttagtagaatgcatcacctgttcttcttcagaagtctgttctgcacttaaagaggcactagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcaaataattcttggcagctgttgttggcctcctttaaattctacttacctgagttcagtaattcatattacaggcttgcacatcaacaaaggctcctgaatgaacagcagtgtaaggctttaataaattaaactgatgggagggataattaacactacagtatacatgctaccatatctccagttggtgatttaaagtgagcttatgtacagtttgtggtgtatgtgttaatgatgtacttttt

SEQ ID NO: 1177 - DNA, 1941 bp, Homo sapiens
tgaacatacttagtattaggtgatataactgtattgatgttaaattatataagcctgataatcgtattgtggttgaatgtccttgtttttaggagatacatgctgagtatttagaaatgaaatgtcatgatgtctgcaaccttcatatgctgaaaaaaaattacctatatacatagagaaagcaaaagggacagagtgttagcaacagatgactctagctggaggatataacgtgcacattggcattttaaaattttttctgtagatttggactttttctgttttttatttttatttatttattttctctgagacggggtctcactctgttgcccaggctggagcacagtggcacaatcatggctcactgcagcctcggactcctggactcaggtgatgctcttgcttcagcctccccagtagctgggactacaggtgcatgctcccatgcccggctaatttttgtatttttttgtagagatggggtttcaccatgtgtgcccaggctggtctcaaaacttctgggctcaagcagtgtgcccacctcggcctccaaagtgctgggattatagacatgagccaccacacccagcctggaatttttcaaaataaaaattggagcggggaatctcagctatgtggtttggatcaagtatatgcagatatggatatctggttatgtggcttatccacagagtccagcctaagatctgggtttaaattatactgctgtcatttttttccttttgagggagtggatatagtagaaagaattgggatttcaatattttctccagaacttactagctttgtgaccttggatagttaatttatgctccttcgcctcagtttgttcatctataacaagggtagttgtaaggattgaggacactgtcttgggaaaaatggcttgcatatattaagtactcaataaattataggtattagccccttttattaaaattattttttactgtttgggataatcttccttcaatctttttattttttgcactagtagcgcctgttctaaaaaaagtgtgtttatattctataggactggctgatagtccaagaggggaagccatattttagcctggccaccagaggtagatcatgttaatcaaagcattttaaccaaggctttcctgtttcttctttctccctgctttgcatttgatcacttcttagcttttatttcttaacgcgatgggaacatttgcaggtctcagtgattctacagactgttagcacaatgtgtctaatcggaggggatagactttttaaaaataactcttctggtagttaaataattcctcatggaaaatgtgtaaattatagaaaaaattcaataggaaaaataagttgtctgtagtcctacctccccggagatagccactggtactgttttgtgggtttcctcccagtctgattttctaggtacagaaatggacaaaagtgttccatttaatttttccaaaaccaggatcacggggaatgctgccagtatttgagcgaaagtatctgtgttttggtcactgttttgctgtgaatgctgtgtttatgaagctacctagcagttttcaccctttcctgcaactcagcacattccctggggcggagtcaggtcatgggctgcaacctggagagtttatggcaaacagaagcccctgttacctcatccaatggagataacccttgctgcctaggagatgtgctgtatattcttccaggtcttgtttttcttgatagactcatggtagcttttacatcatttccatttgcgaatgaaactcagttgacccttgaacaacatgagcttgaactgcatgggtccacttacatgcagattattttcaatcaatatatttcggagattttcaacaacatgaaaacactcatagatatacaccatgtataactgtgtagcctagatatacc

SEQ ID NO: 1178 - DNA, 3194 bp, Homo sapiens
gtggaaagtgccgatagcaaataccggagggccgggcatgggcacagagtccgaagatcaagggaaagacccaagcagtaacgcggaagatgccagctggtggtcaccgatgccaagaaggaagagaagccgtcccagatggatgtggaagatctgtcagaagacgagatgcagaccagctgggtgtgctgcatcccgtactccaccaggaagagggcaaaggagagcacctagcgccccggagagggtgctcagagcttggcgaagaagaggaaggagacggggtgcagaggggctgggggcacaggaggcgggacggagggcgatccggccacctacttgccgcccaagagccttctctgccaggcactgaggtttctgttttcttcttgtgggactggccaggcctggaaggagcgagagcacagaccgcgcctttgggctaaagatcccgccagccctgagcaacgctggggtgccgatgaccacaccaggtgtgagccacgcctgaaacccactgcccactgggtgagtgatgacgtgaccttcaacaaacacaataaacaagcacgggaagatgctcctcctctccaccagatgctcctcctctccaccagatgctcctcctctccaccagatactactactcctctccaccagatactactcctcctctccaccagatgctcctcgtctccaccagatgctcctcctctccaccggatgctcctcctctcgtcgagatgctcctcgtctcctcgagatgctcctcgtctccaccgggtgctcctcgtctccaccggatgctcctcgtctccgccggatgctcctcctcttcgccaaatactactcctcctctccgccagatcctaatcctcctctccgccagatactactccacctctccgccagatcctactcctcctctccgccagatcctactcctctccgccagatcctactcctcctctccgccagatcctactcctcctctctgccagatcctactcctcgtctccaccagatgctcctcctcgtctccgccagatgctcctcgtctccgcgagatgctcctcctctccgcgagatgctcctcctctccaccggatgctcctcctctcctcgagatgctcctcctctcctcgagatgctcctcgtctccaccggctgctcctcgtctctgccggctgctcctcgtctccgccggctgcttctcgtctccgccggatgctcctcctctctgccagacactactcctcgtctctgccagacactactcctcctctccgccagacactactcctcgtctctgccagacactactcctcgtctccgccagacactactcctcgtctctgccagatgctcctccgctccacgagatgctcctcctctccacgagatgctcctcgtctccgccagatgctcctccgctccacgagatgctcctcgtctccgccagatgctcctccgctcctcgagatgctcctcctctccaccggatgctcctcgtctccgccggatgctcctcgtcaccgccggatgctcctcgtctccgccggatgctcctcctctccgccggatgctcctcctctccaccagatactactcctcctctccaccagatactactactcctctctgccagatactactcctctccgccagatactactcctcctctccgccagatgctcctcgtctccgccagatgctcctcgtctccacgggatgctcctcgtctccacaggatgctcctcctctccaccagatgctgctcctctcctcgagatgctcctcatctccaccggatgctcctcgtctccaccagctgctgctcctctccaccagctgctcctcatccccactggatgctcctcatccccgccggatgctcctcctctccgccagatcctactcctcctctccgccagatcctcctcctcgtctccgccagatcctcctcctcatctccgccagatcctcctcctcgtctccgccagatgctcctcctcgtctccgccagatgctcctcgtctctgccagatgctcctcctccccacgagatgctcctccggatgctcctcgtctccaccagctgctcctcgtctccaccagctggaggactccagccccttcctgccctggcctcttgctcagtggcttgttgggtggggacagaggcccctggggcacagcaggggaggctcagccctttgtgggcctcgtgtgggctgcagctcctggaagcacccccaccaggcaggagtgagaggtgcagggcagggatggagcatctgctgtgtcaccaaagtccctgcaggagccaggagcacggtggacgcagctgagccccggctgtgactgcgagagcaacagagactgtggtgctggcactaggatctgtccctggagggaagccacatgctccccactcagaggaggagagggagtcttcctaggggtgtggggggctccaggacatgcctgtaagacgagtttcaccagaatccacccagagccctctcgttcagacacgcacacgtgcatattcatatgtacacagcacatacatgctcgtacataccacacatgtgcacaggagggcacgggcaggtgacctgcagcatctctgatccgggtgtctctaaggcagtcagaggccacaggcggagatgctgtgtgcactgtctattcccgtggagacacatgggggccgtccctgtggtgcacatgataacgcagaggctcccagagggtgagctctgcccatcactcagccagggagggaggggcccttttcagggagccgcatgccacgcagagcttgtcccactgggtagtttcctctgatcaaagtggggcaccatccaggctgaagagagaaaggggaccccccaaagccagcacccacccttgactgaaagacaccacagaagataagtgcccatcggccccagagtcatcatttcccagacaaccggaaatgggccctggacgggctgtcctggacaggctgccgggcagttgggtgtgactcagttgcggcctccaactgtgccaaccagaaaggcacccagagaagcttccggaaatacggttggtttgtccccttggtggggcaggaggcggcagctctgccgggtggctcccagcaccctcccccacagagcaaacatcggcatgagtctgtc

SEQ ID NO: 1179 - DNA, 2537 bp, Homo sapiens
tcatactggagagaaaccttacaaatgtgaagaatgtgacaaagcttacagtttcagatcaaattttgaaatacatcggaaaattcatactgaagacaatgcttacaagtgtaatgagtgtggaaagacctttagccggacatcatcccttacatgccatcgtagacgtcatactggagagcaaccttacaaatgtgaagaatgtgacaaagctttccgtttcaaatcaaaccttgaaagacataggagaattcatactggagagaaaccatacaagtgtaatgagtgtggcaagacctttagtcggaagtcatacctcacatgccatcatagacttcatactggagagaaagcttacaagtgtaatgagtgcggcaagacctttagttggaagtcatcccttacctgccatcgtagacttcattctggagagaaaccttacaagtgtaaggagtgtggcaagaccttcaatcagcagttaacccttaaacgccatcgtagacttcatagtggagagaacccttacaaatgtgaagatagtgacaaagcttacagtttcaaatcaaaccttgaaatacatcagaaaattcatactgaagagaatccttacaagtgtaatgagtgtggcaagaccttcagtcggacgtcatcccttacatgccatcgtagacttcataccggagagaaaccttacaaatgtgaagaatgtgacaaagctttccgtgtgaaatcaaaccttgaaggacataggagaattcatactggagagaaaccttacaagtgtaatgagtgtggcaagacctttagtcggaagtcatattttatatgccatcacagacttcatactggagagaaaccttataagtgtaatgagtgtggcaagaactttagtcagaagtcatcccttatatgccaccatagacttcatactggagagaaaccttacaagtgtaatgagtgtggcaagacctttagtcagaagtcaaaccttacatgccatcgtagacttcatactggagaaaaacaagtgtaatgaatgtggtgaggtttttaatcaacaagcacaccttgcaggtcatcatagaattcatactggggagaaaccttagaaatgtgaagcatgtgataaagtttacagtggcaaatcaagcctcagaagacaggagaattcatactggagagaaagcttataaatgtgaagaatgtcacaaagtttacagtcgcacatcaaaccgtgaaagacaggagaattcatactggagagaaaccataaaaatgtaagagtttgtgacaaggcttttgggcatgattcgcacctggcacaacatgctagaattcacactggagagaaaccttaccagtgtaatgagtgtggcaaagcctttagtaggcagtcaacacttgtttaccgtcaggcaatccatggtgtagggaaactttactaaggtaatgattgtcacaaagtcttcagtaatgctacaaccattgtgaatcactggagaatccataaggaagagagatcatactagggtaataaatgtggcagatttttcagacattgttcataccttgcagttcatcggtgaactcaacgctggagagaaaccttacaaatgtcatgactgtggcaaggtcttcagtcaagcttcatcctatgcaaaacataggagaattcatacaggagagaaacctcacatgtgtgatgatagtggcaaagccttcacttcacacctcatgagacatcagagaatgcatactggacagaaatcttacaaatgtcatcaatgtgccaaggtcttcagtctgagttcactccttgcagaatatgagaaaattcattttggaggtagttggtccatatgcaatgagtagagcaaaccatcaagcattaattgacattagggtcaattcagcattgacttgagtttgtattgacttaacattgagttcaagcattaattgacattagtgtttatgttaagaggattgggccaggcacatcagcttacacctgtaatctgagcgctttgggaggccaaggtgggtagatcacttgaggtcaggagtttgagatcagcctggccaacagacgtgagccattttcccagcctgttttttgtttctttaaaaaaactgatagggatttttatggatatcatgttgaatctaaatcacattgggttattatataatcatttcacaatattaatttttccaagctatcaatatgggttgtagctcaatgtttttaatcattttgatcaatgtttgtagatttcaaggtacaaacttctgacctttgtacgtttatttctaagtatttctttaagttctccagcaaatggaagtgttttaaaattttcttttaaaattgtttattgttaaagtatggaaattcaactaatttttggtgctgatactgtattgtgcaaatccactgactatgttacttagttccagtagtattttggttggctctttgtgattttctacacagaagattatgtcatctacaaacaaatataattttacttctt

SEQ ID NO: 1180 - DNA, 2733 bp, Homo sapiens
ctggcaaaggcctgctctcatcaatgtgtggtttccaaagtcaccctgtccatctccattccagccagctggaaggggaaaccaagtgggaatgtgtgcccaagttttacaaccaaacatccaaaatggtacgtgtcgcttctcccacattccataaggctagaactcagccccgcaacctagtttaactgcaggggaggctgggagatgtcatctagttgtaacccagcgagaaaactactggacaactagatttctgcacaagagatctccagagctccattagagattatcatgtgtgttcatcccatttctaaagatgccaaagtgcactggcacttaaggttcacttacatggctgggtttttgaggttgatggctgcctttatcttccagtatgattactgcccaggaaaacactctgttgcatgaactaaaggactgttttatagtgaccaaaaaaagtggggagggggtatctctcgagggcttttcctaggaatcccaaatttctagctatcctgaatcttgtagaactcctacacgcagactgtgaaatcattactatcaggggcttactaaataataaatatgatctattaccttgagctaatttcatagaaacgtacggctgttatgtgtttttttaaagagctgcagaggtcttccgtgattctctagtctatgtgttccttgtctagattgagtaatgaaattgtgaagtgtaattgctgcctaacacagccaagctctcccgtggctgattgtcttgctttgctttcttagggtttaaatgcggtatttgacatcttggtgataggcaaattcaatgttctggaaattgtccagaaggtactacataaggacaagtcattagaggtgagtctgtacttttatctccagcccagacatggaaaatgtcaagtaccagctgatttaaaatgccattctcaaatattccttgtgattttgaattctacaataaccagccttttaaagcacagtgttgaagcagttcaggcagaattgctgcacatctgtacctggctcagccacacttttatttgaaaatcagccacctctggggctttgcgatgtccttgcagaatctcggcatgctcaggaacgggggcctcctcttcagaatgaccctgctcacctctggaggggctgggatgctctacatgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcggagcgtgtcctctacctccccagcattgggtactgtgtgctgctgacttttggattcggagccctgagcaaacataccaagaaaaagaaactcattgccgctgtcgtgctgggaatcttattcatcaacacgctgagatgtgtgctgcgcaacggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggttgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctggtaagcgcggggtgccctgtgcctgtggaaggaaagatgggttatttttcttatttataataaaatgacatagtgacacccacctagcccatacattttataaagttctttcacatgtttctatctcatttgaaggtagctatttgatttccttttgagtaattttttaaagctctcattagagagcagtacagtgtgaattagtcaagtttaagaggtcacccacgcaaaaggttaaacccaggaataaattaacatgttaaagtcccgtccgccctgtaaaacagcactccaatgggtaacttcctgataaacatcagtttctctgtttttaaaacaagaattgagtaagaacagagattaaagtaacaaatccgtagtatgatttctgagctcccttgttctccttcttcaagggagcagagctcttcatctgcagggagcatttcccccaaaaaaggcagctttggagggcacgggatttatttgaaagggctttgacattatttggtggaaatagaaaataacgtgttctgtagtagctttatatttttggttattgacaggatgtttacgaagatctgattgctcttgattttcttgacaaaaataaaatgagacacac

SEQ ID NO: 1181 - DNA, 2135 bp, Homo sapiens
aaagcagagccgagccgggactgtccagtgggagcaggcgccccggccagcgcagacctggaggcgcacgggcgccgcaccgcacgattcggctcggggtagagcggagccgcagccccacgcgcagcccaggacccactcgccaccgccgcttcctcagcacccatggggaccaggagactttaaaggagtttggggtttcgggagcagggaaatcacggatccccgctcctggccctcgcctcgccacctcattgatgggcaaccaactggaccgcatcacccacctcaactacagcgagttgcccacaggggacccgtcggggattgaaaaggacgaactgcgggtcggggttgcctacttcttctcggatgatgaggaagacctggacgaacgcgggcagcccgacaagtttggcgtgaaggcccccccgggttgcaccccctgcccggagagccccagccgccaccaccaccacctgctgcaccagctggtcctcaacgagactcagttttccgcctttcggggccaggaatgcatcttttccaaagtgagcggtggccctcagggcgccgacctaagcgtctacgcggtcaccgcgctgccagcgctctgcgaacccggcgacctgctggagctgctgtggctgcagcccgcgccagagccgcccgcgcccgccccgcactgggcctcaagagcgaggagatctgctggacgaactcggagagcttcgccgcctggtgccgctttggcaagcgggagttcaaggcgggaggggaggtgccggcaggcacgcagcccccgcagcagcagtactatctcaaggtgcacctgggagagaacaaggtccacaccgccaggtttcacagcctggaagacctcatccgcgagaagcgccgtatcgacgccagcggccgcctgcgagtgctccaggagctcgccgacctcgtggacgacaaggagtagccgcctaggggctgccggcccctctgcctcccccgcacctcgctcccttcccttccccgcacccggacttcgcagtcagcggttctcaacctctgccccgccccgccacgcgcgtccgccgccggtggcccgggcccgggctgcacccccgcatccccaagccagcggcaggaagtctcaggaactgccccagggccgaaagggcgccgctgcgagcgcctggctgacagccacagcggtggtgacggtgctgggagaccccgcgtgcgctttccccttgagatgtaaaccgggaacggggaaggggctgaggggagaaaggacatggccttccccgcgagtccatggccagtgactgtggcccgactcgaaaacaaccctcttctcaaaagggaccatcaccgccccgagcgtgcgcacacagaccggtcggaggcgagaactggtctctacagggcacagttcagctcctctgtggatgcgtccccagatcgcaggatttccaagaaatcgagcctgtcccttgtgcacttgggaataattccccaagacagcacttcgggattccgggttatcctgaggctgcccgggacttttccagctctccagccccaggtctcctgacattgtgttccaggctgcgggctaagccagacagtgtttgcctccggttctttccaccgtgggaagcgaacgccacccccacccgcctttgcctgcgagtctccctcgctggcagaagggaagccggcccggtcccgggaggaagatggcgctgcgaattcggtgaggacagccggccccgcccccgacaaggagctcgctcgttcacctggtgtctgggaacttgaatgtgtgaagggcgcttattgttctgaacccttgattgctccctcctcgggctgcatttcaaaaatagtcatatttttaaaggagttggaggagagggagggggaggacatggcaccattccagaaaccagcattgttacaacaccatagccagtatatttagtttggcttttcctaacatagaaatcttcaaagctggggaagtggaaataaagttttaaaaatgagagagcagttttccaactatgtcaacaaagcctatcgtgttgatgtttttattgaccattttagcaacaggctaataaaatttcaaattg

SEQ ID NO: 1182 - DNA, 2767 bp, Homo sapiens
atctgcgtccgcacctgactcagctgggcaccccggagctacggaggggccagcgggctcccttgcccatgcgtctgggagcgcgcgggggacgtggcgaggctgaaaatgagtctctggaagaggaaacccgatgggatgatgcctggagtctctccctctctcatcagggtgcaatcggcatttggggggcgcatggtggagaatacatatccaatgagcagcgctgccctggcctcgagcactaaatgccagttcccctagctgcttgtgacaaccagaaaacgccccaacaaatcaccagacgttggcagttctccccaaagcaaaggctttagagcttcctgggttaatctggctgccacttgtgagcctcggaggttcctgatctgtacaccaggatggagtctccctctgtcgcccaggctggagtgcagtggtacgatcttgactcactgcaacttccgcctcccaggttcaggctgttctcctacctcagcctcctgagttgctgggattacagtgtcctggtgaagacctagttcttgccggagacaattccactgcagaagcactttacttaaaaggacttgccaggctggacaatgcccgttgacttggggcaggccctaggcctgctgccatcgctggcgaaggccgaggactcccagttctcagaatcagatgctgcccttcaagaggaactctccagccctgagaccgcacgccagcttttcaggcagttccgttaccaggtgatgtctgggcctcatgagaccttgaagcaacttcggaagctctgtttccagtggctacagccagaggttcacaccaaagagcagatcctagagatcctcatgttggagcagtttctgaccatcctgcctggggagatccagatgtgggtgcggaaacagtgtccaggaagtggagaagaggcagtgacccttgtggaaagcttgaagggggacccccagagactgtggcaatggatcagtatccaggttctaggacaggacatcttatcagagaagatggaatctccaagctgccaagtgggggaagtggagccccatcttgaagtggtgcctcaggagttgggacttgagaattcatcctcagggcctggggagcttctgagccacatcgtgaaagaggaatctgacacagaagcagaactagccctggctgcctcccagcctgcccgactggaggaaaggctgatcagagaccaggacctcggagcctcactgctcccagcagcacctcaggaacagtggagacaactggattccactcaaaaggagcaatactgggatctcatgctggagacctatgggaaaatggtctcaggagcaggcatttcccatcccaaatctgacctgactaattcaatagaatttggggaagagctggcaggaatataccttcatgtcaatgagaagatcccaagacccacctgcataggagatagacaagagaatgacaaggagaacctaaatttggagaatcacagggaccaggagctcctgcatgcttcctgtcaagcttcaggagaggttccttctcaggcttccttgaggggcttcttcactgaggatgagccaggatgctttggagaaggagagaatctccctgaggctctgcaaaacattcaggatgagggaacaggggaacagctgtctcctcaagaaagaatttctgagaaacaactaggtcagcatttgcctaatcctcattcaggagaaatgtccaccatgtggcttgaggagaagagagagacctcccagaaggggcagccaagagcccccatggcccagaagctccccacctgcagggagtgtgggaagaccttttataggaattctcagcttatttttcaccaaagaactcacaccggagagacatactttcagtgcaccatctgcaaaaaagcctttctgcggagttcagactttgtgaagcatcagagaactcacacgggagagaagccctgtaaatgtgattactgtgggaaaggctttagtgacttctcaggattgcgccaccacgagaaaatccacacaggagagaaaccctataaatgtcctatctgtgagaaaagtttcattcagagatcaaactttaatagacatcagagggttcacactggagagaaaccttataaatgttcgcactgtgggaaaagtttcagctggagctcgagccttgacaaacatcaaagatcccacttaggaaagaagccctttcaatagccagtaaccaaactctctttccccatttctatctcccagcccagtcacaaaaatactcagctccatcaagaggaattgtgtctaagaggatacccctgttaatctccttttttcttggattggagaggagagaatctggacatggctttggacttggaggatatcttggattggattgcacaatggcttaaattcttgattctgcctcaggagaaagaatagtcttcatgtttccactcatccttcctttggacccatcggggaaaaagtctaaattggagatccagttttagaagtgctttctgggaagcatttaatgggattagctgtagtcactgcttatgggaagaacctcagatcagccccttaaaatgagttctagagcaggtcttctgttcctgaaggggagaagcatagagggcctgtgagctcacgtgtgttctttgtcataggggtgaaaaaccaacttcaagtgtcccttgtttgaaataaacttagcagagtcactttct

SEQ ID NO: 1183 - DNA, 2163 bp, Homo sapiens
aatactagccagccactctctccaaggcaaggggagggggacaaaaagcaattttgagatttgtacagtgcttgccaggtccttcaaaaatgactaccggccgcccatggctcttgcacagcgggtgggaggaagagtccttgtaatccacctctcccaaggaactcctgcgcgaggtttcagattccccgcctgcaggctatggctgacttccccgtatcctgtgtgacgtgggatgtgtggcttcgcgcagcttcccgatggatgatccaacagatgtcatcttgcactgtagtgatagtcttgttgggaccacatgaagtgcagctgtaaaacagcccagcacctcacgctcaggaagggtgtttctgaagactgataaagccccttcagtgaatggcgccagggcacagctgtccacgacaaagtgaggatggccagataagaatagctccagtctgcagctcccagcatgatccacgcagaagatgggtgatttctgcatttccaactgaggtcttagcaaatggcacaccaggagattatatcccgcacatggctcggtggatcccacgcctatggagtcttgctcactgctagtgcagcagtctgagatcaacctgtgaggcagcagcctagcaggggaaggggcgtctgccattgctgcagcttgacctccgctggtgatacccaggcaaacagggtctggcatggaccttcagcaaactccaaccgacctgcagctgagggacctgttagagggaaaactaacaaacagaaaggaatagcatcaacatcaacagaaaggacatccacaccaaaaccccatctgtaggtcactaacatcaaagaccaaagagagataaaaccacaaaggtggggagaaaccagagcagaaaagctgaaaattctaaaaaccagagcacctcttctccttcaaaggatcgcagctcctcaccagcaatggaacaaagctggatggagaatgattttgatgagctgaaggcttcagaaggttggtaataacaaacttctctgagctaaaggaggaggatgtttgaaaccattacaaggaagctaaacaccttgaaaaaagattagacgaagggctaactagaataagcagtgtagagaagaccttaaatgacgtgatggagctgaaaaccatggcatgagaactatgtgttgcatgcacaagtttcaatagccaattcgatcaagtggaacaaagggtatcagtgattgatgatcaaattaatgaaataaagggtgaagagaagtttagagaaaaaagagtaaaaagaaatgaacaaagcctccaagaaatacaagactacgtgaaaagaccaaatctacatttgattggtatacctgaaagtgatggggagaatggaaccaagttggaaaacactcttcaggatattatccaggagaacttccccaacctagcaaggcaggtcaacattcaaattcaggaaatacagagaacaccacaaagatactccttgagaagagcagcctcaagacacataatcatcagattcaccaaggttgaaatgaaggaaaaaatgttaaggccagccagagagaaaggtcgggttacccacaaagggaagcccatcagattaacaggagatctctcagcagaaactctacaagccagaagagagtgggggccgatatttaacattcttaaagaaaagaattttcaacccagaatcacatatccagccaaactaagtttcataagtgaaggagaaataaaatcctttacagacaagcaaatgctgagagattttgtcaccaccaggcctaccttacaagagctcctgaaagaagcactaaacatggaaaggaacaaccagtaccagccactgcaaaatcatgccaaattgtaaagaccatcgatgctaggaagaaactatatcaactaacgggcaaaataaccagttaacatcataatgacaggatcaaattcacatataataatattaaccttaaaagtaaatgggctaaatgcgcgaattaaaagacacagactggcaaattggataaagagccaagacccattagtgtgctgtattcaggagacccatctcatgtgcagagacacacataggctcaaaataaagggatggagggagatctaccaagcaaattgaa

SEQ ID NO: 1184 - DNA, 1937 bp, Homo sapiens
aatttggaatcaataggcaggagtcattttcaaatcaagaaagatcagaatttggtaacagactggatgagactgataaaggagagcgcccacaatgactctcagggttcccttgaagggacgggggcgggcatactgcggtgctacagaaggtggcagcagcaggtcccagggctccagttacagcagctcagacctgcactcatgccaaggactctcacagaccctttccctgcaatgatttcactgagtgcagactccagcaggtgcgcccacagcgcagctcctgccctcaggacctctcaggcagttgggggcagaggcacctctgtgcaggggcctgtgttcactcttctgcaaatggcgagtggcaggctgggaatgaacctcagggctgtgccttccttaagcctggactgttccactgtatcaacatacctgcctcacacaaacaattctaccagcacgggatcagtaatatttcatacatcagaggtgtgtgagaaactaattttgcctggaagaggggtcagggcaggctacagagaggaaggtgtgcacaggtgaggccttgaggggttgggaggcagggaggggagctgctttctaggcaaagggaacgaggagaagatttccacataaagatctgggccttggcacctcactcctggcagcctgtctgtaattcactctggtcacccctctgtggagcagtgtgcctgcctcagtcatctctgttgatgatttaagcctagcagccttcagccaaatgtggcaactgtgtaagccaatacccagctagctcctggaccactcggatgcccatcaacatgtacgaggctggggttacttctcctgggatcccagaaatcctcagatttgcacgcaatgcaaatgggcattcgggggggcctgtgggtggtcccgattctgttcttgggagcgggagtgaaaagcaagcctgtcgtggggaaactggcaccttcactggtggccacgctgctggggctgggcgtgaagctgcctccggcccttggagaggagtgtgagggaagggaggcggcagtgctttttatacacaggagctggaggagggtgatggcagcttggaggaagtcatcactgccatggtaggggggaaatctggaaatattgggcatgtggccctccccttcccaccgtaaccccaagctcctcagcccacttctttccaccaggcacctttgggcttccctctaggtggaacagccaagtcctgagtctctttgctcagaagctcaagtgattcaatttcttttctccaaactttcccaagactgcaatacctcttggaaaggacgtgaccaaatgtggctgagacacactgggcagagccgcactactcatttatgcaaaaccattactctggccgccgcatcagtctcccttccccttttcagcaatcatgtatcccattagcctgtttgattgccgctgctcacaaaggggcgccttcgctgaaccgtcttcaatggcctctggatctctcccctgagagaagccggctaatttggaatgtggtcgtgtgtatgaatccgacacagcctcagtcacaatcgggtgtccttttctgtagctgctgtttatgatcactttgccttgcctctctgggagccataattcaccacatactggagataggctgggtgttcttttccccgtgaatcctggacaggatgtacacaaatgtgctagccccttcttggtgaccaggctaattcctcagtggcttggtggctgctgcctctcattagagggattccctaagcactatttgcttgacaaattttcaaggtttttaaaagcagaagcctttgctaattttcccaagttggcctaagagtccactgtgaactgcagcagaaattggggaaatttaataaatgttgatcaatgac

SEQ ID NO: 1185 - DNA, 2469 bp, Homo sapiens
agcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaacttgtttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctatgagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaatgttgtatacacgtggatttttttctcattaaataataattctagtaaaaaaaaaaaaag

SEQ ID NO: 1186 - DNA, 2238 bp, Homo sapiens
acacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacagtgcctccggagccagcgtggtggccatagacaacaagatcgaacaggccatggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaat

SEQ ID NO: 1187 - DNA, 2869 bp, Homo sapiens
ttacaaactaaaggtcaacaccaatcatatggtatttgaaaactaagaacaaataaaatagaaaaacagtgacattcagttatatggaaatatagtcaagtcaataatttgaagtggattattaacaataacacagttttctttaccttcctgatgttccaaccctttataagaagtcaaaattgactatgaactatcattaagaacatactaaagaagaagtactggcttttaatgtttaacattttctagcatatttgtttgttttcaagttaacgctgcatatttaaagattataatgggaagccagaacataattctttttcgaactgctaaataataagtatctttttttcccttgttgaaactcaatttctagccaatgattgagtctatttttcactgatctcagcaaccttaagtagaaaatctagtgtgacctaaaagctctaaaacttatcaaaggtggagcccatggaaataaaagaaaaatatattcgcaaaatgcatttcaaaaaagaacacttttttttttttgctgggtgcagtggctcacgcctgtaatcccagcactttgggaggccgaggtgggcggatcacctgaagtcaggagttcgaaactagcctggccaacatcatgaaaccctgtctgtactaaaaatacaaaaattagccgggtgtggtggcaggcttctgtaatcccagctacttgggaggctgaggcaggagaatcgcttgaacccaggaggcggaggttgcagtgagccaagatcatgtcattgcactctagtctgggtgacaagagcaaaaccctgtctcaaaaaaaaaacaaaaacaaaaacaaaacaaaacagaacaaaacgtatttaaccccgtaatgaaaataatggaaattctcagctaattggcactttatgaacactaggaaaaattcacttacgttattttaaaacctatacacttagtgataaaaaggatgtacgagttaattgagagagtctagtgttgtacagagggaaaaagactggtggaaagcacatcagaagaataaggatagaacttttaaagatataaagattttttatgtataaaacccattaaaaatggtaagaaataacagccatttctaaaatgccctttaaccagttaacaatctgtttgcacagccttgtagcttatgtaaatatgcatgctcactttcctgcttggatgtgtcagaagttagggagggataggagccctgggtagaaccatatggattcaaaaacacagggaggggctccattttaatattatggctcagaaatagtcctaggaagctgggaccagctgtgcaaaactggtcatagaacagcagttgcccctaaatgatttgaattctttagtactacagttctaattactcctgaaactagtatggaatttgggagtggtgattttgtcattcttcaaattgcttttcctattctttgatagcatgcagaattgacaacagttttcttctagagaacccaatcttgcaaacattaaataaagacagtaattattctgcattcacaattagtgactttgaggccttagaaagagcacctcatgacaaagatactcgttgaatgtcgtcaactgacttcctgcgtggctgtcggactgattttttcaaattctaagaaagagaatgagagattcagatgattcacctccccaaaagatgtccccagggctttttccacctctccatcttgatttgagatcttcaaaatcacttcaccttcagattattatcccatttctctcactggcactagctccaactctctcaggcaagaaagtttgctcatgtgtcatgattatttggttgggtcacttatttagtggccattttccatttacttcaagtatcagaagcaaaaccaagtcacatggctcttcgagggagtacattttgtgtttgttccctctcttaaatccccatttcaccatcagcatagttcccacttattggtacagtgtggccacaggatttaggtgagcaccattcaacaacagttgcacaggtaccattcaggccaagaacaatggctctgagacagctctgctgattattggctgggcttccttaagcaaatgactaaatctctgtgcttttgtttcctcatttgtaaaatgagaataagaataatacctacctcacagcatttttagaaagattaaatggtttaattgttatgccttccttttagggatgttgtgaagataatgagatggtgtgtgtaaaatatttagtacagtttgaaggaactcaataaatagtaggtatccatatcatgattatgaggtaaagagaaaacatcgccattgttgagagtaggattcaagggtgagtgcagctgctccaacagcacccatggctctggttttattttcagccctgaatctttttttcttttttaattattatttttttaaaaacagagagaaagagagacagggtctcaccatgttgcccaggttggtcttgagatcctggactcgggcgatcctcccacttccgcctcccaaagtgctgggattacaggtatgagccaccatgcctggccccagccctgaatcttgtctacttcctttgcttgcttacttcgtgctgccattgcaggctccccatccaaaaatgtagccctctttaggccagcaactccagagactgttgaattcaggcacagtttgtatgagctatagcgcctcatccctgtattagagtaaatacgcacaaaaacacaaggtacttttctgtcctcttaaaattaataatggcttcatttgtaagacatttgaagttataaacgttctggaataaagttgtcagaaaatc

SEQ ID NO: 1188 - DNA, 3273 bp, Homo sapiens
actggagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggaactaagttcgctggcccggcttcccagcttaaataaacttcgaaaattggagcttagtgataatataatttctggaggcttggaagtcctggcagagaaatgtccaaatcttacctacctcaatctgagtggaaacaaaataaaagatctcagtacagtagaagctctgcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgaggatggcgatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggatgaagaagatgatgatgactatgttgaagaaggggaagaagaggaagaagaggaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagaggtgatccaggaatctttagtttgaaggcagttaccttttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtatttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgcttttgtatggcagtatgtatatattgtgttaagttcctcaagaatctccttaaaaactttgaagttaatacttttgtgcaactgtgttttgaataaagccatgacagtgttaaaaac

SEQ ID NO: 1189 - DNA, 2988 bp, Homo sapiens
acaaccgccaccgcgagctggagaaggaggtccgcgcgggccaggtggacatcgagcagctggatccccgcggccggactcccctgcacctggccaccacgctggggcaccttgagtgtgcccgtgtgctcctggcgcacggcgcagacgtgggcagggagaatcgcaggggctggacagtgctccaggaggctgtgagtacccgggacctggagctggtgcagctggtgcttcggtaccgggactaccagcgggtggtgaagcggctggcgggcatccccgtgctcctggagaagctgcgcaaggcccaggacttctacgtggagatgaaatgggagttcactagctgggtgcccctggtgtccaagatctgccctagtgacacctacaaagtgtggaagagcggccagaacctgagggtagacaccacactcctgggctttgaccacatgacctggcagcgagggaaccgcagctttgtcttcaggggccaagacacaagcgccgtggtcatggagattgaccacgaccgccgggtggtgtacacagagactctggcactggctgggcaggaccgggagctgctgctggctgctgctcagcccactgaggaacaggtgctgagccggcttaccgcgcccgtcgtcaccactcagcttgacaccaagaatatctcctttgagaggaacaagactggcatcctgggctggcgcagtgaaaagacggagatggtgaatgggtatgaagctaaggtgtatggggcatctaacgtggagctcatcacccgcacacggacagaacatctttcagaacagcacaagggcaaggtcaaaggctgtaagacacctttgcagtccttcctgggaatcgctgagcagcacgggggcccccaaaatgggaccctgatcactcagactctgagccaagccaaccccactgccatcactgcagaagaatacttcaaccccaactttgagctgggcaaccgtgatatgggccgccccatggaactgaccaccaagacacagaagttcaaggccaagctgtggctgtgtgaggagcatcccctgtccctgtgtgagcaggtggcccccatcattgacctcatggccgtcagcaatgcgctttttgccaagctccgggacttcatcaccctgcgtctgcctcctggcttcccagttaagattgaaatcccgatcttccacatcctcaacgcccgcatcaccttcgggaacctcaacggctgcgacgaaccggcgccatcggtgcgaggcagccccagcagcgagacgccttccccaggcagcgactcctccagcgtcagcagctccagctccacgacctcctgccgcggctgcgagatctccccagcgttgttcgaggccccgcgcggctacagcatgatgggcggccagcgggaggcggcgacccgggacgacgacgacgacctgctgcaattcgccatccagcagagcctgcttgaggcgggcagtgagtatgaccaggtcaccatctgggaggcgctaaccaacagcaagccaggcacccaccccatgtcctacgagggtcgccgacaggacaggagcgccccgcccacgccgcagcgccagcctgcgcccccggcgtcagtgcccagccctcggcccagctcagggccaggttccggcggccacgtgttccggagctacgacgagcagctgcggctggcgatggaactgtcggcgcaggagcaggaggagaggcggcggcgcgcgcgccaggaggaggaggagctggagcgcatcctgaggctctcactgaccgagcagtagcgccccctgccgggaccctcgccagcgccacgcgcgccacgcccagggccaggagccagacaaaccccggcctgcgcgcctgcagagcggcggctggagactggagccaccgcctcgcgggtgcagcagcacagcaggcacggttcggggagggattcggcatggccgcggggtaccttcccaggccagggccctggaggcaactggcacggcctggtccccctgctttgctgtattctgattccccaacccgctcccctgggctcagatctgtcctgtcctagggcggagccaggcggtcctgagggggagatgaatccttagaggagcgctgtccctatcccttgctccttctggccggtccgcatttctgtccactaaccccactccaggacactgcccctgaagcctttgcatctctgctcttcactcctggggggcagctgagctccccgcgtgctgtgtcactgctttgttccagacacaaaccagcacgtctagggcccagcccctcccccaccccggcatttcagcgtcaagtgcacttagcggggtacccggctcccccagcccccacacccgtcctgggtctcagggtggttccagcttctccttgggcagccagaagttggtgtcccatcccccaaggcacattttttttttttttttttgtgatcagggagtgtgtccaacgtagccccctggcctgtgcaagccctgactccctcatggtgcctcggagagtggggagcatattgggctggggtaagcactagacccaagtagactggacacaaagggctcgcccagggccctggcgccacccccaccccttcccaccagctgctgctagcctctgtggttgtacatcccacttgcccccacacggagactgactctaaaacccttcatccaatggtgctaacccccggctctcccctgccccacctcacccacccagagaagcacagaccccgccaggggcaggggcccaccgcacacccttgtcccgggcctgtctgggactggccttcccggctcagccagtgaggctcagaagggacacaaagagggatggaagaaaagaacaaagagaaactgttcctcccacccccttccctgatgccaggggcaccagactgattctgaggcacaaataaaagaggcttcataccgg

SEQ ID NO: 1190 - DNA, 2891 bp, Homo sapiens
aaactttacccggcctaacagctgaggcgctttacggcgacggcggctgagtgagaaccttggcggctgtggaggctgccgcggctgcgaaggaggcggcggcggtggcggaggaagaggagtggcggcagcggcggcggggacccgtgcggggatggcggaggtaccgcctgggcctagcagcctcctcccaccaccagcacctccggccccggcggcggtcgagccccgctgtcccttcccggcgggggccgccctcgcctgctgcagcgaggacgaggaggacgacgaagagcacgaaggcggcggcagcaggagcccggcgggcggagagtcggcgacggtggcggccaaggggcatccgtgcctccgctgccctcagccgccgcaggagcagcagcagctcaacggattgattagccccgaactgcggcacctccgggcggccgcctccctcaagagcaaggtcccgagcgtagcagaggtggccgcgaccacagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattctatccacaactggccacagctgtgcttcttggccatggtaggggaggagtgtgtaggtgccatcgtttgcaagttggatatgcacaaaaagatgttccgcagaggttatatagccatgttagccgtggattccaaatacaggagaaatggcattggtactaacttggttaagaaagctatatatgccatggttgagggagactgtgatgaggttgttttggaaaccgaaataacaaataagtccgctttgaaactttatgaaaatcttggttttgttcgagataagaggctgttcagatactatttaaatggagttgatgcactgcgacttaaactgtggctgcgttgagaaactgacatcaaggaacaactatcatccgcacagaatcgacctttgcatgcaatgcaatttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccttaaaaaagccaatgtggattgtaaaagtctttaagtatactaacatttcacacaaaacctgccctagttttctgaagtgggtgagggagacgcttcagttttaggttttattttttcaatattaaattttccattcttgaatattggtacctcagtgattagtgaatgaaaaaaatgtagagtgggtatgtcttacaatgagtaaaggtaacaattaaattttgtctgccagtgcctgtgtagataagtatatttgtcttcatctctagtttttgaatgcatgctatcttttccttttctttaaggcctttgcaagcaaacttttgtttttatttaaattctaaatttgataaattatttcagatttttataatttggatacttttttcaggtgaatgaaagaatggtttactttagaagtccctttttccttacagtaacaagttgaatctacttggaaaattgagaaatggctcaaaagagataagaaaagttgatggagccgggaattgctggggtttagatgcactttttcttttgagagtaagggaagttttggaaaagaatagaaaattagtgtaagttgatatgattttatttaatcaaaattactgctatgctgcgaagaacagcttttacaaagtagctgaatttgtttttcccacttgatttggattcacattgctttcatttcttaaaatgcttcacttcaggttcttggtcttggaaataaatttcaaggtgcattgtatccattttaagctgctttattttattttcacttgtatgagcaaattcttgggggagctttgcttttcttctgccagaaaaacaaaagggggaaatgaaaatcttttttggaatgagttctgtgggttttcttaacagccaccatgtttattagttacattgtgttttggccaatcagtgcaatgtaacaaattttacagttaattgctttcaattgagtcagtaaacctgtgatagataatttatttaactggaaaacctaggtacccataagaaaaaagattcattctctgtgaaaactgtaggaatctgttgttgttttcatttgaatatgctctacttctgctctagtatttggtttggaatatattttgtggctctaattactgtatttttaaaaaccctacctccattaacagttggtaaaggccccttttcaggaaagtttgttgcttttttttttttttaaaggaaagctgctctttgctcagtatagtgttttgaaagtgaacatagtaacaaatactttaaaaataaagatacacaatttatatttg

SEQ ID NO: 1191 - DNA, 2654 bp, Homo sapiens
agatgtcggagagcagtttggtgaacaacagaggaatctctccaggtgattgtacctgtaaaggagaaaatggagaaaaagacaacattctatcaaggaagcagatgacagagcctgagcctggggggcttgtccctccagggggaaaaaccttcattgtggtcatctgtgacggaaaaaatcctggccgctgcaaggagctccttttgctttgtttttccgatttcctaattgggcgataccttgaagtaaatgttatcagtggggaggagtcactaattgctgcgcgcgaaccattttcttggaaaaagcttaaaagttcacaagcgttaacatccgcaaaaactacagttgttgtgaccgcacagaaaaggaactcaagacgacaacttccaagttttcttccccaatatccaatcccagatagacttagaaaatgtgtggaacaaaaaattgacatcctgactttccagccattacttgcagagcttctgaacatgtcaaattacaaggagaagttttcgactttgctgtggcttgaggagatttatgcagaaatggaactgaaagagtataacatgagcgggatcatcttaagaaggaatggggatctgctggttctggaggtcccagggttggccgaagggaggccttctctctacgcaggtgataaactgattttaaaaactcaagagtacaatggacatgccatcgaatacatcatctacgtgactgagattcatgaagaagatgtaactcttaaaattaatccagaatttgaacaagcctataactttgaacctatggatgtggaatttacatataataggaccacaagcagacggtgtcactttgcacttgaacacatcatccacttaggtgtaaaagtgttgtttccagaagaaattattttacagtctccacaagtgacgggaaattggaaccatgcacaagacaccaaaagcagtggacagtccaccagcaaaaagaataggaaaacaatgacggaccaagctgagcatggaacagaggagaggcgtgttggtgacaaggacctgccggtgctggcaccctttactgcagagatgagcgattgggtagatgaaattcagacccctaaagcaagaaagatggagtttttcaacccagtgctaaatgaaaatcagaagttagcagttaaaaggattctgagtggtgactgccgtcccctcccgtatattctctttggacctcctggtactggaaagacagtgacaataatagaggctgttttacaggtacactttgccttgccggacagtcggattttagtctgtgcgccctccaacagtgctgctgacctcgtgtgtctgcggctgcacgagagcaaggtgctacggccggccaccatggtccgggtgaacgccacctgcaggttcgaggagatagttattgacgccgtcaaaccgtattgcagagacggagaagacatctggaaagcctcacgcttccggataatcatcaccacctgcagcagctcagggctgttttaccaaataggagtgagagttgggcacttcactcacgtgtttgtggacgaggctgggcaggcaagtgagccggaatgcctcattcctctggggctgatgtcggacatcagtggccagatcgtgctggcaggagaccccatgcagctcggcccagtcattaagtccagactcgccatggcctatgggctgaacgtgtcctttttggaacggctgatgtctcgacccgcgtaccagagggacgaaaatgctttcggtgcttgtggcgcacataatcccctgttggtcacaaagctggtgaagaactaccggtcccacgaggccctgctgatgctgccctcacggctgttctaccacagggaactcgaggtctgtgcggaccccacagtggtgacctccttgctgggctgggagaagttgcctaagaaaggcttccctctcatcttccatggtgtgcggggcagcgaggcacgggagggaaaaagcccatcgtggttcaacccggccgaggccgtccaggtcctgcgctactgctgcctcctggcccacagcatctccagtcaggtgtctgccagcgacattggcgtcatcacgccctaccggaagcaggtggagaaaatcagaattcttttgcgtaatgttgatctgatggatataaaggttggatcagtagaggagtttcaaggacaagagtatctggtcatcatcatttcgaccgacccctgttttggtgctttgctggaatacagtattacaaacggtgtttacatgggatgcgatttacctcctgcactgcagtctctgcaaaactgtggcgagggggtggcagacccctcctacccagtggtgccagaatccacaggaccagagaagcatcaggagcccagctgatctgcagtggctgacagcagggaggccatgtgctcagcctggccacgttgccgttacagtctgctccgtggctcctgtggcctgcccttgtctcgcagccaggcagggtcgtgtgtgggtgtggggctgccaggttggacgcagctgctgctgccctgactttggcatatgccagcctgttcctgccacagggcagtcactgccgcctaccctgaaataaaccctcgagtgaccccc

SEQ ID NO: 1192 - DNA, 2476 bp, Homo sapiens
agaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaatagtatgtttagttccaatcgtcagaaaattttggaaagaacggaaatcttaaaccaagaatggaaacagcgaaggatacagcctgtgcacatcctgacttctgtgagctcattgcgcgggactagggaggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccacgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttg

SEQ ID NO: 1193 - DNA, 1584 bp, Homo sapiens
aagcggtttcaaacggcttagagcaggccgcttggttctgacccagctgaggaaatactcttaattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaacttcccaagacttttatgacaaaattgaggcaaaaaaatggcaagagagaaaagaggccctggagtctgtagaagtactaataaaaaaccccaaacatcatctcttgaagcttcacttcaacttcactacttctgtagtctcatcttgagtaaaagagaacccagccaactatgaagttccttgtctttgccttcatcttggctctcatggtttccatgattggagctgattcatctgaagagaaatttttgcgtagaattggaagattcggttatgggtatggcccttatcagccagttccagaacaaccactatacccacaaccataccaaccacaataccaacaatataccttttaatatcatcagtaactgcaggacatgattattgaggcttgattggcaaatacgacttctacatccatattctcatctttcataccatatcacactactaccactttttgaagaatcatcaaagagcaatgcaaatgaaaaacactataatttactgtatactctttgtttcaggatacttgccttttcaattgtcacttgatgatataattgcaatttaaactgttaagctgtgttcagtactgtttctgaataatagaaatcacttctctaaaagcaataaatttcaagcacgtttttac

SEQ ID NO: 1194 - DNA, 1936 bp, Homo sapiens
cttctctggttccctgacctcagtgagacagcagccggcctggggacctgggggagacacggaggaccccctggctggagctgacccacagagtagggaatcatggctggagaattggatagcagagtaatgtttgacctctggaaacactcattctcaatgcaagatcctccgctgcaatgctgagtacgtatcgtccactctgagccttagaggtgggggttcatcaggagcacttcgaggaggaggaggaggccggggtggaggggtgggctctggcggcctctgtcgagccctccgctcctatgcgctctgcactcggcgcaccgcccgcacctgccgcggggacctcgccttccattcggcggtacatggcatcgaagacctgatgatccagcacaactgctcccgccagggccctacagcccctcccccgccccggggccccgcccttccaggcgcgggctccggcctccctgccccggacccttgtgactatgaaggccggttttcccggctgcatggtcgtcccccggggttcttgcattgcgcttccttcggggacccccatgtgcgcagcttccaccatcactttcacacatgccgtgtccaaggagcttggcctctactggataatgacttcctctttgtccaagccaccagctcccccatggcgttgggggccaacgctaccgccacccggaagctcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcgaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagaaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacacc

SEQ ID NO: 1195 - DNA, 1320 bp, Homo sapiens
acatctcctttcctcctctgctccggaaaagcacagtggagacttcatgcaacaatattcccaaaaagaagcctcgaactctcagaattctcaggctaaaatcataacaggaaaaaccggtgtgttgccacctcccacattgcccaaacccaaacttcccaagcatataaaagataataagaacgatttttcccccaaagttgaactggcaacctccctgtcagatatggaatgtaaaattactacctcaaaggatcaggaaaaagtaatggtgatgaccagcagtgaacacacggagacaaagcagaacgttattagtaagagtcttgatgaaagaaaacaattatctattgactccgcaaactgtctctcacacacagttccaggaacttcagcacccaggaaaaaacagattgcgcctcttataaaatctcattcatttccagagagttcaggacaacaaaatccaaaaccttatatgagaaaatttaagacacctttaatgattgctgaagaaaaatatagacaacaaaaagaagaaattgaaaaacagaaacaggagagttcttactacaacattgttaaaactcaaagccaaaatcaacacataacagaggtggaaaaggaaatgccattacaaaaaaccaatgaggaggtttccctatctggaattgattcagaatgcactgtggttcaacccagcccaggctctcaaagtaatgctcggatactaggagtgtgttctgataaccaactctccacaacatcgccagaaacagtcgctgccaagaggctccaccatgttttagcagcttcagaagacaaagataagatgaaaaaggaagttttacaaagctcaagggacattatgcaatccaaatcagcttgcgaaattaaacaaagtcaccaagaatgtagtacccaacaaacacaacagaagaagtatttggagcagttgcacttgccccaaagcaaaccaatttccccaaatttcaaagttaaaaccatcaaacttccaactctagatcatacattaaatgaaacagaccacagctatgaaagtcataaacagcaatctgagattgatgttcaaacctttaccaaaaaacaatatctgaaaaccaagaaaactgaagcaagcactgaatgtagtcataagcaatctctggctgaaagacattatcagttacctaagaaggagaaaagagtgacagtacaattgcctacagaatccatacagaagaaccaggaagataagctcaagatggttcccaggaagcaaagagaatttagcggatctgacagagggaaacttccagg

SEQ ID NO: 1196 - DNA, 1736 bp, Homo sapiens
gaccagctgcaaagactcagacactcagccagagacagcagcccctgccactgccccaccattaccccccatagagtccccaccagcaccatgccgggggtaccagggcctgggcctgagctggccgcagcccttgaggagcagttgggccgggcactggaggagctgcgggcggtggctgaagcaggccgggtggcagtgacccaggcagccgaggtagctgtagccaccgtggagccggtggcccgggcagctgaagaactgcgggcagagagagcagcactgagccggcggctggatgcactgagcaggcaggtggaggtgctgagcctacggctgggggtcccacttgtgtccggccttgagcctgagctggagcccagcgagctgctcctggctgccgccgaccccgaggccctctttcaggctgccgaggatgccgggacccccgtggcccacccacctgccttcagcacccgccgccgctcctccaccggcaccacccgcagcactagtctcatggaaccagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatgctggatcagagcacggactttgaagagcggaagctcatccgggctgcacttcgtgagctccgacaaaggaagagagatggcagtggcagcaccatgatgcaaaccaagaccttctcctcttcctcctcatccaagaagatgggcagcatcttcgaccgcgaggaccaggccagcccacgggccggcagcctggcggcgctcgagaaacggcaggccgagaagaagaaagagctgatgaaggcgcagagtctgcccaagacctcagcctcccaggcgcgcaaggccatgattgagaagctggagaaggagggcgcggccggcagccctggcggaccccgcgcagccgtgcagcgatccaccagcttcggggtccccaacgccaacagcatcaagcagatgctgctggactggtgtcgagccaagactcgcggctacgagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagacccatgcggactgcccgcagctcctggatacagaggacatggtgcggcttcgagagcctgactggaagtgcgtgtacacgtacatccaggaattctaccgctgtctggtccagaaggggctggtaaaagccaaaaagtcctaacccctgctcggggccccacggatgctggtggactgtgtgcccctggtggaggtggacgacatgatgatcatgggcaagaagcctgaccccaagtgtgtcttcacctatgtgcagtcgctctacaaccgcctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctccccccccacatacacacgcagcgttttgataaattattggttttcaacg

SEQ ID NO: 1197 - DNA, 1281 bp, Homo sapiens
cactcaggcagcagccccttctttcttgccccagtctccagttctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaagggacagaggatgagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctagaaaagacaattgatgacctggaagatgagctctatgcccagaaactgaagtacaaggccattagcgaggagctggaccacgccctcaatgacatgacctctatataattatcaccgtttctgctctgttctggatctgccccctttactcctcggggaacccaaggccccactctcgctctggattccatttgggtcagcctggctggtccccaaggcattaggatgggggagcaaaaagcaacttatgtattttcttccacccccaccccaaattaaaatgttaagctgctggaagcctcatgccaccctgcatttgtgtcattgacaaagctgttgctgtccctaagaaggagccttgggggtgtgatgtggggaagagctattgtaggctccccctcctctgacttatgtaatcaaagccacttttgtgtgtgtctattttttcttgacatttaaactcagctgatctgattctaccagagtgatggatttagtacaggttactcaggatagtaattttagttatactcctcaagctgaacaagattaaattccttatttccaggttctt

SEQ ID NO: 1198 - DNA, 1390 bp, Homo sapiens
agcagccggcctggggacctgggggagacacggaggaccccctggctggagctgacccacagagtagggaatcatggctggagaattggatagcagagtaatgtttgacctctggaaacactcattctcaatgcaagatcctccgctgcaatgctgactcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacaccatc

SEQ ID NO: 1199 - DNA, 1322 bp, Homo sapiens
acacactcattttagccagtgtccaggctatcagcagagaaagacaggtgggcagcatggctccgggcgaaaaggaaagtggggagggcccagccaagagcgccctccggaagatacgcacagccaccctggtcatcagcttggcccgaggttggcagcagtgggcgaatgagaacagcatcaggcaggcccaggagcctacaggctggctgccgggagggacccaggactcacctcaagctcctaaaccaatcacaccccctacttcacaccagaaagctcagagtgccccaaagtcgccaccccgcctgccagaaggacatggagatggacaaagctcagagaaagcccctgaggtttctcacatcaaaaagaaagaggtgtccaaaacggtggtcagcaagacttacgagagaggaggggacgtgagccacctcagccacaggtacgagagggatgctggtgtgcttgaacctgggcagccagagaatgacattgacagaatcctccacagccacggctccccaacgcggaggagaaaatgtgccaacctggtgtctgagctaaccaagggctggagagtgatggagcaggaggagcccacatggaggagtgacagcgtagacacagaggacagcggctatggaggagaggctgaggagaggcccgagcaggatggagtgcaggtggctgtggtcaggatcaagcgccccttgccctcccaggtaaacagatttacagagaaactcaactgcaaagcccaacagaaatatagcccagtgggcaacttgaaagggagatggcagcagtgggctgatgaacacatacaatcccagaagctcaatcctttcagtgaagagtttgattacgagctggccatgtccacccgcctacacaaaggagatgagggctatggccgccccaaagaaggaaccaaaactgctgaaagggccaagcgtgctgaggagcacatctacagggaaatgatggacatgtgcttcattatctgcacaatggctcgccacagacgagatggcaagatccaggttacttttggagatctctttgacagatacgttcgtatttcagataaagtagtgggcattctcatgcgtgccaggaaacatggactggtagactttgaaggagagatgctatggcaaggccgagatgaccatgttgtgattacgctactcaagtgaaccttcaaaaacaaaagccaaatttggcccactatggtcttaatgctaaatgctcatgtaggtaaaatgaaaatgcaaactctctgtaataagttagtaaatattaaacaatttttacat

SEQ ID NO: 1200 - DNA, 1160 bp, Homo sapiens
ctctaccggcgggatttgatggcgtgatgtctcacagaaagtcctccgctcccagacatgggtccctcggcttcctgcctcggaagcgcagcagcaggcatcgtgggaaggtgaagagcttccctaaggatgacccatccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcccgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgaaaaaaaaaaaaag

SEQ ID NO: 1201 - DNA, 1168 bp, Homo sapiens
tttttattctttttagatgattatcccggggctcctctgagaaaagtaggagtagattgctggaattaccatgggttaaaatgaaagaggatgacctggctggacaaaggcgtatggactcaggaagacgagaactcctgctccttctctgaatcggattttcctggctgtagagaccagatcaacccttccattccatcgatttggaccgcagtttcgggaatgatgatttcgctggaagtgcggtggcggataaaggggaagcagggttacgtaatttcactgggtcacgctctgtcacctaggctggagtgcagtggaacattctcagctcactgcatcctcggcctcccagggggctcaagctatcctcccgcctcagtctcccaagtagttgggaccacagctttgtatctggtggaggaggcttgggccgaagctggtaaaatgagaagttaggggaggatgtcctcagagagctggaagatcacagtcctcattgtcacaaccgatacagtgttgatagggacaacatatgccttggaatgtttcaaatactttgccacaattaagggacactgaacaggaactcagttttggaaaacaaagtggaatttctggaaactgctagcataaaagctttgacagggtcacatgcagattagcataattttattacattttctattttagtcctgtgagatactaatttggatttcattgtgcccattgagcggcttttgttctttggctgtgagtttaattatttagttatttatgagtgcatctgggcataagtgccacagttttatttcggtgacaaatttatggtcagtgaattttagtaattaatgaataaattatttctcctccataaatgcccctgcaatttctgattttcataacaattcattatacttaagaaaaattctttattagttgaaaaagccaatgctaatggaatcaggaaaaggagatttcaaattgctttaattaactgtattaattaatatccaatatgtgtaagatattgaattggctttggttgtctctcttagcatttagttgcctaaaatctgtttaacatatgaatatactgtgttaaaataaattctaattcttttgtgaagtaaatggcaagaataaaaggatctcctttataatcttt

SEQ ID NO: 1202 - DNA, 822 bp, Homo sapiens
tgaaactttccctttgatgtctccgcttgaagacttaagtctgccgccttcaacagataaatcagagaaagcagaaattaagccagagattccaacaacctcaacatctgtatctgaatatctcattttggcacagaagcagaaaactcaagcatatttagagcctgagtctgaagacttgattccttcacatttaaccagtgaagtggagaagggagaaagggaggcaagttcatcagtagctgcaatacctgctgctttacctgcacaatcatctatagtaaaggaagaaaccaaacctgcatctccacattcagttttacctgattcagtccctgcaatcaagaaagaacaggaacccacagcagcactcactctaaaagctgcagatgaacagatggctttgtcaaaagtcagaaaggaagaaattgtgcctgattctcaagaagctacagcacatgtatcacaggatcaaaaaatggagcctcagcctccaaatgttccagagtctgagatgaaatattcagttttgcctgacatggtagatgagccaaagaagggtgtcaagcccaaattagttctaaatgtgacttctgaactagaacagagaaagttgtccaagaatgagcctgaagtaataaaaccatattcacctctaaaggaaacatctttatctggacctgaggctttatcagcagtgaaaatggagatgaaacatgattccaaaataacaactacacctatagtgcttcattcagcttcctcaggagtggaaaagcaagttgaacatggtccacctgcactagcattttcagctttgtc

SEQ ID NO: 1203 - DNA, 1183 bp, Homo sapiens
agaacagacagacctactgacacaggggaggctctgtgagtaccacacagtggggagggggtgggggccaccatgtcatcatatcagaaggaactggagaaatacagagacatagatgaagatgagatcctaaggaccttgagccccgaggagctagagcagctggactgcgaactacaggagatggatcctgagctggactaagacaacgtgaccagacaaagaagagcccaacggggccactggaccgagaggcccttttgcagtacttggagcaacaggcactagaagtcaaagagcgtgatgacttggtgcccttcacaggcgagaagaaggggaaaccctatattcagcccaagagggaaatcccagcagaggagcagatcaccctggagcctgagctggaggaggcactggcacatgccacagatgctgaaatgtgtgacattgcagcaattctggacatgtacacactgatgagtaacaagcaatactatgatgccctctgcagtggagaaatctgcaacactgaaggcattagcagtgtggtacagcctgacaagtataagccagtgccggatgaacccccaaatcccacaaacattgaggagatactaaagagggtccgaagcaatgacaaggagctggaggaggtgaacttgaataatatacaggacatcccaatacccatgctaagtgagctgtgtgaggcaatgaaggcaaatacctatgtgcggagcttcagtctggtagccacgaggagtggtgaccccattgccaattggctgacatgttgcgtgagaatcgtagcctccagagcctaaacatcgaatccaacttcattagcagcacaggactcatggctgtgctgaaggcagttcgggaaaatgccacactcactgagctccgtgtagacaatcagcgccagtggcctggtgatgcagtggagatggagatggccaccgtgctagagcagtgtccctctattgtccgctttggctaccactttacacagcaggggccacgagctcgggcagcccaggccatgacccgaaacaatgaactacgtcgccagcaaaagaagagataacactgcatttccctttaccaactagcgctgggagcactggacacttaaatcctcatctgtcctcctttcctgtaaataaaagcccttctatcc

SEQ ID NO: 1204 - DNA, 1349 bp, Homo sapiens
agtcggtgacatggcggaggccgcggcgctggtgtggattcgcggccctggcttcgggtgcaaggcggtgcggtgtgcctcgggtcggtgcaccgtccgggattttatccaccggcactgccaagatcagaatgttccagtggaaaacttctttgtgaaatgcaatggagcactcattaacaccagtgacacagtgcagcatggagctgtttatagtttggaacccagactttgcggtggaaaaggaggttttggatctatgctccgagcacttggtgctcagattgagaagacaaccaatcgagaagcttgtagaacccaagcactgcttcaccagccccgactaccagcagcagtgccatgagatggctgagcgtctggaggattccgtcctcaaaggtatgcaggctgcctccagcaagatggtttcagcagaaatcagtgagaatcggaaacggcaatggcctactaaatctcaaacagacagaggagccagtgcgggaaagaggagatgcttctggttgggcatggagggactagagactgcagaagggtccaactctgatagttcagatgatgacagtgaagaagcaccaagcacttcaggaatgggtttccatgctccaaaaattggtagcaatggtgtcgagatggcagccaaatttcccagtggttctcagagggcgagagtagtgaatacagaccatggatcaccagaacaactgcagatcccggtgactgactctgggaggcatattttagaagactcatgtgctgagctgggggagtccaaagagcacatggaaagcaggatggttacagaaacagaagagacccaggagaagaaggcagagagtaaagaacccatagaagaggagcccactggggctggactgaataaggataaagagacagaagaaaggactgatggggaaagagttgctgaggtagcacctgaagaaagggaaaacgttgccgttgccaaactgcaggaaagccagccaggaaacgcagttattgataaggaaactatagatttattggcgttcacctctgttgcagaactggagttgctgggtttggagaagctcaaatgtgaactgatggcccttggactgaaatgtgggggcactctgcaggagcgggcagcaagactcttctctgtcagaggactggcaaaggagcaaattgacccggctttatttgccaagcctttgaaagggaagaaaaaatgagtatcatcagagctgattcctatttgtttatagtgtctaccatttacaacctgcataatgtggactcttgaccagtattcctgttgatattaaaagctaactttttagtaaccc

SEQ ID NO: 1205 - DNA, 1282 bp, Homo sapiens
accctgcggtccgcggcccggggaatctgaagcgtggctcgggagccccgggggacatggcctccttcttggctgtcgtcggggcgcccgggggagtcaactcctgtgtctttgaccgtttccattacagtgtcaagatgggagatcggagtgtctataatgaaaacacaagtgtggtggtctcagtccaaagagcttttgtccaccctaagttctcaacagttacaaccattcgaaatgaccttgcccttctccagctccaacatcctgtgaattttacctcaaacatccagcctatctgcatccctcaggagaatttccaggtggaagggagattctgggggccgcttggcctgtgaatataatgacacatgggtccaggtagggattgtgagctggggcatcggctgtggtcgctgagggttgcctggagtttatacagaaattggtgtctacagtaagtggctgattgcagtggtggatcaggctacctgtttgtatccagcagtgttcctcatcttagtcctgcatttggtgctgcccctgggcatcctggtggcccagtgatcaccccagcccactccccttttgtttctgagtctcatactaggcctctcctccaacctcccactccttctcaatgccgtttctgaaaatcccagttggaatccacgggccctctggagatccatacaatagagcacagcagggagactggggcctggaaagtgcccctgcctggtgctctggtcacctgcctcagccatgcctgcaccagggctgtgctctggctagtgggaaggaggggatgaactaattccagctagaggaccagcctccctgccaggtgggccacagtgactcatcagtatctgggggaacatctatcaaagaagagacatcatcaacagtgaagcaagtgttagatgtggttctggtttcagggctcccacctaagactttgtgaaaccagccagctgggtgattgctcagcgtgaaggaggcgttaccaggtccctgcagaggtgtgaggcctgggacttccactctaggctcagttgtctggggctgggagaagttcccctgcagcccagtgtggatccatctgtgagtggacagcctctgccacactaactctcttggggctacccattcttggcacccccttcctcagtgccctagtggccactttcagagacactacaagttgtattgaggcagttatggagtgcagagttttcagaaatcaactaaataaatgtttggagagtctcctatgttc

SEQ ID NO: 1206 - DNA, 2893 bp, Homo sapiens
aagtaggaaatcgaccgaccaggcggtgcgcttcggacccagccagggcatgtgctcggaggcccgcctggctcgcaggttgcgggatgcgctgcgggaggaggagccgtgtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgttcgatctgtcgaggcactgacgccgctgcatgtggccgccgcctggggctgccgccgcggcctggagctgctgctgagccaaggagcggacccggcgctgcgcgaccaggacggactccggccgctggacctggccctgcagcagggacacctggagtgcgcgcgagtcctgcaggatctcgacacgcggaccaggacccggacccggatcggggcagagactcaggagcccgagcctgcacctggcaccccaggcctctctggacctaccgatgagacgctggactccatagcactccaaaagcagccatgcagaggtgacaacagggacattggcttggaggctgacccaggaccccccagcctccctgttccccttgaaactgtggacaaacatgggagctcggcgtcccctccagggcactgggattacagctcagacgcctctttcgtcacagcggttgaggtctctggagctgaggacccagcctcggacactcccccctgggctgggtcattgccaccgaccaggcagggacttctgcatgttgtccatgccaaccagagggtacctaggtctcagggcacggaggcagaactgaatgcccgtctgcaggccctgactctgaccccaccaaatgctgctggcttccagtcctccccttcctccatgcctctcctggacaggagtccagctcatagccccccacggacaccaccccctggagcttctgactgccactgcctgtgggagcaccagacatccattgatagtgacatggccacgctctggctgacagaggatgaggcaagctctacaggtggcagggaacctgtcggcccttgccggcacctgccagtctccactgtgtctgacttggagttgctgaagggactccgagcacttggcccagagttttcagggcacagcctagaactggctgcagccctgcggacgggctgtattccagatgtccaggcagatgaagacgcgctggcccagcagtttgagcggccagatcctgccaggaggtggcgggggggggtcgtgaagtctagcttcacgtatctgctgctggaccccagggagactcaggacctgccagcccgagccttctcactgaccccagctgagcgccttcagactttcatccgtgccatcttctacgtgggcaaagggacgagggcccggccatatgtccacctctgggaggcccttggtcaccatgggcggtcaagaaaacagccccaccaggcctgccccaaggtgcgtcagatcttggacatctgggccagtggttgcggcgttgtgtccctacattgcttccagcacgtggtcgctgtggaggcttatacacgggaggcgtgtattgtggaagccctagggatccagacgctcaccaaccagaagcaagggcactgctatggagtggtggcaggttggccacctgctcgtcgccggcgcttgggggtgcacctgctgcaccgtgccctccttgtcttcctggctgaaggcgagcgacagcttcatccccaggacatccaggcccggggctgagtgctggggagttggccatccagcctggggagaaatgtttgaatgttccagctgccccatgctgacagcagcccccatctctggtttcagaaggggtgtgtgtgtgtgtgtgtgtgtgtgtttgtgtgtgtgtgtgtgtgtgtgtgtagggagcacccaggcagatctcccccaggctgagagaggactttgttacagatggtactgctggagaggtagtaagtagtgagctccccatcgtgggaggaggacaagaagggaagcagaaggtgctttggaacagtccggtgcttctgtaagaggcgtttgaacctgggcaactccccctggaataggagctgggtaaaatgaggctgaaacctactgggctgcattcccagatggttaaagcattctaagtcacgggatcaggtaggaggtcagcacaagataacgggtcataaagaacctgctgataaaacaggttgcagtaaagaagccggccaaaacccaccaataccaagatggcgacaagagtgacctctggtcgtcctcattgctacactcccaccagcgccatgacagtttacaaatgccatggctggccaggcgcggtggctcacgcctgtaatcctagcattttgggaggccaaggagggcagatcacctaaggtcaggagttcaagaccagcgtggccaacgtggcgaaaccctatctctactaaaaataacaaaattagctgggcatggtggcgcgtgcctgtaatcccagctactaggggggctgaggcaggaggatcgcttgaacccgggaggtggaggttgcagtgagctgagattgtaccattgcactccagcctgggcaacagagcgagagtctgtctcaaacaaacaaacaaaaaaacaaatgccacgtcaacatcaggacgttaacctttagaccctatatggtctaaaaaggggaggcatgaataatccaccccttgtttagcatatcatcaagaaataaccataaaaatgggcaaccagcagccctgccctgtctatggagtagccattcttttattcctttagtttcttaataaatttgctttcactgt

SEQ ID NO: 1207 - DNA, 2538 bp, Homo sapiens
cccgagcctctctccctggccaggccccaggtctcgcagccagggatggagatggggggagggggaacctagagttctttgtagtgcctccctcagactctaacacactcagcctggccccctcctcctattgcaaccccctcccccgctcctcccggccaggccagctcagtcttcccagcccccattccacgtggaccagccagggcgggggtagggaaagaggacaggaagagggggagccagttctgggaggcggggggaaggaggttggtggcgactccctcgctcgccctcactgccggcggtcccaactccaggcaccatgttccccgcgggcccccccagccacagcctcctccggctccccctgctgcagttgctgctactggtggtgcaggccgtggggagggggctgggccgcgccagcccggccgggggccccctggaagatgtggtcatcgagaggtaccacatccccagggcctgtccccgggaagtgcagatgggggattttgtgcgctaccactacaacggcacttttgaagatggcaagaagtttgattcaagctatgatcgcaacaccttggtggccatcgtggtgggtgtggggcgcctcatcactggcatggaccgaggcctcatgggcatgtgtgtcaacgagcggcgacgcctcattgtgcctccccacctgggctatgggagcatcggcctggcggggctcattccaccggatgccaccctctacttcgatgtggttctgctggatgtgtggaacaaggaagacaccgtgcaggtgagcacattgctgcgcccgccccactgcccccgcatggtccaggacggcgacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagcccctattcctctatgtgacagctggctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaacc

SEQ ID NO: 1208 - DNA, 2590 bp, Homo sapiens
cttctcctcgatgtccacgagcttggtgatgaagtccttcagctgcgccacgccctggcgcacggtgggctgcagcggctccatccaagcctccttggccctggaagccggcgtgtccatgttgcccacgttctggactgcctggaggtgacagcaggaaggaccaggttctgctaggtttaactgacgctgctgcactggataccccaccccggtgccgggcacataggtgcagcctgagagtaagcagacctgggttggaaggtcccgcgattcaccaccgacaggatgggcggccttggcaacccccgacccctcgcaggcctgttcccttatccatgagatggaactcggacaaggtggccacaggaaggctttgcaaactgtgaagtgcagtgcctacgtgggcgtgccagtggcctcgccggagccggtagggaacactctgcagtccaggccagggccccggtaggacacccagctgtgcatcccgcccgtggccgcaaggcccgcaccttggccaacaggagcagggtgcggctggtgcgggcgtccgcgtggcgctcccgcaggtggaagagcttgggcgacatgatggcgggagagaagaagcgcaggcacaggaagctggtgacggcgatgaacggtacattctggaggggtgcggaagagcgcgggctggagtcccccagaccagggctcctggcagccccctccccttaggctccgtccctgaccctcgccgggacacagcctccctggtcctccccagcgctccctggttccccaccgctcttcgcccgcccctcgccccagcccagtccaacccggcccagcctagcccagcgggtggagggcgcacctcgtgctgggcgccggggaagcgctcgcgcacgcgccggaagaggtggcggaaggtggcgcgcaccacggcggggcacgcgggaaccgagcggctgagcgcgctcagcagggcccccaggtgggcgcgcagcgtctgcgcgctctgctccagcacctcggcctcggtctgcgggcggtgcagcccggaacacctgcgtggaacggggcgggttggcagaggaggtcacggtcagcgccagggccacgacaggaacagtggctctcacagcagccgggacacggacacaggggacaatacacgggtgggcagaagcacaaacacacatgctgacagggcctgatcccaacccgctgccgctgcgccccgcacccccccggagttacccccggcctcaccctacatccttaacttccactttgctggggtccagctccacgtacttctcctcaaacaccttgttgatgatggggcccaggacgccgtgcaggtactgcatcccggccacctggggaccaccgcaggtcacattgatcctgtctcccccagtcccactccagctgcccaccttctcccggcagccgcccttgcatcgtttgcctgccgtatccgcccaggagggggacaggtacacaagcagggcaaactgtttattcatgaatgaatgaatgagtgagtgaatgaatgactagaattcttagcccttgtaatcctagcactttgggaggccgaggcaggaggatcacttgaggccaggagtttgagaccagcctgggcaacatagtgagactgtctctaacttaaattttaatcacacacacattcttttggggggggggggcgcggggcacggagtctagcacggggcccaggctagagtgcagtggcgtgagctcactacaatctctggcttctggttcaagtgagtctcctgcctcagcctccccagtagctgggatcacaggtgcccaccaccatgccaggctaatttttgtatttttagtagagatggggtttcgccatgttggccaggctggtctcgaactcctgaccttaagtgatccgcccgcctcagcctcccaaagtgctggaattacaggcatgagccactatgcccagccacattcttaaccttaaagggctctcaatatggagatagaacactggagtcgaagtcccagccccctctgtcgctctctctgaagctcagtgttgtcatttgcaagatgaggacaatatagcatgcaacctcaccttcagaaaagactccatggactttgaggccagagagttgctccggaacagggtgttggtcttttgttacttggtcataagtaggcgttttccttttgatttggttctaggaggttagtgtgcattggcgttctgttgcctgcttccagcccctattctcctgcctcaggttcattagaaaagactgagtttggggccgggcagggtggctcacacctgtaatcccagtactttgggaggccaaggtgggcagatcacgaggtcaagagatcgagaccatcctggccaacatggtgaaaccctatctctactaaaaatacaaaaattatctgggcatggtggcacgtgcctgtagtcccagctactcaggaggctgaggcaggagaattacttgaacttgggaggcagaggtttcagtgagccgagttcgtggtcactgcactccagcctggctacagagtgagattccatctc

SEQ ID NO: 1209 - DNA, 2048 bp, Homo sapiens
acagcggtggtgacggtgctgggagaccccgcgtgcgctttccccttgagatgtaaaccgggaacggggaaggggctgaggggagaaaggacatggccttccccgcgagtccatggccagtgactgtggcccgactcgaaaacaaccctcttctcaaaagggaccatcaccgccccgagcgtgcgcacacagaccggtcggaggcgagaactggtctctacagggcacagttcagctcctctgtggatgcgtccccagatcgcaggatttccaagaaatcgagcctgtcccttgtgcacttgggaataattccccaagacagcacttcgggattccgggttatcctgaggctgcccgggacttttccagctctccagccccaggtctcctgacattgtgttccaggctgcgggctaagccagacagtgtttgcctccggttctttccaccgtgggaagcgaacgccacccccgcccgcctttgcctgcgagtctccctcgctggcagaagggaagccggcccggtcccgggaggaagatggcgctgcgaattcgaattttagagttggatctttgtctcatggatgctcttaggagacccaccaaccaccaactccttgtattgcaactggaccccctcgacctgggtgaatgtactcttttcagcaaccatatcctccctcctgttgccaggtaaggtgagaagcaattcctctgcctagaagctctgccgggtgaaatatcaggagatcccacccaagctttctcttgcgtgtagcctatatccagcacgggagcataggctaatcctgcagttggccagcctcttgtcctctggatatcctgggatggaatcctaatgaaggaaactccagtggtttactgaagccctttgtgctaggcctgaggtgagatagaattgctccatcctatgcccaggaggcctgcgtggactcacagtgcaccaccatcctcagaaatcctctctccctgtaggctgtggtctgaatctttgtgtcttcccaaaattcatatgttgaaatcctaacgccccaggtgatgatattagaagatggggcctttcaggagttgactaaaacttcagggaaaagccctcacaaatgggattagttcccttataaaataggtccaaggaaacttgctcacttctaacaccatgtgaggacacagtgagaaggcaccatctataagccagaaagcagtccctcaccagacatagatctgctggcaccttgatcttggacttctcaccctccagaactgggagaaataagtgtatattgtttataagctacacagtttatgatattatagcagcccaaacagacattgtatttcctcaatgttggtttaagagttgtctaaaccagtttcttgttatcatactgtggatgtttctagctctcactgtagcattccacctcttttctgtctcagtgacttagtcaaagcatctagttgaacactctgttatttaaagaaaccagcattcactggctgttcccagctccaggaactcaggtggattcataatttgttctgtttccttgctcttaggaaaagtactgacagctcataattggttgtatttcttaggatatttgcatttaaactagaagcaatgctttcttttcttggtataatttgtcttacatttttgaaagtaatagctattcattaaattacatttgaaaatgcaggaagaaagaaaaaattgtctataattctactactcatataaaaccactattcacatatgtgtactttcctctattaacctttcaaagcatgcctcaattttaattgtattcacacaaatacaattttatgccatacattttacttattaatatgctattagcatcaccaatgtcaatataaactccttgtaaacatcaatttaatggttgcaaagtattacatcaactggatatgccatggcttatttaatcactgtatttattgttaaatatttgcattgtttacactgtttagtattgaaaaccacgctgcaataaatatctttgg

SEQ ID NO: 1210 - DNA, 1898 bp, Homo sapiens
gtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaacagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaac

SEQ ID NO: 1211 - DNA, 2646 bp, Homo sapiens
cttggcaagtcgtcttataaaccaccaataatagcctcttaaaaattcaaaaattactcctcttggctaacaaaataaatgcaaattaatttaataattgttgaagaaattaaatgttttaaaattaaaaaattgcaatgttgaaattctcaaccatgcttatccagaccttttcctatactactaactgccctgggcttatcttaaatacttctcagaagatttacttgttttacaccaggataggcaaagtatggcccacagtgtatttttggactgtctgcaagcacagttgctataatttttaaaaggctgaaaactttaaatttttgtaaatatgctcattaactgtttattaggcttcattaattttaaaatatacagagactatcctattcaactatatttgtatcctatttctaattctcctaacaattatatacactggcaaaaactcttcagatgatatataaggaaaaggtcaaatatactaccgaattcatccagctttccaaagatgctcaaaatctttctgtgtctctcactccctcccttaacccacataccacatctgaaaaaaaatgatatggtgtaacgatgccagtattctaaatgcttgaagggcttatcacatgccctttccaagctgtgacagaagcatgtcccttggaccccggcatcctgtcaatctcacctctgaaggtgacccagtctcatacttcactgaaacaaagaccattagacgccagcactcccgacttcttttatctccactttaacatttctccatatagtaatcctcacttttctactccctgtcatctcagaaaaggaattctctctcctcttttccacagttagcttctcaaatttgtgcctttaattctacccctcccaaatattccaagacttgctccactaattatttcctctcttggaatcttaatctcatcctcttcccttgatccctcccctcagcctttaaaactcctagaccttaaaacactctctgtgatctgacagcccttcaaaccaatatactccccacctctctcccctggttcagtggcaagatctttggccaactgctttctactcggaccttgctattatttgctactaggcacccacaaaccgttgcttgttaaactgatctccttcaagacttaagaaaagcgccatgcggctccctcccagggctctcctgccttctcctcaccgatgccaagagtggtcctgctggagaactgccgcgcctgcagttcgtgcaccttttcccgaagctgcgccaggaaattatggacgaactggaaggggccgagaagaagggtcttggcccccaattgtagctccaagcctttttgtgctttcagatttcggatcctccgcgtggagcaccttggggcgccccttggcaggttcccgccgcatagggccgacttttccacctctggctccagggcgggaagattgtagcggctttgagcttactacttgttttcttataatccctggcggagctgggtcaatttcaggcacagcccagctcagtcaggcgaggtccagaaaggcctgacttgcctggcagcctcaacggacttgtccccgcagcccttgcggacctcctggtcgtcatggcgactgtgaaatgtggggtggggagcatgcgttcgaagccatttgcgcgggcagtccctgcgtgtccccccacgtgctccccagcactcgcaggacccccgcctccgagcttccctgagcgtgcagcttccagtgagggcagccccacgcacagccccccacaccctccccaacgccttcagcccccggtgcgcgtagtccccaagcccacacgtgcactctccaccttgcggcagctgcacgtacagccccccacacgctcccagccccactggcgcagaacccatcaccgctcgcccttcacgcgcttcactgggagtgcagcccccaccccgagcgcgcagctccacgcagcctctccacactctccccagcgcctgcagcacccccagtgcgcacagctctgccagtcgcttccccgcgtgccgcccctgcaccacttcgggccataaccttgctggcgactaagtctgaagaacttcccgtgatttaattcttttcttcgagtttagtcttagctttgacattttaaccaaaaggttacacgttaatttatggtatgaggtcaccacttctcctattgtccttctcagtttctccccaacctctcctattccctattttataagacaggagaagagggagaaagcaaaaagttagaaagaaacagtagtaagataaatagctggaggaccttggcaccaccacctggccctggtggctaaaataataataatattattaacccctgaccaaaactattggtgttatgtgtaaattccagacactgtatgagaaagtactgtaaaactttttgttctgttagctgatgtatgtagcccccagtcacgtttttcacgcttacttgatctattatgactttttcacgtagaccccttagagttgtaagcccttaaaaggcctaggaatttctttttcggggagctccgctcttaagacacgagtctgccgacgctcccggccgaataaaaaacctcttccttcttt

SEQ ID NO: 1212 - DNA, 1884 bp, Homo sapiens
gatgcgcgccgctgccgctgcgtgggggtgaggggagcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcggcatttgcccccagcacagcgaacgcttcctgagagctctaaccaaagacaaacttttggaagccaaacactcaggaccaagactatgtatcgatttgagtatgacccactacatgtcaaagaaggaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattctgcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcaaaaaaaaaataaataaaaaaaaatgcagctgcaggagtgaggcgcttggaggtaccttgacccaaagagcagggcagagggtggcagtggcacataggcaagtgtctttgcatgacatcttctcagagcttcacaataatgtcagggaccacatttaatgctttttaatctcccatagtgcctggctcacaggaagtgctcagatatgttaagtaataaaaagttaatgtggtgggtgcagtggctcacgcctgtaatcccagcactttgggaggctgaggtgagtggattacaaggtcaggagttccagaccagcctggctaatatggtggaacctcgtctctactaaaaatacaaaaattagctgggcatggtggtgcgtgcctgtagtctcagctactcaggaggctgaggcaggagaatcgcctgaacccgggcggcggaggttgtagtgagccaagatccagcctgggcgacagagccagactcttgtcttgaggggaaaaaaaaaaaaattatgtaacaaggaattagcctcaaaaccacatggctttggacgtgctaattcaacttttgtacatctatttgtgagagacctcttgaaattgtttaaatggttacatcaagagtttaatattcactaaactggcatcataaaattgtatgactttctcc

SEQ ID NO: 1213 - DNA, 2257 bp, Homo sapiens
acgtgcggccgcctggtggtggtggaggacctgcactctggcgcccagtagcactggtccggccactctgcggagatctccacgctggccctcagccacagtgcccaggtgcccgcctgcatcgccctcctcctctcccagggccaccgtgcccggcagaacccagctcccggaccggtgcgggttctcaccaccaaagacggagcagacggccaccccagcctccactccagccagccacggcctccccactcacgcctggcctcttgcctgccaggtcctggcctctgcctcgggccgaagcagcacgaccgcccattgtcagatccgcgtctgggacgtgtctggcggcctctgccagcatctcattttcccccatagcaccaccgtgctggccctggccttctcaccagatgacaggcttcttgtcacactgggggaccacgatggccgcaccctcgccctgtggggcacggccacctatgacctcgtgtcctccacccgcctcccggagccggtgcatggtgtggccttcaacccctgggacgccggcgagctcacctgtgtgggccagggcactgtcaccttctggctccttcagcagcgtggggcagacatcagccttcaggtgcgtcgagagccagtcccagaggcagtgggggctggagagctgacctcgctctgctacggggcacctcccctgctctattgtggcaccagctctggccaggtctgtgtctgggacacgcgtgccggccgctgcttcttgtcctgggaggcggatgacggtggcattgggctgttgctgttctcgggttctcgattggtcagcggcagcagcacggggcggctgcgcctgtgggccgtgggggctgtgtcggagctgaggtgcaagggctcaggcgccaggtccagttctgtgttcatggaacacgagctggtgctggacggggctgtggtgagtgccagcttcgatgacagcgtggacatgggcgtcgtgggcaccacggcgggcacgctgtggtttgtcagctgggccgagggcaccagcacacgtctcatcagtggccacaggagcaaggtgaacgaggtggtcttcagccccggggagtcccactgcgccacatgcagtgaggatgggagtgtgcgggtgtgggccttggccagcatggagcttgtgatccagttccaggtgctgaaccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggagactcagggccacctgccaccctccctcgctgccttctgcccttgggatggggcgctcctgatgtacgtgggccccggtgtttacaaggaggtgatcatctacaacctctgccagaagcaggtggtggagaagataccactgcccttttttgccatgtccctgagcctgtcccccgggacccacctcctggctgttggctttgctgagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgc

SEQ ID NO: 1214 - DNA, 1991 bp, Homo sapiens
gctgtttgtcctcgcgcggcccccgtccactgccctgcggttgctctgcgggctgaaaagtttctcccggtgcagaattccgggctcagcgacagcctgcgccgagtgtgcgcacctgtcggagacccgccagtccgccggccccggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctggagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaagacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtctttcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcagc

SEQ ID NO: 1215 - DNA, 1649 bp, Homo sapiens
ggtgcccgcgaaccaacggttagcggtggcaggggctgactgagagcgtctgcttgataatggattctgaattaatgcatagtatagtaggaagctatcataaacctccagaaagagtatttgttctctcattcacccagaatgagccatctcagaattgccatcctgcaaacttagaagttacctctcctaagatacttcatagcccagatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaagagagatataagtatacagttaagctcagcccagtctcgttgtactcttctagagaagcaactagaatatacaaagagaatggttctcaacgtagagtgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctattccaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtaagaaggctttagtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgttaccttaatgaactttgtcagtgagaccttgaattgtctaaagtggttttaatttaatataactttgtgacattttgaatcatgtttctagtttccataaaacatgaagttgcagtatttaaaaattaatgcctaatgacctggtgggttccaaataataaattaattgctttttt

SEQ ID NO: 1216 - DNA, 2103 bp, Homo sapiens
tagtgtggcgggtctctcaggaacgcatattttcttttcggattctccgagaaggggtggagaaacaggatgggaaccggattggttgcagtgtggcacagacctggaaccttcctgaaagaggttggggcaggcagtgactgttcagacgtccaatctctttgggacgcctcttcagcgctgtcttccctgcctctgcctttaggacgagtctcaaacaccaacaaacgcaaggcacgtcccccctctcaggtcagctgcgaaggcgtgggagcaagagagagcctctccctccttctacttagagtttttgtttgtttgtttgtttgtttgtttcaaatattaatggacgataaaacaacacggatttgtcacctcctagcgaagaggaagccaccgccaccacacccctcaagcatgcctgggcactcctggggacaatcggacgtggcaggagttggcatgcccaagatgaagctgggaaggatgacccagagtggaaggcgtgggctggggctccaggtctcagctctcgccagcgtcggaccacacagctttgccagctttgcaccttgcctttccttcttgtgaggcatctgggaccgtcctatcaaggcgcttcaaaggtggaaggacagagtgctggggacaagaacgtaccaggcgcccagaagattccactagcgcggccaaacactaagaccaggtttcctccctgcgtggtggtcgttggttgtgcacgggctacgcacgaagactgaattcctgagaaatggaaactgcaggagaaaaatcaaataaacttagaggcctgtgaagctctccctcttgtcgctctgggaccgctctaagctgagctacatctcagataccttctccccctggaggatgggcctttctcaggcacgaagtgcgtgtgccccactgggctcttgcccacaagagcagtctgaaccctggagaggctgacaccgaggtgtcttgaaggaagcaggcacactctcatgcttccccacctagggtttcgcctttcttctaatatttaggattcccagtgaagggtactccacacacaccctctgcctacccctaatcccaccccattgtgtctgatcccacaattactcccagggtatctatactcacagcttttgcgctcaaagaacattgtcgtctgcagggaacgggtggagcccttctcagaagctcccgggggcgagtccattttaagaatgagttgaagtaggaaagaaaacacagatgctgtctttgcattcgacattctatcaccagcaagagaatatgtaactcctgttctttccttcattattccatgaattaccttttttctctagggatctaccagttggtgatttagggcttttaaatattatgcttgttatgtatttaacaaaatgcaatatgtctactggtggcattgtttccttgggaaattagaaaagtagaagctacatactctagttcctaggtggtctctggaaagttggcctcatgctggttggctaaataataagtgtttaggatttgaaaggaagaaagagagctgaagtcctggtgacagagtttgtgagaaacagaagatgtaacactctggcatttgttgaggagatgaggaagaacttttgaaaaataagctattctattcagttttgtgcaaatttattgcagttgcttcatagaggaagaataatgttgagaatggaataattgcaaatgctagtgatgaaatctaaaggaaacctctactcatagttaactgaaagtatttttgttgttgttgtttaaatacttatctcattgctttctttcctttgcagaattattttcctataatagtttccattaggtgtcagtctgaactggttcttacttaagttaggggtgaaaatgttccatcatcacaccttttaagataagaaagtgggaaaaattaaaactttattaagttgaaattactggagttaatttttattgttaaagacagcttttttattcccagaaaaagtaattttaaattatgtcaccactagtcaatgactgcttttgccctgtcactgtccatagccatgattaaagaagtac

SEQ ID NO: 1217 - DNA, 2087 bp, Homo sapiens
ctcttctcttgaagcagatgcgaaggctccccgaatgagaaagaatactcggaatcagcggtgaattgcagtgatctttcagagaaagcgcctgttcaactttgtcctctctcagagactcagagccttggggcactgagggatgccagttctgcctgttcatctggaacctggatctaaggagggaagaggcgttgcccctgctggcatagtcaggtaccagcccagccaggtattgaacgggctgagcttttcatgatggttcctgctgacctggaaacatcttaaatggaaggttagcttatatgagtcactgatactctttttattgctatttctaaatttccttggcttgaaaattacttctgctttgcagaaattatctgcttgcagctgtggataatttataacaatctctggtgaaacctcagaaaagagatatgtttttgtcttagatggatgtcagcagctgctgcagaacccggtgaaaacagcccccgggtagcacgaggctctgcgagccgtaactccgacaaacgcagaacttcttgaggctttcttcttctaaggagtatgacacagttaaaaaggaaaaaagaaccacaagcaaaacagttgccagtgaaataggagagggagctctttaaacaaggctggctgcagctggcctccgccgctcatctgcagggcgtgagcgcttggtccatgcagtgaagctcttccaacctgggtcaacgaaaacggagaagaaatggcccaagaaatagatctgagtgctctcaaggagttagaacgcgaggccattctccaggtcctgtaccgagaccaggcggttcaaaacacagaggaggagaggacacggaaactgaaaacacacctgcagcatctccggtggaaaggagcgaagaacacggactgggagcacaaagagaagtgctgtgcgcgctgccagcaggtgctggggttcctgctgcaccggggcgccgtgtgccggggctgcagccaccgcgtgtgtgcccagtgccgagtgttcctgagggggacccatgcctggaagtgcacggtgtgcttcgaggacagggatgtcaaaataaaaactggagaatggttctatgaggaacgagccaagaaatttccaactggaggcaaacatgagacagttggagggcagctcttgcaatcttatcagaagctgagcaaaatttctgtggttcctcctactccacctcctgtcagcgagagccagtgcagccgcagtcctggcaggttacaggaatttggtcagtttagaggatttaataagtccgtggaaaatttgtttctgtctcttgctacccacgtgaaaaagctctccaaatcccagaatgatatgacttctgagaagcatcttctcgccacgggccccaggcagtgtgtgggacagacagagagacggagccagtctgacactgcggtcaacgtcaccaccaggaaggtcagtgcaccagatattctgaaacctctcaatcaagaggatcccaaatgctctactaaccctattttgaagcaacagaatctcccatccagtccggcacccagtaccatattctctggaggttttagacacgggagtttaattagcattgacagcacctgtacagagatgggcaattttgacaatgctaatgtcactggagaaatagaatttgccattcattattgcttcaaaacccattctttagaaatatgcatcaaggcctgtaagaaccttgcctatggagaagaaaagaagaaaaagtgcaatccgtatgtgaagacctacctgttgcccgacagatcctcccaaaggcctcaaggttccaggttgcagcaggcgtgaggcactgtgcgtctgcagaggggctacgaaccaggtgcagggtcccagctggagacccctttgaccttgagcagtctccatctgcggccctgtcccatggcttaaccgcctattggtatctgtgtatatttacgttaaacacaattatgttacctaagcctctggtgggttatctcctctttgagatgtagaaaatggccagattttaataaacgttgttacccatgtc

SEQ ID NO: 1218 - DNA, 1817 bp, Homo sapiens
gatgtcatcctgagcagctgggcggcgggtgccggtgcgcacggagccgagccggggctcccgttgcgctgcaccgcgttgggtcggagtcccaggacttcagcggagatccgcgcgctgcgacggccggtgcagagcccgccgagcgcccagtcccggcccggggctgagttgggggcatgctctagccgcccccccggagcccgggagagaacccaggagcgccgccgcccagccccagcgccccgagcggaaccgctgcgaaggggccctgaacggccgtcgccctccctacgggcagcccccgggggttggcgaccgaagtctaggttttcgagaaagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatgatctcagtgaatatcttccggactctgccgcccagtgagaaccctgaatttgaccctgaagaggatgagcccaatcttgagccttcgtggccacacctgcagctggtatatgagtttttcctgcgtttcttggagagcccagacttccagccctccgtggccaagagatatgtggatcaaaagtttgtcctgatgctcctggagctatttgatagtgaggatccccgggagcgtgagtacctcaagaccatcctgcaccgggtctatggcaagttcctgggtctccgggcctacatccgcaaacagtgcaaccacatcttcctccggttcatctatgaattcgagcacttcaatggtgtggctgagctgctggagatcctaggaagcatcatcaatggctttgcgctgcccctgaagacggagcacaagcagttcctggttcgcgtcctgatccccctgcactctgtcaagtcgctgtctgtcttccatgcccagctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattc

SEQ ID NO: 1219 - DNA, 2723 bp, Homo sapiens
agaacagattcatgggtgatttagcctatctgtcccaggccagcgtggctgagtgtgctggctggaggcctctctctctgcttcgagggtagctgagatccaccccggaaaccggcaggatgaagggggcaagtgaggagaagctggcatctgtgtccaacctggtcactgtgtttgagaatagcaggaccccagaagcagcacccagaggccagaggctagaggacgtgcatcaccgccctgagtgcaggcctcccgagtccccaggaccacgggagaagacgaatgtcggggaggccgtggggtctgagcccaggacagtcagcaggaggtacctgaactccctgaagaacaagctgtccagcgaagcctggaggaaatcttgccagcctgtgaccctctcaggatcggggacgcaggagccagagaagaagatcgtccaggagctgctggagacagagcaggcctatgtggcgcgcctccacctgctagaccaggtgtttttccaggagctgctgaagacagcccgcagcagcaaggccttcccagaggatgtggtcagggtcatcttctccaacatctcctccatctatcagttccattctcagttcttcctcccagagctgcagcggcgcctggacgactggacagctaacccccgcatcggtgacgtgatccagaagctggcccccttcctgaagatgtacagtgagtatgtcaagaactttgagcgagcggctgagctgctggccacctggaccgacaagtctccactcttccaggaggttctcactcgcatccaggtgaggctgggggagggctggagtcagcattgccactcccagcatgcagtggctcaggttgccttgagtgattccgggcatctcccaggctcagctgcttccataggcccctgcctactcgtccggccctcaggagcagcctgacccacctcccttctctcaccctctccgtgttgctcccccatccctccccaagagcagcgaggcttcgggcagcctgaccctgcagcaccacatgctggaaccagtgcagagaattccacgttacgagctgctgctcaaggagtacatccagaagctgccagcccaggccccagaccaggccgatgcccagagacctcctgccccagccaccagccctagattctcagggaataaactccggccctgcccctttcagaagccctggacatgatcttctcagctgcccagcactccaatgcagccatcactgagatggagcggctgcaggacctgtgggaggtgtaccagcgcctgggcctcgaggacgacatagtagacccctctaacaccctgctccgtgagggcccggtcctcaagatctccttccgccgcaacgaccccatggagcgctaccttttcttgttcaacaacatgctgctctactgtgtgcccagggtgatccaggtgggcgcccagttccaggtgaggacccgcatcgatgtggccgggatgaaggtgcgggagctgatggatgctgagtttccccactccttcctggtgtctgggaagcagcgcaccctggagctgcaagcccggtcccaggaggaaatgatttcctggatgcaggccttccaagcagccattgaccaaatcgagaagcggaatgaaaccttcaaggctgcggcccaggggcctgagggagacatccaggagcaggagctgcagtctgaggagctgggcctccgggcaccgcagtgggtccgggacaagatggtgaccatgtgcatgcgctgccaggagcccttcaacgctctgacgcgccgtcgccaccactgccgggcctgcggctatgtggtgtgtgccaggtgctccgactaccgggccgaactgaaatacgacgacaacaggcccaaccgagtctgcctccactgctacgcattcctcactggaaatgtgctgcctgaggccaaggaggacaagaggcggggcatcctggagaaagggtcctcagccacgcctgaccagagcctgatgtgcaacttcctgcagctcatcggggacaagtggggcaagagcggcccccggggctggtgtgtgatccctcgggatgaccccctcgtgctctatgtctatgctgcccctcaggacatgagggctcacacctccatccccctgctgggctaccaggtgactgttgggccccagggggaccctcgggtcttccagctacagcagtcaggccagctctacaccttcaaggccgagacggaggagctgaagggccgctgggtgaaggccatggagcgggcggccagtggctggagccccagctggcccaacgatggggacctgtccgactgagccactgccagccgctctcctgcccacctctccccaccctgaacccagctcctgccacagactgaccctgtggcctcagtgacccactgccccaagtggtgctttcagagaattgattcagccatctgcgcccaggccacgtgtcccgatctgggattagaaaatatgggtccattcctttctagaaaggggacaaccaagtgtctcagtttgccttgcggggagggggctcctgggccatgggacttccagtgctaaaactgggaaagccccaggtaaccccggactggtggtcaccatagtatggtttttcatttgtatctcctggggagcttttaaagagtactggtgaaaaacacatagtaaattaatttt

SEQ ID NO: 1220 - DNA, 2335 bp, Homo sapiens
atgtgaccacagtggacctgaaaaggaaacccgcagacctgcagaacctggctcccggaacaaaccctcctttcatgacttttgatggtgaagtcaagacggatgtgaataagatcgaggagttcttagaggagaaattagctcccccgaggtatcccaagctggggacccaacatcccgaatctaattccgcaggaaatgacgtgtttgccaaattctcagcgtttataaaaaacacgaagaaggatgcaaatgagattcatgaaaagaacctgctgaaggccctgaggaagctggataattacttaaatagccctctgcctgatgaaatagatgcctacagcaccgaggatgtcactgtttctggaaggaagtttctggatggggacgagctgacgctggctgactgcaacctcttacccaagctccatattattaagattgtggccaagaagtacagagattttgaatttccttctgaaatgactggcatctggagatacttgaataatgcttatgctagagatgagttcacaaatacgtgtccagctgatcaagagattgaacacgcatattcagatgttgcaaaaagaatgaaatgaagctgggctgttttctgtcttatttctcagttgagtgagcaaggatacgaaaacagtgtgtttgaaaacaaattaggtttgggttcaattccttcaatttttaaaaaactggtctctgagagttttttaaatcattgagagcctgtttttcttctctaaaacattagtttaattttcttcaaaatgaaaatactgctttgtaattacaaaatgagacacacctatcttgatattttaaagcaatatcagagggtgtaaagaaggacattttaacaatcgccttcaattttactccacttaattaccgaaaacttactggagaacatgttccaaatcttcagtatcttgttctctctctctctctctctctctctctctctctatcacacacacacacacacacacacacacaatttcattcatatatggtattgcattattttattttaaagcactggtgaggggacctcttggtgattcctggatgatcatacacagaggacttacaccatacaaaaatattgggcaccgcagtgccagagaagatgcttgaggttagattttaaggagtggggaattgtgaagcccgcagatgcgcacgcaatgaccagcaggaaccggaagccctgggtcacccccactctgcctcatttctgcctccaggatgccactgcctctgcttccaggaaaggcaagggggagggtgcttatccgtgtctctggttccagcttcctgtctttgctccctcccctctcttagagactgtgccttcagcaggactcttaatatctgctgcaacttggagaacctccctgccctgaaatgtgaaccaagcacactttggttccttctccgggcggctctctctgagacccaaggctgcagtccctcagtgctggtggtatcgtgtggggatagcaatacttctctgcccttcattgtctcatctagacatcaagcagggaaaatccagggagattaaattcatggtgacaagtcctgggcagttctggtaaacggtccagttagggagggagtagaaactattgactcaaaagagtttctggctgatctgtggctttgcctccaccatccctaaccaacctctcatcacagctttgtgtgtgggctgagtgctggccttaaccctaggcgtggaagagaaaatgtgaggttgtttagatactcatcaggacctcacaggagctgagacttatcagccagaatgtgttcttcggacagtcgtacacatcttacagaaaaccctccttgtagagttggttgtggtatgtgtttgatgctataaagctcatttttaatgtgtacacctgctctagggacgattcgtttgaaagagagtaagatgcattaacagaaactatcctgggattaggtgaaaaatgtctagcaaaagaaacaaagtctttaatagagtggcctctttcgctcttcgattatgactgctgcagttttaccccagcagtcagctgtctttgtcaaccatacgtttttggagattgggtctagcacatgtcacccttgtccacgttgtttcacatctggttagggggcagattttaaaatgtagttttgtaatgttacatttaagcatgataaatgattagactaccagatgttactagtgctaactttgtattcttagacattaaaatgattgacataaactctttgtgccttgaaaatgaaacaaattataaaaatgtttaaatgg

SEQ ID NO: 1221 - DNA, 2077 bp, Homo sapiens
gtcgtcgggctcgttgccggtgcaaacagggaggaaacagccggcgttgctgtagcgcgtctgggaattacaccgggggactggccggcccgcttcgtgcctgcgggaagtcgggccgggggactcttcggaaactccgagcctcagagaaatatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaacagcaagaagccaccgcagagcaagagaacaaacggtatgaaaatgaatatgaaagggcccgaagggaggcgctagaaaggatgaaagctgaagaggagaggaggcagctggaggacaagctccaggccgaggcactgctgcaacagatggaggagctgaagctgaaggaggtggaggcgaccaaactaaagaaggagcaggagaatctgttgaagcagcggtgggagctagagaggctggaggaagagcgaaagcagatggaagccttccggcagaaggcagagctggggcgtttcttgagacatcagtataacgctcaactcagcagacgcacacagcagatccaagaggagctggaggcagacaggcggatcctgcaggccctcctcgagaaggaggacgagagccagcgcctccacctggccaggcgggagcaggtcatggccgatgtggtctggatgaagcaggccattgaggagcagctgcagctggagcgggcgcgggaggcagagctgcagatgctgctgagggaggaggccaaggagatgtgggaaaagagagaggcagagtgggcccgagagcgcagcgcacgggacagactgatgagcgaggttctgacagggagacaacagcaaatacaagagaagattgagcagaaccgacgggcacaagaggaatccctgaaacacagggagcaacttattcgaaatcttgaggaggtgagagagttggctcgtcgcgagaaagaggagagtgaaaagctgaaatcggccaggaagcaggagctggaagcccaggttgcagagcgccggctgcaggcatgggaagcagaccagcaggaggaggaggaagaggaggaggcccggcgggtcgagcagctctcagatgccctgctgcagcaggaggcggagactatggctgagcagggctaccggcctaagccttacggacatccaaaaattgcttggaactgacttcatgggtaccataagtacagagaacaagggatgctgaggcttctgatcccagccgccaggcagttttacagggctctgttaacaaaatctgaagagttctgcgtctgaatttgaaattggactttataaagcctagaaaacagaggaggcggtgccctgcccttgtcagttgttgttctctttggtggtgatggtaaccagctgcttggcagccttggcgatgtcgtacgcacactggatgacctgctgcgtgaccagctgaacgtctgtggtggtttccaaatctgtgtcttcgtctgatgccacgctgtcatagtcgggctgatcgttgtcttgactctcaacgctgtgctggttattgatggttttcagtatgagctccacattgtctatcaataaaagcaaacaactttacttcaggctt

SEQ ID NO: 1222 - DNA, 2004 bp, Homo sapiens
tttctgctccctctgcctggatgctctctctgggcaacctgcatggctcattctcatgcttcattccagtcaccagtcactgccttcaggaagtcttccctgattgcactcccactcaatcccctcaccctgctgtatttttccctagagaggaagatacacacagacacacttttccttatggatctgattgtgatctgtctcccctttagaacatcagtttcatggaggcggagtttgtgtttcatccctgatgtctagagataaagggcttgccactcagtaggtgctcaggagtccacctgctccgccacttaatatccccttcaacaagctggccaagtggtgtgggggaaggaatgcgttttggagtcaggggacccatctggccacgtgtgcgtaaccgtatgagcacagagccagtgcttccgctggagctcagtgctgctgttatcaccagtgacagctgccaagggaaagagagtcctcatttgtgtccccaaagccaagtgtgagggttacctctcctgccagccctccctgggagcagaagtgggaccaggaagctggcctcagctgtgtctgagcggcagggcctcacccggccactcccaccataccgcctgctgcgggtctagcctcaaccctgctgtgtggagttggctggaggctggtctctctcagctgatgaggggctctgcggagggcggagcctagagcctgtttctccaggcgcaacgttgagggggggtcccctcggggtgatggagatcatctgggtgtatggaactgtgtgtggttggccttactgggtggtcttccttcactgtctgcgggacagatggaggggcacagctgcccatggacccaggctctggggcttctggaaggtgccgaggagggcaggtgcgatgcctgggggcgttcagcaaatgcctggccctgccccctgtgccaacttggcctgggaggctcaggcacagctgtttcaagggtcctttatttcattcctggttcatttcaaagtgtctgtgtcttgttcggagcagcttgagggtagagcctgttgacaaagacgccttcaggcagccaccacggagtgtgcgggacaccatcctcagcagagccctcatcctgaagatcctcatgtccgcggccatcatcatcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggg

SEQ ID NO: 1223 - DNA, 3206 bp, Homo sapiens
agtctgctgcaccttctgtgctgtgcgtggtccatgccccaaggctggaggtgcaaaggggacaggtcccggaggctctggaagggcagagaagccaggcgtggaagggtagggagagccctcggggcctctggcctctcccacagagagagcatgaaggaaggcctgggcgtgagaacagatgtgggggacacagaggcggaggccacgtggcaggaggggaaacaggctggtggaacagggtgtacggggcctggggagggatttggatctcattctttgtggggtgtggggagtgatcctggctactctgggcaccacagaggcaggagccagtacaggccatcacgtgagggcaggcagcccagtcaccgtcctcttgctccaggccatcatgtgagagcaggtggcccagtcaccgtcctcctgctccaggccatcacgtgagggcaggtggcccagtcaccgtcctcctgctccaggccctgcagccggcagcacccctccgcagcccaccacacgcagcaccaggaggctgtgaatctccccactctgtaggaacagctgccgcttcctgggtccccattccccaacggaacgtgttccatgacatctgtgcagcatccgctgtgtgccaggcacagttctaggccccggagacaaagcgggaacagcacagacaggaacctccactcttacagtgaggagagaaagaggagtgaggcttggggaggttgggcaggacagctgcagggagagggagggcagaggacgggcgagtcggggagtaccaaggaaggcctcagcaaagcagcatggaaataagacctgaaagcacggaagggccctccgggaggcgggtatgcaggcgcagaggccctggggccgagagctgtgtgtggagaccagcgtgaggggctggggcagctgggcccaaagacagattcacagacgccttccatggccgctgcggtagtcatgccctgcggcgtagcctcctcccaaggctggagcccttccccggagctggtcgtggccaggagctcccaccggggcagggcgctaaggcccggcactccgcctggctgctgtggggctgctgccggggcgggtgctgacgctgtctgtgcccctgcccgtctcccaccaggttccaggtaaatacacggtcgtggcggaccacgagaagggaggccccgatgcgctgcgcgtgaggagcggggacgtggtggagctggtgcaggagggcgacgagggcctctggtaagaccccgcgctcagccccggactgccccgcacgtggctgccgctgaccctcgccccttgcaggtacgtcagggacccgaccactggcaaggagggctgggtgccggccagcagcctgtccgtccggctcggcccgtccggctcggcccagtgcctgagcagctcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgccccgacccagagcgcctggccgtgcgggctgcagaggacccctccggggcagaggcaggttccacggaaaaccccggcccgctggggcttccccggagactccagagcccacagaggaggggccgcagggaacagccccgggcggcaggcgccgggcagcggcatctcgtcctggctccaccgtgctgcttctgcctccggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttggcggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagttgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatgggtgacgtttgaataaatatcagcaactcct

SEQ ID NO: 1224 - DNA, 2844 bp, Homo sapiens
taccgggggtgagtggagccgggccggagggagctgcggctggagggagggacgcctggcttcccggggcggctggtgggggctcggtcacccataggggctgggaggaggatcggcgcgtcttccgggttgctgcctttcccgggggtctgccccgctgacattctgtgcccgcctctcgccctgtctccccgtgcccatcgcaactgtcaggccctgcgggctcccgccgctgtcactcgcgcacaggttaccccgtggctccctttctcttcacttgctcatgccccagctcatgggaaacctgttttctgacctcacttcccctgctccagttctgccttgctcggattctctgaaatctgaccctttccaggggcactgtgacaagaagaagggaagaagcaaccttacccctgagcaggctcccgtcccgcccatgccctacccgtggcaggggccagggttctctgatggacggagccaactcgtccgtgtgcccttgggctactcatttttataacatggccccttttctgttcatcagcactggctgcagaaacttccttttgcaggtcccttgctacccatatgtgtgaagaaaagggggaaatgaaagccctagaacccacactgcagtgggcatgggatcatcctggaaccaggagaaacgaggttagggctaccaccttaaccgcccaggtgctggctctgcgtgaatatcttaggaaatgctttcagaacagacagcagcgctggggacaggatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacagggcctggtaaccatcaaggatgtgtcactgtgcttctctcaggaggagtggcggagcctggacccctctcagacagacttttatggagaatatgtcatgcaggaaaactgtgggatagtagtctctctgagatttccaattcccaaactggacatgctttctcaactagaaggaggagaagaacaatgggtccctgacccccaggacttagaggagagggacattctgagggtcacatatacaggagatggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgtgggaaacagtttgtatggggttcccaccttgccaggcatcaacaaacacacactggggagagaccctacagctgcctcaagtgtgagaagacctttgggcgaagacatcacctcatcaggcaccagaaaacccacctacatgacaagaccagcaggtgctctgagtgtggtaagaatttccgatgcaactcccatctggccagccaccagagagtgcatgcagaaggcaaatcctgcaaaggccaagaggttggagagagccctggcacaaggaaacggcagcgtgccccaccagtgccaaagtgtcacgtgtgcactgaatgtgggaagagctttggccgaaggcaccaccttgtgagacactggctgacccacactggggagaagcccttccagtgccctcgctgtgagaagagctttggccgaaaacatcacctggacaggcacctgctcacccaccagggacaaagtccccggaacagctgggacagaggaacatctgtcttttgaaatctgtttccactacagctatggtcaagtctatcagccggtgctaccaggagtcactgccagggctgccgttctcctgaaccccagtggccagaatcataagccctgaccccatccctagaaagatgaggtcccagcaatggccagagcatttctcaccagttctgtgagatagcacataaaaatagagttctttgggcaaaacttttgagaagcaatgcatcctacatgggctgatattcagcctgagctgttctcaagaggagagtggtactggcagtttatggctgaaatccattctgattggttggagtctatgctataccagttgttaaacattttgagtatcactcttgcatactgttactattatattttctctatatatagacagaaaggccattttagaatattaaaggctctgaaaatttctgcagtagacccaactgaaggttctattaaggcagtgtttcctaaatgtatttgacctcagtatcctttctatttacatcccacagaactggtgactatgaaacactctggtgaacactgggttagagagtaacaaggaaacaagagatagtgatcaggcatccagagcccccttttttatccatatgaaagccaggggggccagaccttgttcatgtgtgggtctgtcttccttatgccaatcagcagtatatacatcacctctcaccctcacctgctgaaaaaataacctttttacccattattcctactcccttcatcctgcacatacatatatccagctgagagatcacactacagggctaagagatgatctaatacccccaaatagccctggcccacacag

SEQ ID NO: 1225 - DNA, 2240 bp, Homo sapiens
aactttgcagcgtacttggaccgctctggccgccctgggcgctacccgcagagataagggcccctccctgcgcccggtccgggcatctccgagccggcctgggggtggctgaactctcttttgccggccgtaaccccagcccccgcagcccccgcagccgatcggtcctcaagctacagctcccctctctgggagtccccgcttttgaattccccggggatgttcccgctgcggtccgatggacctcccagagcagcggaggtcaggggagctagcagaggcggggacgtcccttgggagtgaggggactgacaggggcggcctcgtaaccctgcgtgggatggaaggtcagagtgggttcctcggtggggggcaacagcgggggctctccggcaattgtccccgaccctccgtcctggggagggcaggatcagcgcgcgggctgctttgcatctctttgcattttagtgatgtttggtccagtcctggcccgggcagatctggggttcgggcgggtgccggtggggtagggctgggggtgggagcggcgcttcctgctgcgggtgagccttttgcctcggaactggacccgggagacatcacagcgctgggctaggggcgcggcttgaactcgcctaaagagctgcgccctctcagtaagtccccatggtcccctgccccccgcgctccgtcctcagtcaggcccgggtcctgcctgaaggcgggggtggaccagatgatctttcttgggccctgggcctagattcgaggtccccagggtccaagtcctgggttcagagggcggggcgcgaggggcggtgtctccaaggggcggggtcccggggtccctgaaaggcgcggaccaggccggatccacccagtctcgcgcctgcagcccgtgccgccccagccgctgccgcctgcaccggacccggagccgccatgcccaagtgtcccaagtgcaacaaggaggtgtacttcggtgagcgcgcccacaccggccccgcgaggaggcgccgccgacggggcgacgaggctggggaccgctcaggaggaccgggggcgctgggtccctggggcggcgccccagcctgaaaacgcctcagcctggcccgccgcctgccccgggatgagggtggaggcccctgcgtccgagggccctggcgatctctgcctgctagtggtcttgctgtgctcggcgggctacctctggctctgagcctccccgtctctgggtcctacggtctctgccgtttcctctcaggcgcgccctgagtgggggacccgcagggctggaaggaacgcggggctggggccgcgccccccagcgctaagtggaaacagacgcggaaaccgacgcccggggcgcgatcccgggcgcccgcctccctgccccgcgcccgcgcgccccgaggggagggaggaagtgggaagtcacccctgtccccgccgagaagggctgtcgcaggctccacccttgccaccgcagaggcccggggctgaaagcaggcagccaggcccaggccctgctgacctaagccgcgacccctgaccctcggcctcgccctctagccccacccagccttcaggagcaagattcccggccgcacccgaaagtgccccggggaccagcgaccccgcgctttgtttagttgtattggctctggggattggagatgttcccctcatggagggtgctgagaccttagggtgggctgccaggctgggcggatgcgggctaagtgcacagggccttgggcagagctggctgcaagaggcgggtacgccagtggtgggtaggcgccgcgtcctgcagcgtctcaccggggcctgtctgtgcctctgcagccgagagggtgacctctctgggcaaggactggcatcggccctgcctgaagtgcgagaaatgtgggaagacgctgacctctgggggccacgctgaggtaggtgggacccaccctggtggcaggggccaggggtgatggcaccccctcacggcccttctctttgcagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaagcaaatgccaggccttgtccccagatgcccagggctcccttgttgcccctaatgctctcagtaaacctgaacacttgg

SEQ ID NO: 1226 - DNA, 2858 bp, Homo sapiens
gttccccgcggagccatgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgaggtaggggcgtcccgggcgcgcgggcgggtcccaggctgggcccctcggaggccgggtgctcactgccccgtcccggcgcccgtgtctcctccagcccgtcggagccctgctgctggagcgctgcagagtcgtccgggaagagcccggcaccttctccatcagtgagtggggctagggaagccagcggcgcttcccgcagcccggggcacccgcagcgccgcactttcccctccccgggcgcccaaggtctcctctgtgtccccagcctggcgccaccctcctcaaacacaagagtgcattgtccacgggcagctcaaggtcaagttctcctggcgggcaccacccttcccacctgccgagtccacttaagcttgggtccctcccagactctgctctttgttccctgtgggcccaggctgtacttacagggcaggtgggccagccccacccaaagcgtttccccagctgccaagagtagcatgggtctagcattgttatatggccccgggctggaaatcccaggtgggggtaggaggagtgagaggggggtgttctcctgggtcttaagagattcccttctgcggggaaagatggagtccctgctagtttgcccagagtggctgtcaaaattccacaggccaggtggcttaaatatcagaaacattctctacagttctggaggccagaaatcctagatgaaggtgtgggtggggccgaatccttctgaggccgaggggaatctcccagttcctagtggtggccagtatcctccaggttccttggcttgtggaagcgtcaccttgtcctccttgcatcacgtctgtgcccacatttccccttctacacagacgccaagcagaatttagggcccaccctgacaacccctttttacttcactttattattttatttgcttattttttgagacagggtcttggtatgtcgcccaggctggagtgcagtggtgcaatctcggctccctgtaacttccccctctcgggttcaagtgattctcctgcctcagcctcccgagtagctggtactacaggcacgcgccaccatgcccagctaatttttgtatttttagtagagacggggtttcgccatattggccaggctgctctcgaactcctgacctcaggtgatcctcccacctcggcctcccaaagtgctgggattacggtcttgagccaccgtacccggccctctttatttttgagacaggatcttttgtttccgaggctggagtgcagtggcgtgatcacagctcactgcagcctcaacccccttggctcaagcagtcctcccacttctgactccggagtggctgggcctacaaggccccaccaccacacctggctaatttttgtttttgtagagatggggattttgccatgtcacccaggctggtctcgaactcctgagctcaagcaatcctcccaccttggcctctcaaagcgctgggattataggcatgagccaccgcacctggcgacaacctcattttgactagtttatatgcaaagaccctgtttatatacagggccatactcatgggttctggggggtcaggacatgaacacatctttgtgggggccagagaagggacagtttatgggcaatggcaagaggaagctgcttgtggctgtgggtaggaccgaccacaggtgttccatccccaggcttcattgaggaccctgagaggaagtatcactttgagtgcagcagcgaggagcagtgtcaggagtggatggaggctctgcgtcgggccagctacgagttcatgcggagaagcctcatcttctacaggaacgaaatccggaaggtgacgggcaaggtgtgtgcagggctgcagagggccggggtggggctgcaggtggcagaggcagtcctccagccctggctcatggccacccgtcctccccacaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctgggtccagggtgcttgttctgttcaaataaaggtacctcttttccac

SEQ ID NO: 1227 - DNA, 2365 bp, Homo sapiens
atttacagctggaagggcagacggaggcatcttggtgtatacacagccctgctgggccacatcccgggtctcctccctctgcgatgccatagcaggggcgccttccgaaagccctctggattgaggcagcaggatctatggtggaacctgccccggcgtcgccaacgcccctaggaccccagcacactgactggggagcatccctgtgtcgtttctgcccggagaggagcagaggccaggctgctgctctgggagatgagactttctggtgcacctgcacttccacatgagacttccgggtgcacctgcactcccagatgcagacttcctggtgcacctgcacttcctggtgcagacttcttggttcatctgcaacttcctggtgagaatcccttgggcatctgcacttcctgatgcacctgcacttctagttattttagagaaaacgttccctgaacatgccacatgcagaggatgctgggtatcaggctacctttgctggacagctccaggtaactgcatttgctctgccaatgttggctttttaaaaatagaaaacacatatagacaaatccatcacacacacatgcacagacacacacacacacacacagacaaatccatcacacacacatgcacagacacacacacacagagtcagcgacataggctcacaagtagagctcttcgtctgtttatacttaatgcaattactgatacatctaagtttggagctgctgttttcttttacgtatactgtttgtttgcagattctgtgtataaattctttcctttcttgccgccttttagatgatttcccccagcttaccttgaggactttcgagcaaacagacacgttgaaagaatagacaaggaccacttgcatgcccctcagttagattcaccaactgtcaatattttgcactgtatgtatacacgtacatgtctgtgtatacacatatacacatacagtcacacatcgcccgatggcagggatggttctgaggaaggcgctgttaggcgatttcgtcgctgtgcgagcatcatagtgtgaacttactcaaacctagatggcacagactcatcgcctcccacacgcctgggctgtatggcaggacctcctgctaccgggctacaaacccaggcagggtggtactgtactgaatggtgcaggtgattgtaacacaatggtaagtatttgtgcatgtaaacatacctaaacatagaaacagtgtagtaaaaatatggtataaaagatcaaatacagtacacctgtacaaggtctgctctgttctaatcttatggggccaccactgtatatgccgtctattcttgacagaagtgctttatgtggcacatgactgtacatggaaatacacacacactcacacacatccacacacaagcatatgcatacacacatatatacatgtatatacacgtgcatataacatatgtagatatctgccaattgctatccaacgtgaattccataaatttacactcctaccagcagcatttgggtatctgaggtgtcacacatccttgccagcactggatattatcccggcttggagattttgccagcctggtgggtgtgaagtggatcttgttgtggttttaatttccatttctctaattatgcagaggctgagtgccaggcttcctctcctgggaagagcctgccggcttgcgggctgtcagcactcactgtgggtgcgggtggcgtgcctgcctgcacggcccttgcctctcttagtctacagggtctccactcctgagttcccggaaacaagatacagatttcagaatggcacctgaacattgtttactgatttccggctggaagtgagggtccgagggattcttctatggaattgtatgactcagcatctttctgattgcaagcagcagcatcgcagcctaaatgaatctattggctttgcttagggttggttccccttcattcttgagctggttgtgggcaactcctgccccctgtggggggactggactgccttagatcacatgtgtgtccctgactctctgtggtcaggggatagaatattcagattggaggggagccagcttctcctaaaccacgtggatctccaaacggaagtcagagcagatgggaagggggagcagacgttgagctcaatcaataaacacccaccttgggagctgcagcctggagggcttggtgactgccacgctggctgctcagagctcctcgcttacttttgggcatatgcctgtgaaccagatggtggcacctcctgaaaatcgggtctgtggataatgggaggattttttaaattatgaaaatgttcattatggaagaataaatgaagaatagcatatg

SEQ ID NO: 1228 - DNA, 1818 bp, Homo sapiens
taggttcaaggactgttaatggtttgtaactgcctgacaataaactcaacctcagttacatcagcctgggcagatgtctaaggatatgagaccgggggaagaaaaagttagaatctgtagcagaaggacgaagcttgccacctgcctactgggctgagcttttaatgtgatttacatttctaagctctatgtaggtgccctggaaatggtggtcttcattaatgcaaagattaagtctttaattaaactttttaagaagaaaacggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacaccagaagagaagatgcgacagcaagcccaaacagtccaggctgacgtggtgcctattaacataactggtacgctttgctagccagacaggttcagaatgtacttgggagaatgactacagctttttgttttatgctgttagcatttcattgctacatcaaaggtgaatagctgtggtccaacttcatgctctttgtttaatgagaggaatattaaaactacatatgtgtgtgcatataaaatgtctactgcttgttgggttcgaagactatgtcgccagcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgc

SEQ ID NO: 1229 - DNA, 2375 bp, Homo sapiens
actttacacatggagaagcagaagcagagatgatagaatctttcgcccaaggccacatctgtattgggacgggggcagcctggcacccaagtgcccattcctcccttctgaccagcccccacccctccggctctggcgtccaaagggctaaggggaggggtgcccttgtgacagtcacccgccttctcccctgcagccgcgccgcggatcgccaacatctcggtgctgcccagtccggctcacgccttccgcgcgctctgcactgccgaaggggagccgccgcccgccctcgcctggtccggcccggccctgggcaacagcttggcagccgtgcggagcccgcgtgagggtcacggccacctagtgaccgccgaactgcccgcactgacccatgacggccgctacacgtgtacggccgccaacagcctgggccgctccgaggccagcgtctacctgttccgcttccatggcgccagcggggcctcgacggtcgccctcctgctcggcgctctcggcttcaaggcgctgctgctgctcggggtcctggccgcccgcgctgcccgccgccgcccagagcatctggacaccccggacaccccaccacggtcccaggcccaggagtccaattatgaaaatttgagccagatgaacccccggagcccaccagccaccatgtgctcaccgtgaggagtccctcagccaccaacatccatttcagcactgtaaagaacaaaggccagtgcgaggcttggctggcacagccagtcctggttctcgggcaccttggcagcccccagctgggtggctcctcccctgctcaaggtcaagaccctgctcaaggaggctcatctggcctcctatgtggacaaccatttcggagctccctgatatttttgccagcatttcgtaaatgtgcatacgtctgtgtgtgtgtgtgtgtgtgagagagagagagagagagtacacgcattagcttgagcgtgaaacttccagaaatgttcccttgccctttcttacctagaacacctgctatagtaaagcagacaggaaactgtttacagggcctggaggcccagtcttgtcctcctctgtcaccgacttgctgtgtggacctgggacactctcttcacttctctgggtctcaattcatttactgttgaacacggacaatcatattcttccctcctggctgggaggactacaaagatctgaggaaataatggatatgaaggggctttggaaagtacaaagccatcttctcatgaggggcatgacagaaccctctttgcagagtgacctttggacgtgcagtcagttcttggagaagtgtggcccctgcagcagtgtcacggagaacacagagttccagagagcaagcctggggcaggggctgtgcaaacgtgtggtcagaggaacatcaaatcctggaaacttggtggcagggagaggcctggggcctttaccccatgccccctgggatctccactgtgactgtcccacaccctctgcccaactcttgccccatcagctgccctgcattgccttgagctgggacccctaggaaatggaaaccaggctcccctctctcaaggtatctgggaaccactgtctcaggagctgaagccgggagacctgaggggaggtctggccggagagtccgtgcgtaaagcagctacagctctgacctctctgacctgcagcctctcagggcgtgcgaagtccaaacgcactggcaacttcaccccctttgccctaacgcgggcaggctgacttggaggggtgcttccctatttacacctcagggtgaatttgttgatcaccttagctcctgtggtccttggggcttagggagaggagggaggcatgcctgggtcccaggtaagctggcaagaggaaagggccacaggctaggggaataacgaggccatgaacaagacatctcaccccagttacaatggcttttatccaaaagacaggcaatgacaaatgctgatgagaaagtggagaaagaggaatccccatatactattggtgggaatgtaaattagtatagccactatggagaacagtacagtttcctcaaaaaactaaaaataggctgggcgtggtggctcatgcctgtaatcccagcaccctgggaggccgaggcaggtggatcacttgaggtcaggagttcgagaccagcctagctaacatggtaaaactctgtctctactaaaaatacaaaaattagctgggcgtgctggcacgtgcctatagtcccagcaacttgggaggctgaggcagaagtattgcttgaacccaggaggcagaggttgcagtgagctgagatcaccccactgtcctccagcctgggcaacagagagactgtctcc

SEQ ID NO: 1230 - DNA, 1903 bp, Homo sapiens
aggaaatttctggtgggccttcgcggctccgctgggttggcagccgcttgagccactgcgaggaaagcaaagtctgggccatggagatgagcctagtcctgctgttcctgatccgcactgccctttttgcaccccagggagctgctgctgacggcgcctccctctgtcgccaaagttggagtgcagtggcgcggtctcggctcactgcaagctccgcctcccggattcaagtgattcccctgccttagcctcctaagtagctgggattacaagtgcccaccaccacacccggctaatattttgtattttaatagagactgggtttcaccatgttgaccgggatggtctcaatctcctgacctcgtgatctgcctgcctaagcctcccgaagtgctgggattacaggcgtgagccaccacacctagctggaagaggagataaatatatgaaggtgctgtttggcacagaatttaatagggaagaaagagacagtataactcaccagtgctgggtctcatcatcctgcaatttcagaacaactatgaatacaaaaagaattttaaaatcccagtcctgcctagaaaggggaagtcatctctaaatatggtggccctggggcagctggcctccctgccaggcctcttccatgggggccctttctgcagtgactgtggtttcttcccattttactctgtcctgtgtcctgactgaagcgacaaggtgtgtctgcagctgtgctcacacctggaggaaacctcaatggtcacatcctctttcctgtgtcaagaagcatcgtccggggaggtgagaagaagacagtcctccctagaattgaagaaccagggagaagcagatgggctgggcaggtgggttttcacctggaacctggaggatgagcaatgacatctctccaccctgagctcagcccgggcatccacctcctgggctcatgagcagtgcagtggtgcctcctagtggtctctgctcttccttttccagatcaagcacaaacctgagatccaactgtccctcttatgcgcctgggtttcttcactggacaccagtatgagtcaactttcctgtaaagcagaacaagcacgagattggaccatgttagaggaggaatggtgtcatctccacttctggagagatccctgtccccgtgttcgggggaaggaccaagcctcactcccatgcagagaagaggctctgactgtaactgcacctgtggagagaggattgcggcctgttggcagaagagtagtgtcttgggccccagctgacctgatgaatatcaatatccaatgccctgtaatgaagtcatgtgtgcacatatcatcacttctgcatgcagtctcatgggaagatggtgccaagaacgaagaaggaagctcctgcccctcctaaagccgaagccaaagcgaaggctttgcaaggccaagaaggcagtgttgaaagatgtccacagccacaaaaaaaacaagatccacatgtcacccaccttccggcggcccaagacactgtgactccggaggcagcccaaatatccttggaagagcacccccaggagaaataagcttgaccaccatgttatcatcaagtttccgctgaccactgagtaggctgtgaagaagatagaaaacaacagcctacttgtgttcactgtggatgttaaagccaacaagcaccagatcaaacaggctgtgaagaagtttgtgacattgatgtggccaaagtcaacactctgattcagtctgatggagagaggaaggcatatgttcgactggctcctgactacgatgctttggttgttgccaccaaaattgggatcacctaaactgagtcaagctggctaattccaaatgtatgtatatcttttcaccattaaaagaatcttaatctc

SEQ ID NO: 1231 - DNA, 2117 bp, Homo sapiens
gcgactgcctgtgtgcctccattggcatctctgcctgtgggccccaggccagaagtaatggcccatgtagcccaggcccgggggccagtcctcagcattttgcggaggggcggcctgggaggggaggaggggatccctggatagggggtctcccctggtctgccccagctgtgccgacagcacctccaccttgggcctccatcctctaccagcagagaagagagtggcccattcggtgtccacccgtcaggccacccagcagccaggcacgctcataagcccgcgttacggatggtgcggccgggtgcacaggcccgagggaagcacaggcctcggcctcccagctcccaacccctgcaccacccacagccgggagtaccccatggacagctgtggccgaggagaagccagggatgagggggatgggcctcacctccccaccagcctgggaagggggtaggcccctggcaagtaggtgagaagctttttcattcacaagttgtccgggctccccattcctctttgtcaggccagcgggtgtgggcagtcgggggaggctggggtcctgacacaacaggagtacatctgctggcctagggcctggagaccttctcctacaggtcgggaggcagccctgggcagcgggcattgcggggactaaagagaaacaagagcaggttgtgtgcagggcaccccagccactccagaaacccaatgggagggtgggggctaggaccccaagaagctgaattggggtgcagtgccgccaggcctcccctgtaggagtcactttgggcttcctgtcccaacttgtggtgggagctggggcaaggttccaggggtaccccgaatgaatggggctgttcccaagctggccagggagcctggaagcagatgagatggggccgcagagcctggtttgcggaggggagaggcagacgtgccctgcagccctctcttcttcagaggccccctgcgggtgctgaggggagagtggcttaggcgttgcaccccaggagactgaactgggtcagttcccccttgtttgctgccagagaaatgggggtaccattgtcagggtgagctaaggaggccctgctgacattggcccaaccaggcccctcctttgcggctgctgtggggactttcgagagcagagcacacccctaagtgcatggagaggtaagcacagctggtgagcacacggggacagcgacggagctcatggagacccaggtgaccttaaaacaccccagggccggctccggccccagagagatgtggtccgagtagaggggggtcagcagtgacctggtgggtgggtgtatttgaggggtgcctgtgttgaaagctctgcagtagattctaaggagcagccagggctgagactcccggtgctgagcccaaggcccctttccttcctgcaggagttcatcttggctcttgcagcccccatgaccctgtggcgctggggggcggctagcatgatgctccccatttttcaggagggaagctgaggctcagagacatcatgaggatgccagctcaaggcccagccaggccttggtcctcagctgctgtcatccagtagggtaagtgggacccccaggaggtgttgggggacactcctcccctcccccacactcacagtctgttcaccgcccaaggcagcaggctggactcggtgcagggaccatggcttggcgtggccaggttggagtggcccctgggactgaaagcagggggcgtgggggctctgaggcggggctgagtgcggggacgtcctgtggcgggtaccctgctgggtcctgggtgggggccaccaccaggcagctgtgggaacattccagaccacctaggagtagggccccttcaccgtttgaagctgactgtaaaaaacatctgacctgcgtgcaaagctcaagcccagaggcctccagggtgtccagcctccggggtgcctcctacgcagcctccacgtccccatccactgcagcccctgaccatcgggcacaccgtggggccttcgctggccgccgggcctcaggttctgctgcaccaagtgatttttaaagccccatctgcctttctccacttataaagaacttgggacattt

SEQ ID NO: 1232 - DNA, 1820 bp, Homo sapiens
gagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagaatcttttattcagcaccaacaataagaattacttggcttggtaccggaaaaaaccaggccagcctcctagcctactcatgtactgggcgtctacccggcaatccggggtccctgaccgattcactggcagcgggtctgggacagaattcactctcaccatcagcagcctgcaggctgaggatgtggcagtttattactgtcagcaatattatttttctcctccgacattcggccaagggaccacggtggaaatcaaacgtgagttaaatttacggtttccttcatcggctgtctgtgtcttctgttccctgtgtctgttgtcaacctcgagaactgattacacacttgcttcgaagaccaagcaagattcagtcgttgcatgagaatagcttgtctaagtcataagttcagatttgtcctggggcattttacatgttctggacagagccttggtcaaacgtcagaaagggagtttgtgtgtacacttttggccaggggaccaagctggagatcaaacgtaaggacttttttccactgattcttgactgttacacattaatgtaatttgtgttcctttgtgtggattttcattagtcggatgccagggctctaacaaacttcattcccaggttaggtacagagggggggaaattgttccacaggacgctgacttgtggctaatttttaggatttctatatcaaaatactttcattgggggaaagaggcttgctgacctttcagggaggttttctaaagggaaaagttaggacgattcactgtgattctctatcggccctgggaccaaagtggagatcaaacgtaggtacatctgtctcaattgttcgtgaaaacttagtgccattgtatcatttgtgcaagttttgtgaaatttcggttgaataaacctggtgacccagaagtaaatagtaggacaccagaaaatgaactgaaaaagctgagcaagtaggcgaatcactgggtttgagaggagaataggattcatgggggaagtggggaagaaatagctagacttgtctctgaacaagcagtctatctcaaatgattggcttcaagagtgctttttgttgaggggaaagggtgagatccctcactgtgcctcactgtcggcggagggaccaaggtggagatcaaacgtaagtgcactttcctgatgttttttcttatcaggttttgaatttggagcgtttttgtgtttgagatcttacctcaggtcaattccaaagagtaccagattctttcaaaaagtcagatgaataaggttaaggaacagccaagcgctagccagttaagtgaggcatctcaattgcaagattttctctgcatcggtcaggtgagtgatattaacagcgaaaagagatttttgttaaggggaaagtaattgagttaacactgtggatcaccttcggccaagggacacgactggagattaaacgtaagtaatttctcactattgtcttttgaaatttgggtctgatggccagtgttgacttttagaggcttaaataggagtttggtaaagattggtaaatgagggcatttaagatttgccatgggttgcaaaagttaaactcagcttcaaaaatggatttggagaaaaaaagattaaattgctctaaactgaatgac

SEQ ID NO: 1233 - DNA, 2191 bp, Homo sapiens
gtgtgctgccgcggcgcgggaggagagtgtgcgttgcgctttctcccgcgatcgccctgccggtcgctagctccgagggcgcgcactggatcccaggctcctccgagagtgcggcgacctcggggctccgccggcaccggaggtggctctgagggcagggacgtgttggacacgctgactttgtaggctccgccaagaggcgccgcaggagcccgtggccacccaggagcccgatgtgcaaggcaggtgtgagtgccaggacggcattcctggagatgaaggcctggagctgcggtctgcggactcggcagtgcccgtggccatgacccaggctgccgtgcggccctgggcaccctgcctggagaacatgaccactgccccaaacggcctcgggccaggccccgcagccccctgtgcaggctcggacctgaaagacgccaagatggtgacctcccttgcgtgtggaaatggagtctgtggctgcagccctggtggcgacacggacacccaggaagccaaactcagcccagccaagcttgtgcgtctcttttccaccagtcggaagaggacgggtgcccaccccgagcggccccactccatggtcctggtggggaactcctccacatggaacaccctcgcctccttccggaaaatgggatcctttaagaaactgaagtcctcagtcctgaaaggaattcagagccgagaggggtcaaatgcctgttcaaagggagaggcttcggagcatggcctgggaaagtccatcccaaatggcgctgtcccaggagcccaggcaagcaggggctcccccttagcaccgggaccagcatgtggtgccctcaggccagcagagtggggcacattggatggctccgacctcgaggacacggacgatgccttccagcggagcacacaccgctcccgcagcctccgcagagcctacggcctgggccgcatctgcctgctggatgcgccccagaaccatgcgacacccacgatagccactggccaggtgcccgccgtgtgtgagattctcgtgaaagaccctgaaaacaacagcatgggctacaggaggagcaagagcacggacaatcttgcctttctgaagaagagctcctttaagcggaagtccacctccaatcttgcagacctcaggacggcccatgacgcacgggtaccacagaggaccctgagcagttcctccactgactcccaaaagcttgggtcaggaaggaccaaacgctggaggagcccgataagggccaaggactttgacagagtcttcaaacttgtgagcaatgtgactgaggctgcctggaggagggagagtcctaggagtggggccccatcccctggagaggccagcctgagacttcaggcacacagccggctgcatgacgactactcccgccgcgtctccaggagcactgagcaggacagcaggcggggcggggcggtcatgcatgggaccactgcaacctgcaccgtggtccccggtttcggctcagccacctctaaggggccccacctagacgctgacactgccgtatttcctcttgaaaccaaaagttcctgggcggtggaaagcgacagttcctgcacttgcagctctttgccaagcccgattgtccaggatgtgttgagcaaagactcctgtgacccaaacgctggcagccagttgacatttgaccctgagcagcctcccacccctctaaggcccaccacacccaagccccagagccctcagagcccccagagccccggggcaggaagtgccagctgtcacagcaatcacagtgccctgtccgcgaattcagaggaaagtgaaggaagggcagaagagcctgctcagagagagccagggcctgtgtccttgcaggatcccctggaagccacacatggtgatgagggcagcaaggaccttctggtgaacattggtgtggcagccggcccagaagaaaaggagaaggaggaggtaagggcagcggcgaggtccctcatgtgggcgaccctcctgcgggaagggagcttgcacaggtgttgcccttggtccctaacctgtcaaggtcagtggccctctgctgaccttgttgcccttacagtattagtgggaatgggagttgtcaagttgctgtttaccaagttcagaagtaatctctatctcctttgaaataaattgacaatgtacgag

SEQ ID NO: 1234 - DNA, 2425 bp, Homo sapiens
gatgcgctccccggcgcccagcagcagaggccaccgctcccagaaatgcatgcgaccgatccccttctcccggaccccaggagccggcgcccccgccctgtagggttacgactcactgattaaaaagagggactttttcaaatactttgcacttttgattgtgtattatggataccaaggaagagaagaaggaacggaaacaaagttattttgctcggtttgtggataccggataaagcttcactttgatgggtattctgattgctatgacttctgggtgaatgcagacgctctggatatccacccagttgggtggtgtgagaaaaccggccacaaactccatcctccaaaagggtataaagaagaagaattcaattggcagacctatcttaagacatgtaaagctcaagctgctcctaagtcattatttgaaaatcagaatataacagtgatcccatcgggctttcgagttggtatgaagcttgaggcagtagacaaaaagaatccctcattcatctgtgttgctacggtaacagatatggtggacaatcgtttcctggtacattttgacaactgggatgagagctatgactattggtgtgaagcatcaagtccacatattcatccagttggttggtgtaaggaacatagaagaacccttattactccaccaggttatccaaatgtgaaacatttttcttgggataaatacttagaagaaaccaattctttacctgctcctgcaagagctttcaaagtgaaacctcctcatggattccagaaaaaaatgaagcttgaggttgtagacaaaaggaaccctatgtttattagagtagcaactgtggcagacacagatgatcaccgggtaaaagttcactttgatggctggaacaattgctatgattactggatagatgcagattctcctgatattcaccctgtaggctggtgttcaaaaacaggacatccccttcagcctcctttgagccccttagaattaatggaagcttcagaacatggtggatgctcaaccccgggatgtaaagggattggccatttcaagagagcgagacatctgggccctcacagtgctgccaactgtccctattcagaaatcaatttgaataaagaccgtatttttccagaccgcttaagtggtgagatgcctccggctagtccgtcatttccaagaaataaaaggacagatgcaaatgaaagctcttcttcccctgaaatcagagaccagcatgctgatgatgtcaaagaagactttgaagagagaacagaaagtgaaatgagaacatcacatgaagccagaggtgcccgggaagaacccaccgtccagcaggcacagcgtcggtcagctgtctttctgtcctttaagtccccaattccatgtctgcccttgcgctgggagcagcaaagcaaacttcttccaactgtcgcaggaatccctgccagtaaagtttccaaatggagcacagacgaggtgtcagaatttatacagagcttacctgggtgtgaagaacatggaaaggtatttaaagatgaacaaattgatggagaagcatttctacttatgactcaaacagacattgttaaaattatgagcattaaactgggccctgctctcaaaattttcaattccatcctgatgttcaaagctgcagagaagaattctcacaatgaactttgaagatggtgaattctgaataccatcagcattctgctttaaagctcatgttttattcaaagcacaaggacggttataactcctaagtgagaagtctccaaaactcaaaagagcaacactatcggattatttatattactcaagagacaatatatatgaattcttatgaaagtgcttgagcttttaaccaggtactgtctaacaacagtcatcttttggttctgttcactgagctaaatttatctttgtaaatctttttgagtctggggggtggggggaaggggggcttcattaattatttatggtaatggggggcagagtaagaacttttggcattttgtaaacattgttgaattctctttcatgtacactgtttctttttcaatactttcagaaacctttttatataatcaaatttcaatttaaaccaaattagtcgaaacctggctaagtttagccagtaggactgttatctgtattgttaattttgtgccatattttgaattgcaacattatgctaagtataactttgcaagtcatgatattgcctaactgcttgtcataattgtcagggctgaatagttgtaagaatgacttttctttgaatcagtatttttccttttgcacgcattatgaaatgttaaacaaattacttttcaccagcatctttactataattaccaaaaacatgtatataaaagaatgaaattgaaaaataaaatatataaacat

SEQ ID NO: 1235 - DNA, 1785 bp, Homo sapiens
agtgagtaccagcagaaggctgggagtctgtagtttgttcctgctgccaggctccactgaggggaacggggacctgtctgaagagaagatgcccctgctgacactctacctgctcctcttctggctctcaggctactccattgccactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggacctcatgaaaactgatgctgacacttactggtgtggaattgagaaaactggaaatgaccttggggtcacagttcaagtgaccattgacccagcaccagtcacccaagaagaaactagcagctccccaactctgaccggccaccacttggacaacaggagtgagggttcccaggctgcaaactacagacctgcagctcaccaggcacaagctcctgaagctcagtgtcctcctgcccctcatcttcaccatattgctgctgcttttggtggccgcctcactcttggcttggaggatgatgaagtaccagcagaaagcagccgggatgtccccagagcaggtactgcagcccctggagggcgacctctgctatgcagacctgaccctgcagctggccggaacctccccgcgaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccacctcagtagccacctccccggcaggggccctgaggagcccacggaatacagcaccatcagcaggccttagcctgcactccaggctccttcttggaccccaggctgtgagcacactcctgcctcatcgaccgtctgccccctgctcccctcatcaggaccaacccggggactggtgcctctgcctgatcagccagcattgcccctagctctgggttgggcttggggccaagtctcagggggcttctaggagttggggttttctaaacgtcccctcctctcctacatagttgaggagggggctagggatatgctctggggctttcatgggaatgatgaagatgataatgagaaaaatgttatcattattatcatgaagtaccattatcataatacaatgaacctttatttattgcctaccacatgttatgggctgaataatggcccccaaagatatctgtgtcctaatcctcagaacttgtgactgttaccttctgtggcagaaagggacagtgcagatgtatgtaagttaaggactttgagatagagaggttattcttgctgattcaggtgggcccaaaatatcaccacaagggtcctcataagaaagaggccagaaggtcaaagaggtagagacaaagtgatgatggaagtggacgtgggtgtgacgtgagcaggggccatgaatgccgcagccttcagatgccagaaagggaaaggaatggattcccctgcctggagcctccaaaagaaaccagccctgcccacgccttgacttgagcccattgaaactgatcttgagctcctggcctccagaattgcaggagaataaatttgtgttgtttttaatg

SEQ ID NO: 1236 - DNA, 2553 bp, Homo sapiens
aatgttcaacaactccgcggggtcttcctgtttcgtgtccgctgcgtttgggttccggtctccgcttctccagtggccccggtggctccaccgcagcgtctggcgcgctgggacctgcacaggccggagagagccgtaggcaggaccccgggacaccctggaagccaggaaatggactcagtggcctctgaggatgtggctgtgaacttcacacttgaggagtgggctttgctggatccttcccagaagaaactctacagagatgtgatgcgggaaacctttagaaacctggcctgtgtaggaaaaaaatgggaagaccagagcattgaagattggtacaaaaatcaggggagaattttaagaaatcatatggaagagggactcagtgaaagtaaagaatatgatcaatgtggagaagccttcagtcagattctcaatcttaatctgaacaagaaaattcctactatagtaagaccatgtgaatgtagtttgtgtgggaaagtcttcatgcatcattcatcccttagtaggcacatcagatctcaccttggacacaaaccatatgactatcaggaatatggagagaaaccatataaatgtaagcagtgtgggaaagccttcagttcttgtcaatcctttcgaagacatgaaagaactcacactggtgagaaaccctatgcatgtccggaatgtgggaaagccttcatttctctcccaagtgttcgaagacacatgattaagcacactggagatggaccatataaatgtcaggaatgtgggaaagcctttgatcgcccaagtttatttcagatacatgaaagaactcacactggagagaaaccctatgaatgtcaggaatgtgcaaaagctttcatttctcttccaagttttcaaagacacatgattaggcacactggagatggaccttataaatgtcaggaatgtggaaaagcctttgaccgccccagtttatttcgaatacatgaaagaactcatactggagagaaaccccatgaatgtaaacagtgtgggaaggccttcatttctttcacaaattttcaaagtcatatgattaggcacactggggatggaccttataaatgtaaagtatgtgggagagcctttatttttcccagttatgttcgaaagcatgaaagaactcatactggggagaaaccctatgaatgtaataaatgtggtaaaaccttcagttcttccagtaatgttcgaacacatgaaaggactcacactggagagaagccctatgaatgtaaggaatgcgggaaagccttcatttctctcccaagtgtccgaagacacatgataaagcacactggagatggaccttataaatgtcaggtatgtggtagagcctttgactgtcccagttcatttcaaatacacgaaagaactcacactggagagaaaccctatgaatgtcaggtatgtgggaaagccttcatttctcttaaaaggattagaaaacatatgatactgcacactggagatggaccttataaatgtcaggtatgtggtaaagcctttgactgtcctagttctgtccgaacacatgaaagaactcatactggagaaaaaccctatgaatgtaaagaatgtgggaaagcattcaattatgccagttccattagaatacatgaaagaactcataccggagaaaaaccctatgaatgtaagcaatgtggaaaaacgttcagttattccagttcctttcaaagacatgaaagagctcataatggagataaaccttacgtaaagaatgtgggaaagctttcatttatcacacaaccttcgaatacctgtgaaaatgaatagtggaggacaggtctacaagtatctacatatctaaagaatatggaaagtcttcagtttgctttctgggtttcagacttgtttgggagctcacccctttctcctgtttctcacttttggaataggaatctctatcctgtgcctgtctcatattttggaaatacatgactagtttggttttcaccggttcggagctgaagaagaattttgcctcagcatgaattgagtctcatccatatctgagtgatgtgatattgagatgacactttggagtttgagtttaaacattaggcttcatgctggaattaactgagacttttgaggcctttgggatgagatgaatatattttacatgtgatgacatggattttgggggccagaggtgtaatgttttggctgagtgtatgccacctcagattcatatgttgaaaccttacccccgtgccccccctctcccccacaatgtgatggtatttggaggccctgtctctggtggtttttaggattggaggacatcatgaagatggaggccttgtaattgggattagtttcctgataggaatccctagagagctagctttgcccttcaccatgagagggtgcagtgagaagatagctatctttgaaccgggaagcaggcccttaccagacatggactatgccagtgccttgatattggacttcccagcctcccaaaccatgagaaataaatgtttgttgatt

SEQ ID NO: 1237 - DNA, 2569 bp, Homo sapiens
atgctgtcaacctgtaaaacaatcccctgaatcctcccacagtgctcgtaggggcgagttctgggccctcaaaagggcagtggcaataagcaatctaggacagaatgacatcaaggttgccacgggaaggccctgttgggatttgcacagagaagggcggcggaagggtgtccaggcagaggaaacaggaaatgtggccgggaagcagagttcatgtgagggtcaggaagggaggggagcaagaaagaaggcgagagagaggagaccggaggtctgagctgcagccactacacaggcctggaattctaccacagggaatttggtgggtgcctctaaagggctttaacctgcaattaatgacatggttgctgaatggctcctgtgggcaagagaataggtggtttgggggacacacgggttggaggcccgtgcatatcccaggtgagaaatggcaccggctcagggcactagtggtgggatgacagcaggcggatctgagcccccttcagagggtgggacaggggagacttggtaggtggttatgaagggctggccagagagtggccaagagaccccacttggctattccaatggtggtggcatctttctcctggagttgaggaccctggaaggggctaaggctcatgcggggcccctgacactggctgaggttcccctccccgcccatctgcttctctgcagcagcacgagtctctggaaaaagacaacctcgccctgcggaaggagatccagtccctgcaggccgagctggcgtggtggagccggaccctgcacgtgcatgagcgcctgtgccccatggattgtgcctcctgctcagctccagggctcctgggctgctgggaccaggctgaggggctcctgggccctggcccacagggacaacatggctgccgggagcagctggagctgttccagaccccgggttcctgttacccagctcagccgctctctccaggtccacagcctcatgattctcccagcctcctccagtgccccctgccctcactgtcccttggccccgctgtggttgctgaacctcctgtccagctgtcccccagccctctcctgtttgcctcgcacactggttccagcctgcaggggtcttcctctaagctcagtgccctccagcccagcctcacggcccaaactgcccctccacagcccctcgagctggagcatcccaccagagggaagctggggtcctctcccgacaacccttcctctgccctggggcttgcacgtctgcagagcagggagcacaaacctgctctctcagcagccacttggcaagggctggttgtggatcccagccctcaccctctcctggcctttcctctgctctcctctgctcaagtccacttctaacctggtcttcggagctgggttggccccttctttgggctcaggaagcagccttagcacacgggcctctcctccctcactactgggtgctgccctgcgtggctgaccagctggcccaggatttcacagtcgaaaaggaagccaccactgatgcctcccactgtgacaggccctgtcaccaccaatatcttatttcaacctcacagttgacctgagaaatcgagattatcactccactttttcagacaaggaaactgaggctcagggaagccaagtgacaagtccaaggtcacgaagactttcttggagcccgaaacaccaccctctgctcctccttctcctgtcctggcccaggcatcctaggggctgaaatcctggaaaccgtgggctggtgtgagaaggtttgcatgctcagagcagagaagggctctccccactgcttcgtgattccagggccagagccatgcagtcccagaaaccccaacctagctggggcaggtccagagtccaagccctggtgggtagaggccaagcagaagccctgaagtggactcttgcttcccctagtagtgttttcagtgccaagaagctgaaactgtgagctggagttggggagaggtctggaagaggaccatctgggatttctacagcctgggtacccatagccacaccaaggcttctgggagattctgcagggtcagctttccaggctgttcccaaatagctccctgcctccccactgcccctaaagccacagcagaagagccattcatctcataaacaaaaaggaagaggaaagaatgaggaaggaccctgtgcaaggttatttgcaggcagggatgggcttgtacctgacagcacccacccctgtgtggcccccaggccctcatcaccctcagacccctcctaagcagttccctcattgctctttggactaggctgacagcaggaagagcagggcccatgaccgggtggaagttcagttttggtgtctgcttcaagagggggttttacactctgattccaggacaagcactctgaggcgggtgggggagagaaaccctggctcttcacccaggtttcacacacatgtaaatgaaacactatgttagtatctaacacactcctggatacagaacacaagtcttggcacatatgtgatggaaataaagtgttttgcaatctt

SEQ ID NO: 1238 - DNA, 2569 bp, Homo sapiens
acatacttcctcaccagacaccaccaggagttctcagcccccaaaacctgtcaccgatcctcaccaggctgtttgctctaccctctcccccaactcaagggctcccgtcctcacctccctgcaacactgctcctagaaccatgtctgtctacctggagacagccaggcctattcccttctgggtctccagtgtccctttttctcacaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggcggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctccgcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtattttt

SEQ ID NO: 1239 - DNA, 1891 bp, Homo sapiens
agttaccagctttggctgctcgcgcctccccaactcgggtaaagctcctcggcctcggcgtgctgcgcctccgcggctgccctgcgccagaattcggttccctcaaaattataaaggcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagaggttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggtactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcctggaggagatcgaacaggcacccacatgtctcaggcaaaaatcacatctgaacttgctaaagttatcaatgatggcttatactattatgaacaggatctatggatggaagaagatgaaaacaaacacacagccataaagcaagaagttgagaactttaagaagctaaatctcattagtaaagagcagtttgaaaacctaacacctgaacttccttttgagccaaaccaagaagttcctgtagcaccttcacagtccaggcaagatttgactgatgaattagctcagaagttatttgatgtttcagaaataacttcagcagcaatggttcattcgttgcctacagcagttccagaatctcctagaattcatcctacaagaacacccaaaacacctcgaacacctaggttacaagatcctaacaaaacaccaagattttatcctgttgttaaagaaccaaaagccattgatgtaaagagtcc

SEQ ID NO: 1240 - DNA, 2816 bp, Homo sapiens
gcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaagcaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgtacagcaaatccttctaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagcctttgcaaaatgttagcacagtgctgcagaagcctaatcctctctataatcagaatacagatatggtccagaaatcagtcagcaaaaccttgccctctgcttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccggtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcatcaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttccttt

SEQ ID NO: 1241 - DNA, 1929 bp, Homo sapiens
aaagctaaccctcgggcttgaggggaagaggctgactgtacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggttgagatccgtagcattttagtgtccgagaggataattgctaagggagcagagacctcttcacaccttcatgcgcttagacctgcctagaggctcagatggctcagtggcactgctcacagagaacacaggctggaggacatggagtcggggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatggaccaaggatccactggggcaaacagagaagatctacgtgttagatgggacacagaatgacacagcctttgtcttcccaaggctgcgtgacttcacccttgccatggctgcccggaaagcttcccgagtccgggtgcccttcccctgggtaggcacagggcagccggtatatggtggctttctttattttgctcggaggcctcctggaagacctggtggaggtggtgagatggagaacactttgcagctaatcaaattccacctggcaaaccgaacagtggtggacagctcagtattcccagcagaggggctgatccccccctacggcttgacagcagacacctacatcgacctggcagctgatgaggaaggtctttgggctgtctatgccacccgggaggatgacaggcacttgtgtctggccaagttagatccacagacactggacacagagcagcagtgggacacaccatgtcccagagagaatgctgaggctgcctttgtcatctgtgggaccctctatgtcgtctataacacccgtcctgccagtcgggcccgcatccagtgctcctttgatgccagcggcaccctgacccctgaacgggcagcactcccttattttccccgcagatatggtgcccatgccagcctccgctataacccccgagaacgccagctctatgcctgggatgatggctaccagattgtctataagctggagatgaggaagaaagaggaggaggtttgaggagctagccttgttttttgcatctttctcactcccatacatttatattatatccccactaaatttcttgttcctcattcttcaaatgtgggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgtcaacaaatttcaggctaaggatgccccagacccagggctctaaccttgtatgcgggcaggcccagggagcaggcagcagtgttcttcccctcagagtgacttggggagggagaaataggaggagacgtccagctctgtcctctcttcctcactcctcccttcagtgtcctgaggaacaggactttctccacattgttttgtattgcaacattttgcattaaaaggaaaatccac

SEQ ID NO: 1242 - DNA, 2338 bp, Homo sapiens
gtgcagcggctgccacggagctcgcagctgcggcttctgaggagtaagcggcgcggtagcgaaggccgccgaacctgcctggctagccggcgacttgagtgacgactcttttgaaacagatggtcaccatgtttagatattagcagtcccatatatgcatgtctgcatttgaaaatggaagagggaaacaacaatgaagaggtaattcacttgaacaactttcactgccatcggggacaagagtggatcaatctccgagatgggcccatcaccatatctgactcctcagatgaggaaaggattccaatgctggtcaccccagctcctcagcagcatgaagaagaggacctggatgatgacgtcatcctgacagaaacaaataaacctcagagatcacgacccaatctcatcaaaccagctgcccagtggcaagatctgaaaaggttgggagaagaaaggcctaaaaagtctagagcagcatttgaatcagataagagcagctatttttcagtgtgtaacaacccattgtttgattctggggcacaggatgattctgaggatgactacggtgaatttctggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttacttccagtctctgaaccaacagccccgtgaaataacaaaccaggtcgttcctcaggaacggcagcctgaagcagaactgggccgcttgttgtttcagcatgaattcccagggcccgcttttccaaggccggaaccccagcaaggtgggatttcaggcccctcttctcctcagcctgcccatcctctaggagagtttgaagaccagcagttagcaagtgatgatgaagagccaggtccagcctttccaatgcaagaatctcaagagcccaatttggaaaacatttgggggcaagaagctgcagaggtagatcaagagctcgttgaactactagtgaaagaaacggaagcaagatttccagatgtagcaaatgggtttattgaggaaataattcattttaagaattattatgatctgaatgtactttgtaattttcttctggaaaacccagattatccaaagagagaagacagaatcattataaatcccagtagcagtctgctggccagccaagatgagacaaagttgcctaaaatagacttttttgactattctaaattgacccctcttgaccagcgctgcttcatccaagctgctgacctcctcatggccgacttcaaagtgctcagtagtcaggacatcaagtgggccctgcacgagctcaaaggacactatgcaatcacccgaaaggccttgtctgatgccattaaaaaatggcaggagctgtcaccagaaaccagtggaaaaaggaagaagagaaaacaaatgaaccagtattcttacattgatttcaagtttgaacaaggtgacataaaaatagaaaagaggatgttctttcttgaaaataagcgacgacattgtaggtcctatgaccgacgtgctctccttccagctgtgcaacaagagcaggagttctatgagcagaaaatcaaagagatggcagagcatgaagactttttgcttgccctacagatgaatgaagaacagtatcaaaaggatggccagctgattgagtgtcgctgctgctatggggaatttccattcgaggagctgacgcagtgcgcagatgctcacttgttctgcaaagagtgtctcatcagatatgcccaagaggcagtctttggatctggaaagttggagctcagctgcatggaaggcagctgcacgtgttcgttcccaaccagtgagctggagaaggtgctcccccagaccatcctgtataagtactatgagcgaaaagccgaggaggaggttgcggcagcctacgccgacgagcttgtcaggtgcccgtcctgtagctttccggctctgttggacagtgatgtgaagaggttcagctgtcctaatcctcactgccgaaaggaaacctgtaggaagtgtcagggactctggaaagaacataatggcctcacctgtgaagagctggctgaaaaagacgacatcaagtaccgtacctctattgaag

SEQ ID NO: 1243 - DNA, 2208 bp, Homo sapiens
ttttctctgtggatggcaggatgtttgaacctagaaaccccatttctaagttaccatgaaatccacattgtgcagggtcttcctgagtgctgccagggatacaaagaagtttccatggcgtccctgttctcacagggcttttagtgccaacgaggagagagaaatgggatttgtgaatctaaaatatgggtcagaaatactgcatgattcccttatataaggaatctaaaataggctcatagaggcagagagtgaaaatggtggttgcagggactggggcaggggaggaggaagtggagagttgctgtgcagctgatataatgtttcagctatgcaagatgagtaagtcctggatatgggctggacaacgttgtgcctacagtgaacaatacagtattgtgcactgaacagtttgtttagagggtagttcttatgttaaatgtccttatcacaataaaacataaataataaaattaaatgttggttgagatggcaatgagagaatgatattcaaagttaattgtgggaagactagtgtcagagcacattaggagtgtgtagtttcgagactgcggctctgggtagagggcagctgaggttgctggcaagtattctggcaaatgactcagcttggccaggcttacacacagagtgaccgggattggcacagaggcctggggtggtctcgcagagacagaggcctggaataggtcagaggcactgaatcaagggcccaaggggtgccaaccagcactactagcaaggtgcgtgcagaggactctgttgattagggccccaggttggcagcaggagagaagccatgtcacctgcagacctagggaaaccgagggaggttggggacatgggatgaaggctgttgtagaaattctggtatgggatatagggctagtgatgtctaagcagtggtgagaaaagcaagaccctttgtcagccctggcaagtggacgctgctgctgttggaaggcaccgggagaagggtgaggctgagacacagctaggacagagagtgcccacttctcctctggtgggtgtgggaccctgccgggcctggtggccataggacctggtggcgcaggaccccctcccaggtgcagtgtgggcagagaggtcccctgcttggcatgagcagacaggctgtgcgtccctggaaccacttcttcaccgcggtgtggacgtgcctgccggccagcagctggcttcctgtgggacacctgactcagccactgtgttctgcgctgtgcccctggccaggcatgagctgagcacatctcaggctccctcccacagggcctggtcacacgccccagggcacgtagtggctgatggtccttcctgaggggatggggccactcaggaggagggatgtgcaaggcctgagtgttcagagcatcccatccctagggggcacagggaaggtaggcagctgctctgggggaagggctgatgtgtggacccccacaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaatt

SEQ ID NO: 1244 - DNA, 2136 bp, Homo sapiens
aaggaagaaaggagccaaggaggcgaggcatggatccgcagcctcctccacccgcccagggcagcccacctcaccgtggccgaggccggggccgtggccgaggccgtggtcggggccgtggccgtggcagggggggcgctggagcccctagggcgcccctgccctgccccacctgcggccgcctcttccgtttcccctactacctctcccggcaccggctgagccactcggggctccggccccacgcctgcccgctgtgccccaaggccttccgccggccggcccacctttcccgccacctgcgcggccacgggccccagcccccgctgcgctgcgccgcctgcccccgcaccttcccagaaccggcccagctcaggcgccacctggctcaggagcacgcgggcggcgaggtcgagctggccatcgagagggtggccaaggagacggccgaacccagctggggcccgcaggacgagggctcggagccgcccaccaccgctgcagcaggggccacggaggaggaggcggtcgcagcgtggcctgagacgtggcctgcgggggagccttccacgctggctgcgcccaccagcgccgcggagccccgggagtcggagtcggaggaggccgaggccggggcagcagagctgagggccgagctggcgctggcggccgggcggcaggaggagaaacaggtcctgctccaggcagaccggacgctgctgtgtctgcgctgccgcgaagccttcgccaccaagggcgagctcaaggcgcacccgtgtctgcgccccgagggcgaacaggaaggggaaggggggcccccgccacgccccaagcgacaccagtgctccatctgcctcaaggccttcgccaggccctggtccctgtcgcgccaccggctggtccactccaccgaccgccctttcgtgtgcccagactgcggcctggccttccgcctcgcctcctacctccgccagcaccgccgcgtccacggccccctcagcctgctggccccgctgcccgcggcgggcaagaaggacgacaaggcctcgggtgcacggaactcagccaaggggccggaggggggcgagggggcggagtgcgggggtgcctcggaagggggagaagggcagaacggaggcgacgccgccccggctcggccccccgccggggagccccgcttctggtgcccagagtgcggcaaaggtttcaggcgccgggcgcacctgcggcagcacggggtgacccactcgggagcgcgccccttccagtgcgtgcgctgccagcgggagttcaagcgcctggccgacctggcgcgccacgcacaggtgcacgcggggggcccagccccgcacccgtgcccccgctgcccgcgccgcttctcgcgcgcctacagcctcctgcgccaccagcgctgccaccgcgcagagctggagagggccgccgcgctgcaggcactgcaggcccaggccccgacgtcgccgccaccgcccccgccgcccctgaaggccgagcaggaggaagaagggctcccgctgcccctcgcaaacattaaggaagagccgccctctccggggaccccaccccagtccccgccggctccccctgtcttcctcagcgcctcctgtttcgacagccaagaccactcagccttcgagatggaggaggaagaggtagacagcaaggctcacctgcgcgggctggggggcctggcctcctgaccttcgccgccctgccctccgccgctccgcctgagctccccggtttgcagaatggaggagggaagttgaaggagccacctcctctgtctacccacccgtccccttcacgcccttgacactaaggagtggggggccctggactgccccttcctcccccatcgcccgcccccagaacccctgatgctggttaggaaccgctcaccccaacatgtgtcttaaggcaggacgacttggaaaaaaaggcggcggacagttggccagagggatggagactggtggggacgcccccgcctccctgtcccccgtttcacacactggacaccatcacctctttggaactgccagaccctgggggtccccagtgagcaaaggtctgtccttgtccctttgtctgtctgtgaataaatgtgagttcgtg

SEQ ID NO: 1245 - DNA, 1949 bp, Homo sapiens
gctaagcggcgccgggcgggagaagagcggagcagtggtcggagatgtggcgaccggtgcagctctgtcatttccactctgctctgctgcacagaaggcagaagccctggccgtcccctgctgtgttcttcaggagaaacgtcaggggccttcctccaaggttctccagccccacacccctgtggaggaaggtgctctccaccgcggtagtgggggcgcccctgctcctcggagcccgctatgtcatggcagaggcacgggagaagaggaggatgcggctcgtggtggatggcatggggcgctttggcaggtctctgaaggtcggcctgcagatctccctggactactggtggtgcaccaatgttgtccttcgaggggtggaagagaacagcccaggctacttggaggtgatgtctgcgtgtcaccagcgggcggctgatgccctggtggcaggggccatcagcaacgggggcctctacgtgaagctgggccaggggctgtgctccttcaaccacctgcttccccccgagtatacccggaccctgcgcgtgctagaggacagggccctcaagcggggcttccaggaggtggatgagttgttccttgaggacttccaggccctcccccacgagctcttccaggagtttgactaccagccaattgctgccgccagcctggcacaggtgcacagagccaagctgcacgatggcaccagcgtggctgtgaaggtgcagtacatcgacctgcgggaccgctttgatggggacatccacaccctggagctcctgctgcggctcgttgaggtcatgcaccccagctttggcttcagctgggtcctccaggacctgaaggggaccctggcccaggggctggacttcgagaatgagggccgcaacgcagagcgctgtgcgcgggagctggcgcacttcccctacgtcgtggtgccccgcgtgcactgggacaagtccagcaagcgcgtgctcactgccgacttctgcgccggctgcaaggtcaacgatgtggaggccatcaggagccaggggctggcagtgcatgacatagcagaaaagctcatcaaggcctttgctgagcagatattttacaccggcttcatccactcggacccacatcctggcaacgttctggtgcggaaaggcccggacgggaaagcggagctggtgctgctggaccacgggctctaccagttcctggaggagaaggaccgcgcagccctctgccagctgtggcgggccatcatcctgcgggacgacgccgccatgagggcgcacgcagccgcactgggggtgcaagactacctcctgttcgccgagatgctcatgcagcgccccgtgcgcctggggcagctgtggggctcgcacctactgagccgcgaagaggcggcctacatggtggacatggcccgcgagcgcttcgaggccgtcatggcggtgctcagggagctgccgcggcccatgctgctggtgctgcgcaacatcaacaccgtgcgcgctatcaacgtggccctcggcgcccccgtggaccgctacttccttatggctaaaagggctgtccggggctggagccgcctggcgggcgccacgtatcggggtgtctacggcaccagcctcctgcgccacgccaaggtcgtctgggagatgctcaagtttgaagtggcgctcaggctggagaccttggccatgcggctgaccgccctcctggctcgtgctctggtccacctgagcctcgtgcccccagcggaggagctctaccagtacctggagacctagggtgcagccgcccagggccggcggggcccttttcaccttgggctgacggaggtggcggggctagaggtgtagacaccccgagccccgtgggcactcgcactggggggctgtgacagcagctgggccaggaggccgtgtaatgaccacacactcctctcaagc

SEQ ID NO: 1246 - DNA, 2797 bp, Homo sapiens
gttaacaataacttaccatgtatttcaaaatggttagaagaaagatttggaatgttcccaacacaaataattgataaatgtttgaggttatggatatgcaaattatcctgatttgatcactacatattgtatgcatgtatcaaaatatcacatgtaccctagaaatatgtataattgtcatgtatcaataaaaacaaaaagggcctatttctctttgccttcctccccgaattccctcctgtcccagatatgtgttgttcctggtgctctcctgccccccgttcattcagcactgagccagcaggaaggatctcacaggtcatatcctgagatccagccctccaccccttcaggtaataatcctcctgctcttggtcattcgtatcctttggttcatagatattttgagtctagtgccttctaattgctgacctaaataataacccttggtttttaaagataatacaaagtggatttcagtaacaatcttgagtcttcacagaagctaatgaagtcagggattccatgaagccatccaagcatatagagctcatttccctgggtcccttttccttagctcaaggccacacaaaatcagaacatgaattccagcccacatttgcattatgtcgaaataattatgagttacaaatgaagctaacaaatagctaaatatgttctattcatctactttgataaatataccgccataataacccacaaggtcaaagttgagtgtagaattctcagattctttggtgctctgcacgagaatgtggtagcagaaggagagccaatcctcagccccaggccaaacttttccctttcatcgtaggtagccctgtcctcacttgagaagccttgcgtacacccgtgtgggggactccctaggccccatgcaagctccatccacatttctcaccccttcagacagcagagtcttgggcaccatttggacaagcagagtttgcgctttgaaataaacccaggggagaggccatgcaggctcaggcacatttggccaggtgtctgagtgcccagagtatggcctagaagagaacgtgagagctctgggtgggccggggtacagtcagtggagggccagagaggcaccttctcaagcgcaggattcagggcaggggtcctcttgccgagatggatggctacgattgctcagtgcaatggcgcctgcgtcatgtcttctcagcgcatctttcactcagtctcagccaccatggggagttccatggaagcgcaggcttcccctgtgctgccagtaaactcaagctacactttctgccccagggcatctccattattttggagattataggattttggctgagcacaaacacacagcccagaaacacttgcaggttaacagcctcaggggaagatctcaaccagtgtgggacaggtgggcaaatgctccaggctcctgtttcaggtggacagttcgggaagactttccggagactctcagaaggttctggcagaaaagaagtccatggcagcagcctcaatagcatgcctcaatagcaggcctcaggtgatccgtccaccttggcctcccaaagtgctgggattacagacgtgagctatcatgcccagcaacataacatttatatgcacaggaaagcaaaaaatgtcgtgtgactagctctattgcgatattcgccttgttgtggtgacctagaaccaaacctgtaatatctccaaggtatgcctgtacccctaaaagaagagctggagtaaggacctgggtgtgggtggtttatttgggaagtgatcccaagaagcaagagtgagaagtggggagagtgagccaggtgagaaagaaaagccaaaatgatggcattgtttgaaccccggaggcagaggtttcagtgagccgagatcatgccactgcactccaacctgggtgacagagcgagactccgtctcaaaaaaaaaaaagttgtgtttacactattgtagtcaattaagtatgcaatagcgttatgtttaaaatataatgtacataccttactttgaaaatacttgattgccaaaaaatgctaaccatcatctggtccttcatcaagtcgtaatcattttgctggtgcatggtcttgcttcagtgttgatggctactgacttattggggtggtggttgctgaaggctggagtgggtgtggcaattccttaaaataagatgacaatgtagtttgctgcattgattgactcttcctttcaccaaagatttcactgtagcatgctgtgcagtttgatagcatcttacccacggtagaatttttatcagaattggaatcagtcctctcaaaccctgctctatcaactaagtttatggaatattgtaagtcctttgttgttctttcaacaatgttgacagcatcttcaccaggagtagattccatctcaagaaaccacttctttgctcattcataataagcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatc

SEQ ID NO: 1247 - DNA, 1969 bp, Homo sapiens
gcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcacccctggccaccttcggaactttcccgtcgaccaggccccccgggactcccagggctccagggccctcctccggccccaggcctaccccagtcacggacggtgggtaccatgtgccagctcctggagtccacagtgatccaacctcaaggggacagccccgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagc

SEQ ID NO: 1248 - DNA, 2558 bp, Homo sapiens
aagctctgcctgtgcgaccgccgcccacccgagcctatctgggctgcgtcttctcgccgctgctcttcgtggcccaacgccccaatccttgcgtgtccttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggcccagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggcctctctggcagtgtcccaagagttcactggcttttcactctgaacaacaaataacagtgctgctgagacaagttcctagttcacctttcattgaagaaccagatcagcacagtagcagaatcttccgaactgacatttttcctttgagtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggagatagataaaagcccagaaggccagttcactcagctgatgacattgcccaaaaccttacagcaacagataaatcatattatggaccctcctggaaaaaacagagatgtggaagaaactttattccaagtggctcatgatcccgactgtggagatgtggtgcgactaggtacgtttatgaatttgatgttgaggaaatgccagccatggggaaaagcagactttgtttgtgattggaatgtattatttcttcctttttgtttagcgagatagagagattgcctctcagaagaagaaagcactaaaaatttgagggttttctaaatctgcatttttatttgtttgaagtaagatggtgaaaatacttctgtttttaaattcctggatcctaaatcactgtcaaagggagaaacaatgtttcttttggttcctagagcacaacttctagaatttatttaaaagatgtgtctgtgttttgtggtggtctgagaaaagagattggtggcatttttttgtgcttttataacatcgagaacacagctttcctcaatcaactccatttgatgtgtctcatacattgttgagtacattccctcagacatggcccacgttccacagcattttccccagcactgccctgatgtttatccaaaactctgaacccaggccaggtgcagtggctcacgcctgtactcccaacactttaggaagtccaggagggagaatcacttgaggccaggagtttgagaccagcttgggcaacagagcaagaccctgtctctgcaaaaattacaaaagtagctgggcatggtggcacatgcctataatctcagctaacttgggagtctgaggtgggaggatcgcttgagcagttggaggctgcaatgagctaggatcgcaccactacactccaggcttggtgatagagcagcccgtatctcttaaaaaacaaacaaaaaaaagagcctgaaccttatcttcagagactaacttccctttaaggtgctaaagtaaatatttactgagctcctccgcgtgccagatagaatttccagtaatgctttgcaaagaccatcgcactgcagtggatgagctgcagcaggcgctccacgcccactctcctcctgggcctgcactaggtttgcagagtgtgtgtttaggtcaccagctccccatcctgaagatagctctgtacgaggcacactgttgtttgtttgaacatgatcctggcaacagtgtgatctgggccgtctctttgagggctttcagcaatcgtgagaccgtctagtataagacagagcacgaaaggcatttttactgctggcctgaagaagtcagtgatttatagttcactaaaactgcacaaaatgtggaaagggtggctgaggaaaacatcctgattttgcttgcttttatatatgttatgtgtagatgaataaagtgtttgatcctttttgac

SEQ ID NO: 1249 - DNA, 2644 bp, Homo sapiens
aatgctccggcagtcctgttccttcccggttacgtcccttccagcccttggcggagtctgcgggcgagagggcgcaggtgcagaggtgccgccggcggcgtgcggctgcgaaggaagggaccccgacaccgagcgttcctgcggacgctcctcaaccgggggttgttctccgtgctctggacccggcccttcctcacctaggacgtctcgcggtgcactgtccccctctctcgggcgacttttcccccacatccaagtagtgatcaagctcagaatccagctcgcgcccgctgtgcacctagcacttcccacctgtagtcttttgacctcatcgccccctctagaaggctgctgccatcgcttaaatgaggaagccgaggtgcagagaggtttcagacctattgcggtggagctggagttcgagaaccaaccactcggtgctgagacgcgcttgcggaacgggcggcgggcgggggtgaagcggagtgaggggagaggccaggtgcgacccgggcaggtgaggagcacgggcccggagggaggacttacgagaatggaaaggaaagcagcccgtcttcagtgggacagtgggagcattaagatgtcagagaatgagcagttgtgggaagagccatagggtattttattttttagagatggggttttgctctgtcgcccaggctgcaacctcgacctcccgggctcaagcgatcctcctgcctcagcctcccgagtaactgggactacaagcaacgcgccaccacactaaatctttaattttttggggggaggttgaaggtgggggcgggacagggtctctctccgtctcccaggccagagtgcagtggcgcaattacggcccgactcctgggctcaagcgatcctcccacctcagcctccggagtagctgggaccacaggcgcccaccaccacgcccagctagtttttgtatttttttgtagaggtggtgttttgccatgtttcccaggctggtcttgaactcctgagcgcaagtgatccacccgtctcagccttccaaagtgctgggattacaggtgtcagccaccacgcccggccctaaatatttttttaaaagttggatttttcatggtgcccaagggaagagacactcctttccttttactaagaccatttcttttagaaaactttgtaataggaaaatctttctttgccctcttgaaatgtatgtaaattttttaaaaagctgcataagcctcttgccagttttataaaccaggaatttctttcttaaggacctttcttaaggaccttggagtgatttctttgaaataaaaaggccaaggaagatagcttccctccttgtctctgtgggagtttagcagatggctggctccaagttgcaattacctgcttgtcatagagacatgaggtttattttaactttggataaaggcagttagctaacacagatggccgccccaagtaccacgtacctgccttctcgtttagaaacactgtgggcattaggggcaactcatgcagaagacccaggaatcttccaggtatactccatgggatgcctgttccactctggcccattggcacaagctagccttttcttttaaggatagtggggtccgttctgagagcggcctttgcaacatctcacttcccctgttgactgttatttcttttcttcctgctttcctactcccttgatcccaaactcactaggggtatttagtgagcacttactgttgcagtaagactgtagccaaggaagacgaagagacagttggagaccaaagagaacttcaattcgggcacccgagcctagagcaggctcatgcccaaaatggctaccgacccagacaaagaaagcaggcttgcttatatgtcgtttcaggcgtgaaaaacaaggcaggatacaagtttcagacaaagacagtaaattattcaacctgtgacaattctgagaaaacttacatttagttatcttgaccagtcaaccttgaagctggacagagctggggtaagggaaaacaggaattacggaagtatgagggagtcgcgaggccggagataagcttggaaggttgagataagctcgcaggtgcaacttcttagcaatgctgagagtggctgcttaaatttcttagcctatgtataacttctaaatagcctacactaaatggtaactattacctatgttgtgtttgttattttaaactttaatgttatttattttatttcattttccttccacattacctctgctgttagcagctttgagaaatgctgctataggatgtgggaggtcattaaaggatttaagcagggagaggcaagatcagattaacatttcagaaaaatatttactgttttccagctgaaactagtagagtacaatttactttctggtcacagcacacagcagtcacatcctggaggaactgtacttctctaagatctagtctgtcctgtggtttaaatgacctttagcaaattgtctttattactttgtacactgctttcaccagtctgctcttccatggctaacggggcagaactgttatttttagggttttccacatccagtatgttcataagatttctaccctgtgtgaacttccagatgtcgaataaaggctggatgctgacc

SEQ ID NO: 1250 - DNA, 2374 bp, Homo sapiens
accacaggaatcttgttttctaaccggccgtgctggtggacactgcgcaattttgcacttggagcgcttaagaagttcgggttgggtacgcggaccgtcgaggcgcgcgtcctggaggaggcggcttgtctgctagacgaatttcaagccaccattgcttcggcctggccgggagagcggaagggcctggtgtgggagagtcccttgcactgccaagacggggccactggaaggtatttgggtggaagaaagccagtaagcccatggggctggctgggggcaggaccacgcgttatgaccaccgtcctgttcctacccccaggagccccgtttgaccccgtgcggctactggataatgctgtatccaatgttatctgttcttgtcttcgggaaccgctatcgctatggggacccggagttcctgaggctcctgaacctcttcagtgacaacttctgcatcattagttccagatggggcgaggtgagagggccggccacaatctttccttggtgcgtccagccttatgccaaatcccgagtacacagacctacctacaatggatcattagaatgggacagattcctggaagagttctagaacatccagtatcaaagtcctagtccaatctccctgtagggaaactaaggcctagtggccttgtgcagggcccatgttgagacagaccctgtctctccagatgtacatttgcctgtccctcatggactggctcccgggcccgcaccaccgaatcttccgaaacttttcggagctgcgggtcatctctgagcaaattcaacgacactggcagatgcggcagccagcggagccccgcgatttcattgattgcttgaccagatgggtaaggcatgggtcccagctctctaaactctatccatgccgcccaccaacaggtgcctggcacgcggcagcacatctcctctgcccacagtaacagcaggacccggagagccatttccaggagtagacgtcggtaatgacgacgcattttttttttggcgtcaccgaaaccacgagcaccaccctgtgctatgggctcctcattctgcttaagtacctagaggtggcaggtgtgcaacccggagagacccagaatgggaggctgcagtctggggatggctggagggtcctggaagtgcgcagctcacagcctcccccggcctgagccaaggtgcaggagctggaccctgtggtagggtggaggcccgccccaagcctggactatcgcgtgtgcctgccctacgccaacgcagtgctgctcgagatccagtgcttcatcagcgtggtgcccctggggctgccgcgcaccctcaccctcgacacccacctgcacagccactgtctgcccaaaggtacccactgagtctggggatcccgtgcgggacccgggtgcatgagatcagccagaatcagcaggtgtgcgctgtgcagaccaaaacacaatcagttacccctggagcaggagggcagctctgccttcccttaggctttttgttgttgttgtttgagacggagtctggctctgtcattcaggctagaatgcagtggcatgatcttggctcactgcaacctccacttcctgggttcaagcgattgtcctgcctcagcctcctgagtacctggtattacaggcacccaccaccacgcctggctaatttttgtatttttagtagagacaggtttcgccatgttggccaggctggtctcgaacttctgacctcaagtgatctgtcctcagccccccagagtgctgggattacaggcgtgagctacttgcccggcctattcccttgggcttttaaaaagcgtcttggatggaggtggtgcaggtgctcaccaagcccgcaggtaacccaagttgcatgtatccccagggcacttttgtgattcccctgcttgtgactgcacaccgggaccccactcaattcaaagacccagactgcttcaaccctaccaacttcctggacaagggcaagttccagggcaatgatgctttcatgccctttgcctcaggtgcaggcagaggaggaaggggaccagcctggactggctctggggtacctggtgctcactgtgcacctgtgtacccggcaaagcagatgtgcctgggcacaggcctggcccactcgggtatcttcctattccttacggccaccttacagaggttctgcctgctccctgtggtacgccctggcaccatcaacctcacctgcagtgcactggcctgggcagtgtccccccagacttccagctccagccagtggcctgctgaggtcaggctccactatggtgggctcactggccctcaaacctccataccctcctcggtcaataaaggccctaaattgcagatgg

SEQ ID NO: 1251 - DNA, 2447 bp, Homo sapiens
ataagcccagtgaaggcccagtgtggctggtggggttgctctggtgtgggactcagggttggaggtcatttcaggcccccttattggcctccccgtcccctctttgcctgccccagttgtgacaccggctatcagcatgggaacctcttcatgtccttccgaagcctcttccaggatgtgactgatgccatgaataacatccaccagtcgggctgtctcaagaagaccctggaggacttggagaaatatgtgaagaaggatccacgcctccccatcctgctggggaagatgaaggaggttgggaaagtgtttctggccaccaacagcagctacaactacaccaatgccatcatgacctacctgttcagcatcagtgaggtgagtgttggagtgttgcgtgcacggctggggtgggctgtgcaaagggccagggtgccaggctgcaccacgatgctgagggcctctcccacgtccagcctccctttgaggaagacctgagtgtgtgagtggtcatttctcatgagtggaagctccccagtgggtaggagcctggtgacctcagccaggccctgggaggagcctttgggggtgataggaggcagtcaggtatgtggggacgggcggcagaaagtgggtgagacgagggcatggcaggtcaaagggaggggtgctgggagtgacaggtcctgggcactgggagtgaccaggtgtcactgggcaggcagcagggccctaactaggtagccgtgctggtgccacctgtccctgggtctctgtgctgtgaggagctctggagcctggcctgaggctgcacatgatgttcaacacccacctccacaaggtccttttgagcacttcctagtgcccagcttggctggggaagctgggcagcgagaccgggttcccaggggctgaagaggtctcatccagctgggaggttggtggggagaggcaggctgtggtgggtgactggctgtggcaaggtcagatttaccaggctgtgtgtgtgcagcccgtgtgcacccccaacaggctgaagcctcgggcaggccctggaggtcctactttgacctgatcgtggtggacacgcagaagccccacttctttgcagaggggttggtcctgaggcaggtcaacacggtaatggcaggtgcagaggtcagtccacctgcacccatggaccacggttggggagggcagcctgcctgccccttagacttgacctgcctttatagctggcagctctgctggcctgtctgtccctggaggcagggaacccgaggccgccttcagcgccctctgctgcctccttcctcccacaccccccatggttacctctgccactcccagctccctgcgaccctccctagctagagaccaaagatgtggttctcctggctccagggcacccctctgcccctccaggactcaggaaagctccacgtgggcacctccacagggccccaccagcactgtgctgtctactctggaggctcttcggacatggtgtgcgagctgcttggggttcgggggatggacatcctgtacattggggaccacatttttggggacattctcaagtccaagaagcgtcagggctggcggacttgcctggtggttcctgagctgtcctgggagctggacatctgggcccaggagaaggagcggttggaggagctgaagagactggacacgcacctggcagacatataccagcacatggatgggagcagttgtgagctgcaagtcatcaacttcaccaagagagagatccagatgccacatgagtcagttgtggagcaagaacaggccaatctagaccctgcctcctgcctcctctcctgcaaccagaggggttagggcaaagagagaaacgaggatcaggaaagttacatcgaggctgacggaatcctggacatgggctggcatcacgggccatcttctacttgagatatttttcagataacacaagtatggaaaaaggaaaaagcaactgtattgaaatctcctaaatgcagcagatttggagcctgcaaacacttcttttagggaggaggcagtattgctcttaacctagaaggcatcctcaatggtctttgagacgtttggaaacgtgtgcacaagtgaaattattttacctacttctcttgaacgcatgatgtctcatatccaattttatttctaaacatttcttttaaaaaatagttatttctgtgcacttctgattctgttactagtaagaacagtaaaacctgattggctatatattgcctcactaactgctctttcattctgggtcactacgaaagatgttaaatgagatagcccaaatgtctttgagtttgtgtatacacattaaaacacataaaaagtcatactcatgattttaaaacttgactctcgaatgtgttagaagcttctctgtggtattaaagtgctgaagcatc

SEQ ID NO: 1252 - DNA, 2406 bp, Homo sapiens
ctgctgctgaggcggctctcggtggaagagtccggtctgggcctcggcctgggcccgggccgctccccgcacctgaggcgcctgtcgcgcgccggcccgcgtctgctgagccctgacgccgaggagttgcccgccgcgccgccgccgtccgcggtgcccctggagccgtccgagcacgagtggctcgtgcggactgccgggggccgctggacccaccagctgcacgggctgctgctgcgcgaccgcggcttggcggccaagcgcgacttcatgtctggcttcacggccctgcattgggccgccaagagcggcgacggcgagatggcgctgcagctggtggaggtcgcgcggcgcagtggcgcaccagtcgacgtgaacgcacgctcccacggcggctacacgccgctgcacctggctgcactgcacggccacgaggacgctgccgtgctgctggtggtgcgtctgggtgcccaggtgcacgtgcgtgatcacagcgggcgtcgcgcctaccagtacctgcggcccggctcctcgtacgcgctgcgccgccttcttggcgatccaggcctgcgaggcaccacggagccagatgcgaccggtggtggaagtggcagtcttgctgccaggcgccccgtacaggtggccgccaccatcctcagttccaccaccagtgcatttctgggcgtcctggctgacgacctcatgctccaggacctggcccgaggcttgaagaagtcgagctccttcagcaagttcttgagcgcctcgcccatggctccacgtaaaaagacaaagatccgcggtggtctgccagccttctcagaaatctcccgtcgacctactccggggcctttagctggtctagtgcccagtttgcctccaacaacctgaaggtccctggggctaccacctggttgatctatcgtggcctgctcgtcgcagtccaaacccgcccaagactgcagcccaatcaacgcctggagcctcattctgtttccagctttgtccagggcagcctgttttacccagatgggcctgcacctccagcttctttctgaagcatgacccatctccagagatgggatttgagaaatcagtgagagcttcctataaagaactccaggagacaggcctgaactctagagggaacttgaaatccagggtcaaaggttaaggggcagcagctggtctggcccctgaaagccttcacctgatgcctctgcagctacacaatcccaagacagagctagagcaagggtctctttaaatgttgaaagatgttaggttgtcagctttaagatatgtggtggttttgtaatttgatgcttttattctgtttttaaattgaaatgaggtaatgcaactttcgtaataaccttttggaattatatttttccacttttaggcaaagtgcttagacattttcaattttttttttgctaaatactttggaattctatttaaaaaatagatgatcaagatctaaaggaaattaatcccaaccaacaaacttaaaagtttatctacctcgttttaggcaatcaaggttctggagagtcttgaacacagaataacgattgtgaccattatgaatgtaactaatttcagttgtactgtgaatgctaaatatttgcaaacaagtacatcttgaaagtaaaggtgacttagagaaaagagacattttgacagatacttttaatttgtggttgtctccatcatgaaatagaaacgtgtttggcacttgtgggtggctattttgatttggcatgactacttaattttttaaaaaaattgtggtttgtgaattgcacctttgtgccatgtttctgaatctggttttcaaatccagtggagcctttcagtgaaataggtgactattaaaaaagtaatagtattacagaaaaatgagcgattaaatagtaatggatacaattaaggagcaactattttatatgactgttctgtacaaacaaaaagtatgtaatacccattttaaaaaaccatttgaaagtagacaacttattccaaaatagcaaatgcagaatctctgctcagtgagcttggatgagtggcttaacttctctgggcctttgttcctatctgtaaatgagaaagtttgtagatattgccaagatttcccaggctcaatacagtgtaattattttatgttttaaagatatgaaatctgtttactcaaccaattttttaaatgtcatattgtgataatgctctgcttttgcaaattgtgtttgcatgtcattagttatatcaaatagttttgtggcatggggtagtggagcttccctccccacccccatatgtatcagtgaagcctttgaaattacttaaggcagtctttcatggaatgttttgattgagcaatgaaataaacagtcctccattttg

SEQ ID NO: 1253 - DNA, 2647 bp, Homo sapiens
aaaaaacagatccggagcgcgtggcgggcgtcagcgcggtggccagcgcgcagaggcgggcgcggaggcggctagaaggtgaccgcggatcccagcttcctgcagccagccctgaaggatggctgccatattgggagacaccatcatggtggctaaaggccttgtcaagctgacccaggcggccgtggaaacccacctgcagcacttgggcatcggaggggagctgatcatggcggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctctgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggattttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcggggcccaggcctgtggggctggttctcacctttgacagctgaatgttcctaaagaactgctgccccacagtgagggtgggagcagcggaacagggaatgccagacacaggctcgctgctgctggaaggcggggtgggactttcttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgct

SEQ ID NO: 1254 - DNA, 1800 bp, Homo sapiens
agagaggagcccagcactgggattccgaggtgtttccattcggtgatcagcactgaacacagaggactcaccatggagttttggctgagctgggttttccttgttgctattttaaaaggtgtccagtgtgaagtacagctggtggaatctggaggaggcttggtgcagccgggggggtccctgagactctcctgtgcagcctctggattcgacgtcagtagcaattacatgagctgggtccgccagtctccagggaagggccctgagtgggtcgcgaccatgtacggcggagggaacacatactacgcagagtccgtgaagggccgcttcaccgtttccagggacggatcccagaatactctatatcttgaaatgagcagcctgagacccgacgacacggccgtctattactgtgtgcgagatcatagaaattacgctgatactagtccctatgggaggaagtggggccagggaaccctggtcaccgtctcatctgggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccagtgattgccgagctgcctcccaaagtgagcgtcttcgtcccaccccgcgacggcttcttcggcaacccccgcaagtccaagctcatctgccaggccacgggtttcagtccccggcagattcaggtgtcctggctgcgcgaggggaagcaggtggggtctggcgtcaccacggaccaggtgcaggctgaggccaaagagtctgggcccacgacctacaaggtgaccagcacactgaccatcaaagagagcgactggctcagccagagcatgttcacctgccgcgtggatcacaggggcctgaccttccagcagaatgcgtcctccatgtgtgtccccgatcaagacacagccatccgggtcttcgccatccccccatcctttgccagcatcttcctcaccaagtccaccaagttgacctgcctggtcacagacctgaccacctatgacagcgtgaccatctcccggcccaagggggtggccctgcacaggcccgatgtctacttgctgccaccagcccgggagcagctgaacctgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccatgagaccctgcccaacagggtcaccgagaggaccgtggacaagtccaccggtaaacccaccctgtacaacgtgtccctggtcatgtccgacacagctggcacctgctactgaccctgctggcctgcccacaggctcggggcagctggccgctctgtgtgtgcatgcaaactaaccgtgtcaacggggtgagatgttgcatcttataaaattagaaataaaaagatccattcaaaagat

SEQ ID NO: 1255 - DNA, 2537 bp, Homo sapiens
tgtagagatggtgtcttgctctgctgcccaggctggtctcgaacttctggcctcaagcagtcctcctgccttagtttcccaaagcactgggattacaggtgtgagccactgcccccggccagcacccgtcttctggaacatttgtaagcatttctgttgggtgtgtacttgcgcgtggaattgctggctctcagttatgcacatttcttagaagatcctgccagtccttcatcccagaccccgaccccagcgtggaaaacgcagtgcatcctcaacgcctagtgtttgcggctgtggcggctcatgatcgacttggaaggcccacagtgtgtggtgtggagttttgcagggagccagtgacactgcccaccttcgatccagacctaaccttgatcctgttctctgaggccaccttaccaaaaccttgacttacccgtcttagatcacttaccctgggggaaatgtgccacaagctcacgagggcactcagccagcctacaaaggttaccatggcagagaactgaggcctcctgccagcagccagcagcagctgaccagccgcgagggcccctccgggaaggagagctttctgtgtttcttcctgtaccccatatatgttgacgtgatacgttttactttctgatttcccttgtgagatctttggtctgtgggttatttggaagtatggtttaatttccaaacatttagggttttcctccagattttgttgttgtttctggtttctggttttaattccactgtggtctcagaatatactttgctgacttccctctctttagatttgttgagccctgttttgtgcttcatagtgggagggtgattgtatgtgcacgtgcagatatgtgtggcccccacacggtatctccagctatccgtgtcttgcctctccgtgcccagtgcacccttctcagccctgccgtgtgaccctgggctgggccctccctgtaccctcctttgcaggttggcacagtgtttggctctgtcactggaaggagctggagggactccacaggagggaggggcctgccctcctggttccagtgtgcttgcttttcctggcttccgtggtgtgtgcctgccagcctcatggtgggggcgggggctctcagtgacagtctgcaggagtttagcaacacccaggttcattcaccacggtgggaaggattcctgctaagcttccttgcctctgtccagctcccagggcgtctgcctccctcctgccccagggagagcttctgggtgagtctcgctggcactcctgccccgggcttcctgctctcaggccttggcctgctgcaccttggccaactgcaccacccggcacatcatagccccactcaggtcagagctgcgtctcagccgacgtggggttccgaggttctcaccaagatccagactcaacgcttgtgggtttgttgtctcagtcctggcggtggaggttctcccgaggcctcagcgcctctgttctcggaagtctctttacatgttagtggaaccctctgttcctgttgaatcattcttcgtgttaaatgtttctatctcttgactgatacatgatagtcatcatgtatgtattctgcggctgcttttgattttttctctttatccctggttttctgtaatttgataagctttagggtatgtgtgtgtgttttgggggtttgtcaagatttgtaggctttgtcatttttatgcaatttggaaatattctagctattcggtctcttcccctgcctcctgcagtcccaggtactcgaatgggctgcttgctgtggactcatgggtccgtgagtctgctcatcttcttcagtttgcgtttcatttttggtagattctgtttccacgtcttcaagcccactgatcttttaagctgctgttaagctatggccattttctgtatgagccattgtgttttttcatctctataaatttggttttggtatttaaaaaaatgtcttccagctaggctggcggctcacacctgtgatcccaacactttgggaggttgaggcagggggattgcttgagcccaggagtttgagactagcctgggcaatacagtgagacctcatctttaaaaataattaaaaaggtcaggtgcggtggctcacgcctgtaatcccagcattttgggaggacagtggatcacaaggttaggagtttgagaccagcttggccaatatggtgaagccctgtctctactaaaaatataaaaaattagctgggcacatgcctgttgtcccagttacttgagaggctggggcgggagggtcgcttgaacctgggaggcggaggttgcagtgagccgagatcgcgccactgtactccagcctgggcgacagagcaagaatctgtcttaaaaaaaaaaaaattagccaggtgtggtggcacatgcctgtagtcccagctgctcgggaggctgaggtgggaggatcacttgagcctgggagtttgaggctgcagcaagccgtgattgcactactgcattccagcctgggtgacagagtgacggtctc

SEQ ID NO: 1256 - DNA, 2789 bp, Homo sapiens
tttttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagagacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggtttcggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgt

SEQ ID NO: 1257 - DNA, 2142 bp, Homo sapiens
catgtagatgcttcataaatatttgtagaatgaatgtatgagtgcttgtctattccattctcttgccaattctttagactcagacttacattataaagtattcatccctatccttgcattttattactacaaatttcatgcgtcaggaagtctgccttacatcttttcatcttaactggggatattcggacaggcacgacatgacacagggtctgggaattgatgctgacctcggggtgaggacatcaacgccccccagctcagctcgtaacaccttcatgagggtgtgtgtggctcagggctggccgagggaccccagcctgacctctatgcctgttttcttctctgcaggctccacaagttcttccctgtgtgaacactgggtgagccggctcccgggcagcaagccagccagcgtgacctctgcagcttcctccagacgcacctccctggcgtcgctctctgagtccgtggagatgactggagaaaggagtgaagatgatggaggcttttcaactcgaccatttgtgagaagtgtccagcgtcagagtttgtcatccagatcttctgtcaccagccccttggccgtcaatgaaaattgcatgagaccttcatggtccctgtctgctaagctgcagatgcgctccaattctccatcccgattttcaggggattcgccaattcacagctctgcttccaccttggagaagattggggaggcagcagatgacaaggtctccatctcttgctttggtagcttgcggaacctttctagcagttaccaggaaccaagcgacagtcatagtctccgtgagcacaaggctgtgggccgggcccctctggctgtcatggaaggcgtgttcaaagacgaatcggacacccgcagattgaactccagtgtcgtagatacacagagcaaacattcagcacaaggggaccgcctgcccccgctctctggtccatttgataacaataatcagatcgcttatgtggatcagagcgactccgtagacagctctccggtcaaagaggtgaaagcccccagccacccaggctcactcgcaaagaaaccagagagcacaactaagagatcccccagttccaaaggcacttctgagccagagaaaagcttgcggaaggggagaccagccttggcaagccaggagtcatccctttcaagtacatccccttcttctcctcttcctgtaaaagtctctctaaagccctcccgctcccgcagcaaagcagattcttcttccaggggcagtggacggcattcatcccctgcccctgcccaacccaaaaaggagtcatccccgaaatctcaggactccgtgtcatctccttcgccacagaagcagaagtcagcctcggccctcacctacactgcttcctccacatctgccaaaaaggcctcgggccctgccacaaggagccctttcccacctgggaagagcaggacttcagaccacagcttgagtagagagggctccagacaaagcttgggttctgacagagccagcgccacctccacctccaaacccaattcccctcgggtgagccaggcccgagcaggggagggcaggggggccgggaagcacgtgcggagctcctccatggccagcctgcgctcccccagcacaagcatcaagtctggtttgaagagggacagcaagtctgaggacaaggggctgtccttcttcaaatcagccttgaggcagaaggaaacccggcgctcgacggatcttggcaagacagccttgctctctaaaaaggctggtgggagctctgttaagtctgtctgtaagaacaccggggacgacgaggcagagagaggccaccagcctccagcttcccagcagccaaatgcaaatacaacgggaaaagagcagcttgtcaccaaggaccctgcttctgccaaacattccctgctgtccgctcgcaaatccaagtcttcccaactagactctggagttccctcgtctccgggtggcaggcagtctgcagagaaatcctcaaaaaagttatcttctagcatgcaaacctctgcacggccttctcaaaaacctcagtgatatttctgcaatcgaagtgttttatctgtaaagatgtttatttatttagaacccctgccctcccacc

SEQ ID NO: 1258 - DNA, 2559 bp, Homo sapiens
agcgtcgtggaaaggtaggagcaactatccctggggcttggtgatggctgggaggccgggttctcaagagcaaagcaaggataggggcaccggtagcctcccgccgccgtctcaacggcctctgggcccatcccctgagggggcggggccgtctcctccacctcccggtattccccgaggaggcggctcctcatcctccgagggtcctcacagctactttttgtccctcgtcgattcccagctcctcagaaggggcttccctctgacacccctcattcaaaggcacctcccaccccgcacctcagccttggcggagaggactcacaggtaccgattctctaggctgccgcccccaaccccatttcgtacccccggaaggccaaacatccctccctacacctgtccctgctcgccagggtgggactggagctgctttcctccgtaagataaaattggtgtttcccaaaaaggagggatggggcgaagcaaaaatcaaagaccgacctagacagccagctttacggaggaagcggcttctcccacttaagttcttcccatcccccattctctgatgctcagtcttcctcccgcagcccctcgcatcctctggcctcttgtgaggagtcgagagctctcctgttttgggactgttttggactgtgaaagagggagaactaggacctcctctccttcaccctttgtaccttccttctactttctgttccttctgggagcacccagcctctaagggtttcttaggtttgaattgcgtttcatttttccttttccaccctatttcctccctgagaacttgatgaaaagccatcttatatttcacagtgaggtgggtgtgttggatatctgcagagctggctttgtgtgggcaggaatgcagtatatgttgcttgacagtcaatgaataacaccatgttttcaaatgaaacagtatacataagtaaataagtagcagtggattaggaatgagtatatcccagtctagggtgggctggtccattgctcagggagactgcagttaaccttgaaggtatactgcaggttgaaacaaaagacaggaagtgtttgaagaaaattcagggtcagtcatctaggtttatgattaatctagtcctatgtcctttggtaactctctaaccccttttttatagtgtcctccccgcccccgggaaacattcatgtatattttgattggttttacgatcatctatcaaaatttagaggatgaaaagtaagaacaatttttaaatctcagagataagagtaaataaaggcaaggtattctagctattcatgtttaccaaaaagtgcctcttctagtgtgctcctaaaggttttgtcaagtggtcttcatttcagcaggtgcaaagtgttgattttgacctcatgttaatgtcgttgaatccccagtaatcatctattgctagcgcttttatatattaaaatttaccatgtttttagcatagtttcttttgcttccaatctcaagtctacctcccctctgtcagctatagccaaagctgatggcaataaaatgcaaggagttggaatcacggagggtgattgtaatgactgttgtcttttaccttcttgattagactttctgaaggtagacttcctaaagataattacttttgaatagttaggtttgaagttttcagagccactcggtgctcacaggtcttctcagtgattgtttccaaatctccagtaagaaagtacaaagaagaaactggagggtgtctctagcaaacgcaatgtgtgctgcaatagaagggtaagacgtgagctcccagcaataacagcagaaaaaactaaaagcagaacagaaaatcccaaaaggataagttgtattatatcaacagagaacagaaaataaactaaggtaagagactaagcaaaccaaagttgtgattgccgaggtttaataggaaaaagcaaataatattctcttattatttagcacagtaagcaagatctgtttgttacacttttgggtcttgaaaatctttcctttaaccttttcaacacctgtttggtcatgctaggtgaagaaaagcatagtatgcagaggatagatgtctgatctctctccttgaattataaattctttgagggcagatagtagtattttttgtttttcatctttatatctttcacagttcctagtatatagtatgacttcatgagtgtttgtttaacttagtttgaggctgtcaccttagggtagactgaaaggcaatgtactgattagatttggcacaatttgttagtataaacggcctacttgttgtcttcatttaacttgattttccccatcttctgtcttatgaaattccagtgtcttaagtgactaaaattttgaatttcttataaagaaatatctgtgaggcagggtgtggtggctcatccctgtaatccttgctacttgggaggctgaggcaggaggcttgcttgagcccaggtgtttgaggttacagtgagctatgatcatgccactgcactctccagcctgggcagcagaaagagaccctgtctcttaac

SEQ ID NO: 1259 - DNA, 1597 bp, Homo sapiens
ggaagtgcggatcccagcggcggtcgtgtagctgagcaggcctggggcttggttctatgtccctgtggctatgtttccagtgtcctctgggtgtttccaagagcaacaagaaacgaataaatctctgccccgcagcgcctccaccccagagacccggaccaagttcacacaggacaatctgtgccacgcccagcgcgagcgcctggactcggccaacctgtgggtgcttgtggactgcatccttcgcgacacctccgaggacctgggactccagtgtgacgccgtgaacctggccttcgggcgccgctgtgaggaactggaggacgtgcggcacaagctgcagcaccacctgcacaagatgctgcgggaaatcacagatcaggaacacaacgtggtggcactgaaggaggccatcaaggacaaggaggaacctctgcacatagcccagacccggctgtacctgctctcacaccggcccaacatgcagctgtgccgcgaagcagcccagttcaggtactgcctgggccactgaggcagtcccaggtgcccccgtccacctcctcgctgtgaccctctccaataaacactccaatctccacacacacatcccccacaggtgctgagaggggagggagagtttgcggccacacacaacacgcaagcacgccttaaacacacagatatagacatgacactgggcaggtcatgggtcgggggcctcccagtgccagggacctgtgcccacgtggtctcaccccaccctgtgctacctcatcttcccgggaggaagctccttcagacaaggtgagctcctggaggccacggggacagagaggccagagagggccattccctgctgccttgagggtgctgtccccacctctggtggaaagtatgacctacgcctgggctacaggcatagatgggccgtccttttgtttcccttgttaacggatgcctggtggccccttctgagcctaagtacctttcttccttccctgcccctcagttccttcaaggaactgggtgcctccttccgtcaaatatcaggaatgaaaagaactgagcctggtcggctgaggccagtcctgtcctgtcagggtcgagattgcacgcgggtcactcattcccactgaggcccgcgctccctgggaggaccctcgtaatttatgctctgccctagagccgctttcctggtgggatcctttcatggcgtcttcccaggacctcctgccagctcccattgggagttttgggtcccctgcaccccggtaggtgcatacttctgccctccccagccccagctcacacacccaacacccccaagctggtgagtgaggtggaggagctgaacatgtccatcacagcgctgtgggagaagcttctagaaggggagcagtccctttgcaacctcgaggacatccacatgagcctggagaaggatgttaccgccatgaccaacagtctcttcatcgaccgccagaagtgcatggcccatcgtacttgctacacccccatcctgcagctggctggctaccagtgagcagcggcacggtgcttccccccaatcccccaaataaacagtgcattagctttc

SEQ ID NO: 1260 - DNA, 2179 bp, Homo sapiens
attttgatgcagtcattgcttttcatttatgagctgaaccatgaaacttgcccttatctactattggtttcccagtggtacagtttatataggaaacgagaataaatgctgattcttcttttatgtacttactttcaaaataatgagttagttccttggtatcatgcaacagtgaccaattttgtgtgtgtgtgtgttttgttttgttttttaattgttaagacattcctatgccaaatacagcacgatagaagttgttagtcatcttggtaatataaaaacttttaggataacttacagtcatggatcgtgaccttccagggttctgagtgttgaaaatgactttttttccaatcttaaaaatatcacaacatctttgatgtgacttgggcagggagtgggtaagttaaggttgatttatgctgggcctcatctccagccacacttgtggccgcctaggagcattgatgacattcatctgaatcagcatgtttggtgatgatgccgagtcactaggactttggccaagatcttgatgtgcagaccccaggctgttccatcgctctaatttaaaccctttctccttcaggaggtgttggaattggccttctccatcctgtatgaccctgatgagaccttaaacttcatcgcacctaataaatatgagtactgcatctggattgacggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccatgagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgtacaaac

SEQ ID NO: 1261 - DNA, 2823 bp, Homo sapiens
attaaagcgtcatgggcacacagaggagtgtgtgaatcctgagtgtacagcttgatggattacacagagcgaacacactcacgtaacactggatcacgaagcagaacctcaccagcccctagaaggccccttttgcccctttcggtgccctcaccccaagggcaaccatcatcctgaactttctcaacagcatagatgagttttgcctgtttctgaactttatagacacggaaccttgttcttttatctctgaccttttgctcaacattacatttctgagatgcatccgtattgttgcatttagttgtaggttgttcattttccttgctgtggaagattcagttgtgtgggtgtaccatgatttatgtatcctttatgttgttgatgggcacttgaggtggcttctggtttggggctattacagacagtgctactctgaacattcttgcacaagtcttttggtggacatacgaacgtacttctgtcaggtattttcctagaaggaggattgctgggtcataaggaaataggtatattcggctttagtggctatggccaaatggttttccaaaatggttgtgccaatttatattcccttcagcaggcaaacatttttgcacacattctagatgtagttgtacctgtgaaaaaattcctgtcctcagacatgcactcccatctcctggtgtgtgcagatcacacttaattgtacgtaaataatgcacgtgtgcagactgtgccagccttcacctgggcaagtgcagaacagggtgagcctgcacaccacacgccacactccccaagccctgtcgctgggcggggcttataggaaggcggggcactgacttcctgggtctctgtcttccagaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcggactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcaaggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaagggcaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctggtgaggacccgagtgcctgggggcggggggaggggtccgttgcttgtggggtgctgggagtggctcctgtacaggtctgggaatgagcatctttccaggggactgatggacaagatagggtggggacttcctcctctgtgggccagcccctcataaatcgtgcctgggatagtgaagaacacatcagttccttcagaaaccctgaggcttctcgaagaaggctctcctctgttccaggagaaggaagggacagatgagaagtcacttcaagttcccagaatactcaggagctgaacttgtcaaggtttagatgtggcaaagcaggccaggcatggtgactcatgcatgtaatcccagcattttgggaggccaaggcaggaggatcacttgagcccaggagtttgaaagcagcccgggcaacatagtgaaacctcatctctag

SEQ ID NO: 1262 - DNA, 2554 bp, Homo sapiens
ggggtcttggtaatgttgcctaagctggtctcaaacccctatgctcaaatgattctcctgccttggtccccaaaatgctgggattataggcatgagccacttcgctctgccttgactgtttttgatggaatattctcaagtagattacatgctgtggcatcttaaacagagcactgtgaaccaaatgtacccttgggtgctgccactgagcatgctgggcttgcccttgcccgccttctgcaggaccttatgtgttattttctcagtgttgtcagcctgcctgtttccatggccaccttccctctgtttctgctcactcctggtctgatagggaaatgccgtctgagttcttttggatgcctcgggtgtgcctgctttgacacccttctgccaactggctttgtggctggaggtgtcacagcggtggccacatggataactgtcagtgaagtgtggcttcctgggtggatggggccttgggaggtcacacagaatgttgtcaggattgacagggagggcttcgaagaggagagacttgagcagtgtgtgcagggcaaatgggctcaaatatgcagggaagggggcaaggggcactggcagggacaggggaccagatgagtggggcaccgtggtgagtgtgggagtgaggggcctgaagatgatgaaatccccttgaagtggtgtgaggttagtgagtactttcactgtcagcctcagccccagccctgaaggcatctaggctggcagaaaattacattagtaatgagaagtttattaacaatataattgggttaatctcatcatttttagtcaggattctttgggttgcaagtgacagtgacccaccccacaccgttggttcacaaaataaaggaaaggagggccagcagagcccaggatggggagggctgtggccggtctgcaggacaactgggctcagcgacctgggtatcaccaggccactcctcctcccctctgcccctctgcacggtggcttcgccctctcttgcgacgcaccagcttcttccatcggttggaaatgtggccacaaaaggtgctcggctgccacaggctacagcttctgccactgtgtgggcctgccctcagtctcagatccagaattcctagggagggactctagtggctgacctgaagcaggtgacttgcttgggctggggcccaccctctgtgggaagatatgtgagcaccccagccagccctgccaactctgctcctaaatccacccttttgattgttaactcctcattgttttttgctgttggctaaggaggagaaccacagaaatttgttccaccttctgttaggtgggagaggcatggtttttccagtgacttaggagcccctcgtgctgatgtgttagggtgactgttttgattatgttggaatcacaggctagagctgtgtaagtccctttcatagaggagaggagaggggtgtgcgtgggtttgttcccagagacggcaggctgggtagtcaggctccaggtttgaatccttgccctgtggtctacggcaggttgcgagtggggacggcgcctgcctggtgcatggtgctccatgggccacaccgtcccggagcgggtgatcatccgagtctagccatgagagctctgcccaaccgggctacgctccttccccacagctcttcacccagatcttcggggtcggtgtgaagactgctgaccggtggtaccgggaaggactgcgaaccttagatgacctccgagagcagccccagaaactaacccaacagcagaaagcgggtgagccctccagagaggctgggccctgggcttccctaaactgcaccctggatccctcagcatcaactccctagagggaagggagcagtctggtgcagagggtttggtggcagctttgtgtggtgggcttcctggggtctccacccagtgcagtcaggatctatcaaagccttttctcagtggacgatgctgaccacagcaacttccatgatatgccaggggcttgtgtctgcctactggttagactttgaccagtgaccagggacagcctgggccttgggcacactgcccagtgtggtgcttggtacatggaggcctgcagaggtggcactgagcagcagaaagaacatcagctttcaagtttgttaggcctgggtttgagtcttatctaccatttgccaggtaggtgaccattgcccaagaaataacctctctgagtctgttacattttctgtaaaatggagaaggaaggctgggcatggtgactcacacctgtaatcccagcactttgggaggtcaaggtgggtagatcgcttgagctcagcagttcaagaccagtctgggcaacagggtgaaaccctgtctctacgagaaatacaagagttagccaggcgtgatggtggatgcccgtagtaccagctactcatgaggccgaggtacaaggatcgctcgagcccgggaggtcaagccttgaggccaaggtggaagttgcaatgagctgagattgagccactgcactccagcctgagtgacagagcaagaccctatctc

SEQ ID NO: 1263 - DNA, 1650 bp, Homo sapiens
agctctgagagaggagcccagccctgggattttcaggggttttcagtcggtgatcaggactgaacagagagaactcaccatggagtctgggctgaactggcttcttcttgtggctgttttaaaaggtgtccagtgtgaagtgcagatattggagtctgggggaggcctggtgcagccgggggggtccctaacactctcctgtgcagcctctgggttcatcttttccaactatgtcatgacctgggtccggcaggctccagggaaggggctggagtgggtctcaagtactgctgcctccggtgcgaacaccttctatgcagactccgtgaagggccgcttcaccgtctcccgagacaactccgagaacatgatgtatctgcaaatgagcagcctgagaggcgaggacacgggcatttattactgtgcgaaagatggcgacgttccgaacttgggagttgcttggatagtagcaggccccggcaatgtaaggccgcgcaaatggttcgactcctggggccagggaaccctggtcgccgtctcctcaccatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctccccc

SEQ ID NO: 1264 - DNA, 2043 bp, Homo sapiens
agatgctcccaggctctcccgcagtttaaagacttaactcagcggctttcagggcctgtggttgagggactccgaaagaactgttgctggtggaccggttcagggtcttgacttcgccacacaaaagaacttgagagcacgtccaaagtaaagctaagacctctagtacagtgttcaatggaactggtgagaaaagacgtccttgctgtgttcctgatatgaagaggaaagcagtccttctccattaagtaaaatgctgacaacatgagcctcccgtggtcggaacgggcttgtgaaggcggtgctggggtgcaccagggcagcagctacagaatgcaccagctggagtcgacattaaagggccccatttcccatttgctgcagaagatgtttaattggaagtctctccctgtccttttaccctctggtgctgggcaccaatgagaagctcatctggccccgggatcctggcaggacactgggagcactatttccatgggcagcagggttgttcctggagacatcactgacccaggacacctagcacaatggcactcgatgtgaaagtggcttcgtacaaatctgccactcaagcctaaataagtgcattccagaagagccgcagcccctctaacagctcctgaggtgagggaaaccctagggatgggaagttggagcagaaagagatggtggcctgaagtcaactgcagtgaaaatctctccccatcagcaagttttgcaaagctatggccacagggacacatgactggggcccctcctagtcttggaaggagcccccatggaaatgagggcctcacagtgaatccacctctgatcctacttcacctgcagtcaaatgagaagagatttcaatcagctaaagacaccctatcccctctccccgacccctgcgaccccaggagctcctgccttgtcactgtgtccccaaacgaaccgcatctgaatcaagcccctttctctccctagtggtcaacatctgggctgtgatgggcagctcccactcttgccttagaatatgactggagaggtgacttctcatcacatggagaatatgttcaccccatggtgctttccacccaagctgaccatggcttgactttttggtgtagttgctagctctgtgccatccttggcaatgtgaccctggagcagctgtccccagtgtgcatttgggggatttcatgtaattatgaataggatgcaaattttatagccccagtgaagggaaacacccctggcgaggcttcccggggccagagagaggactccactgagggagatggtggcagggccattctttgtgtcctgcttttttttttttttttttttttaacatcctctttatgtcctgagagccatgtgcagatgaggaaaaatgacatgcaatgcatttttgcctgccacaatgactttgcaatcataacaagcaaaatgttctaaacagtaagtgaatcgaggaagatatactgccaagtcaggaagaaaaaatccacctgttcagtgatttcaggaactgctgaagaaaatcaccagtgagtatcagtttctgcaagagaatctaatgcaggctttgcttctcatcggaatcccccagctggtgtcttggttgactgagagtctgggggagagggcagagaatggatttattctctgctaggtttttaacagtcaagaagggctgtggtcctaaggggcactggtcaaaccttagtgtgcatcagaattatctggataaggctaggcacagtggctcacgcctgtaatcacagcactttgggaggctgaggcgcgtggatcacctgaggtcagaagttcaagaccagcctggctcttttagtagagaaaccctatgtctattaaaaagtacaaaatttagccaggtgtggtggtgagtgcctgtaatcccagctacttgggaggctgaggcaggacagtcgcttgaatctaggaggcagaggttgcagtgaactgagatcgtgccattgtgctccagcctgggcaacaagagtgaaactctatctc

SEQ ID NO: 1265 - DNA, 2882 bp, Homo sapiens
aaaatgacctctgagtcttacacattctgcctgctaagagtgattttgcatgcctgaggcctcgggccatgctgtaccggtgtgactagaaacagctcttctggcatgatggtgacctgccatggaaaatgctgggtcccaatgcccaagtgactgtagttgtggctcagccaggacccgaccatttagatcacctgttgttagacacgcaacactgtcaacatagttcctgtgggtcagcagcctgtacacagcttacctgggtcccctgcttggggggatctcacaaggcttcaatcaagatgtcagcccaggctgtggtctccactgaggctccgtgggaaagaccctgcttccaagctcacctaggttgtttgcaaaattcggttctttgcagctgtagaatggagggcttcagtttatttctagctatgctgtggggcggggtgggggagctgccctcagatcctagaggtcacctgcaattccttgccacttgactatgtccacagaggtggtccatgcatttctgcttcctttgccaaagccagcaacaagagactccaacaagacacatcctaccatctcatgtatgcaatcccgtgcaggcaatcatggacatgtccatcacatacataaccacgtccattccatcacctttgctgtattctattggcccactcaaagggtgtggactaattagggagcgagaatcagccctcttaagtcagccctctctatttcatgtgccaactctctagaatattgatccttttggtattttaagtcatatctattgtcactggaaatcctttttgaagtagaaaggacagagctcacaaaatacaaaccgcgccactattcctgcctgtcatttagagttttgccaggggagcaggttgatttcagtcttttcatggagtttactgtttgatatgatgatatctttacccccataattaattttatttttagttttgagacatggtctcattctgtcactcaagctgtagtgcagtggtgccatcttggctcactgcaacctcaaccagcccaggttcaagagatcctcccacctcagcttcctgggaccaccccagtgggatcactggcgcaaaccactatgcccaactaatttttaaaaattctttgtagagagggggtttcactatgttgctcaagctggtctcaagctcctgggctcaagcaatctgcttgccttgggctcctttgggatcccacaaagtgctgggattacaggtgtgagccaccacacctgcccccgccccataattaattttaagttaatctccacatttcattatcttgggctagatttcgggggaggggcctaatttagctggcatgtgccccattgggtgaatcgaataaaagcatagctgccctggcatggatctgtgaacaaaagttctctgaaaagaaatttggaagaaagacttcattcaggaacagttcacaaactttctgtgtaaaccagttactttccagagaacaaagggaggatcctggttttatagtaaaagttcatgctcaggttgccaatcaggtccattttatgaaaatgaaggctttaaatttgcttagttctgtttggttgatgcagctgcattctgattagtggttagaactgagccctaattggttctttcagatgagctctgattggctgctttaggtgagctctgaaagccccactgttaaactgaggttgggggtttccagggaaactccgagtatatgagttctagtcagcaaatggcctggccacttggctctctttaaaattttggcccagttaggtacttgggatccatcttgaaggattggctcttgaaggatttgttctgagaacacttgtgaacttgagaggcccagtaaggcagagtgaaaaccagaacgcttggcacctatcagttagcacaggatccttccctggaacatcagcatcccttataagtgtgtctaacggccaactcgtagacagagctattgttaatacactgttctgagtatccctctgtgaacaccttcatctggttgatacaggaaaattaaggaagacaaagttttgggaaagtgattgaaatcgtggaataatcaaagcaaatcaatggcagcttgtgtttaaaattaaaaaccaactgtcaagcatggcatttacctaaagtaatttccaaaagtaatcaacagagtgaacaacacccagtgggccaggaccatgtcaacgttggctcattttcagaaacaacatggtgtcagggctccatgttcatggacaccatgaggggagtctcctagcaatgaccctcttctctcctgcaggaagtccaaggtcctttgcatggcagtcttatccccaaatggcatttgctttcgacccatggtatttccatattccatgaagaaaactttaaaaatataggcaaatcaccctgcaagtatccagagagtttccagggggtttctcacacacacacacacacacacacacacacacatgtttagtggggatcttttaggtcaatacatatagatctacatcattattagttgttgcttggtgggccactgcatgaatggttaataattgtttaatttttcctagttagacaataaagatttttaaagaatatatctttgcatacttgcttatttatttgattaggataaattcctgaaattggaattgttaaaccaagaaatacgcatatttttaaggcttttgttatgttttgtcaaatgatcctcagaaagaatgtttattaattcacatttccactagcactacacgatagaactattgggtattttttatgctgttacctttgctggttttataaataaaatattctcttgttctt

SEQ ID NO: 1266 - DNA, 1903 bp, Homo sapiens
gcaaacgattaactggagaaagtttaatagagtgatatctctggaggtacaggcagggcaatgagatggtgcagtgccctaggactagcaaggatggggacctgttatcccccagcctgagggacgagaggaggcactggctttgcaggaggcctggtgagagatggaactggaggtggggctgctggcaggagctgtggcctcagaaagagggttccagccactgcctcacttgtgaccaaaccaggagggagcaggggtggtggggatcagatacccaaacctccctctcctcccacccccctgtctcctgccaatgcttaaccagagggcaaggggcccagggccccatgcagggagaggaagttgtggggaaaggcagaataacaagcagagaaactaattttttaaaaaggtttttaaaatgttgtgggtgaaataaaacacgagctatcagttaatctgtataaccaatgccaagtttcattacctctcttgtccaacttcctcatcaagaaaatgagcatagccacatctttttttgccttaaggggagaggcagaattctaacaatcataagacatgattcctgatgtgtgcgtgatccccactgaatctgagagtcaagcactgttgcctcggtcatacaacatgtatgtgttgatcctgactttgcaccaggtcctattctcaccccagtggagaagttaaggctcagagagttaaggagtttgcctaaggtcacacagcacagaagagtcagtaaattcatttgctggcgggacacggtggctcactcctgtaatcccagtactttgggaggccaaggtgggaggatggcttgagcccaggggttcaagaccagcatgggcaaaatagcaagaccctatctctacacaaataattttttttacttaaaaaaaaaaaagaatcagtgaaggattggacccaggtttgtgtgagagcagagcctgaacgttagctctggggccatgtatttttccaacagcaaatatttgtgggcacctagtctgtgccaaacctgtgctgggtgatgctgggggcatggtggtgacaagcagccctggtccctgtcctcaggagctcacatctggtcgaagatgataagcaaataaatgcatgaatgagtggatacagagaaagatatttgccaaataaagcagagtgacagggaagagaggggtggggagagaagccctccctggagtggtgaaattggaactgatccctgatgatgagatgaatcaccaggtagagagagcagcaagtgccaagccctggaggcaggaatgagctgcgcccattgctatagcagcagaggaggcaaagtagccaggacagggtaggttgggggagaggagaagacgaggccagagagctgaggggctggaggaggcaagggtggcaggtgttttctaaagtacccttggcttctaagttccccctccctcactctggagcagccacagatgagtctctggaacccatctgtgtcctcgtacctcagggcctttgcgctgctgttccctctgcctgtaacacccttcctccaggtgtctcccttacgtccttcagacctttgttcaaatgtcacctccttggcaggccacagtggttcacgtatgtaatcccaggactttgggaggctgaggcaggtggatcccttgaggccaggagttcaagaccagcttggccaacatggtgaaaccctgtctttactaaaaatacaaaaattagctgggcttggtggcacatgcctgtcatcccagctactcgggaggctgaggcgggagaatcgcttgaatccaggaggtgggggttgcagtgagctgagattgtgccactgcattccagcctgggtgacacagcaagactctgtctc

SEQ ID NO: 1267 - DNA, 2896 bp, Homo sapiens
aagtaaaaattaaaaaatatatttgacaatacccagtaccaatttattgtttgttgttgacattaacattttctttaagagtatttcttcatctgtaaaatgaggataaaaattgtaaaattgtacctacttccagcctcatagaattgttttgatgattacatcagaaagcttgtaaaaaccttaggcctgtttcctgacatatactaaatgccccatgtgctaactgaggatgatcattgtaggaaaatttcatagactatgagggaaagccatgcctaaaataatctccagcttattaagaagtgcattcctttttgtttctttgttttatcttagattgagtctcactgtattgccagtctggagtgcagtggcgcaatctcggctcactgcaacctccacctcctgggttcgagcgatcctcctgcctcggcctcctgagtagctgggactacaggagcacaccaccacgcccagctaatttttgtgtttttagtagaggcggggtttcaccatgttgggcaggatggtctcaaactcctgacctcaggtgatccacccgcctcaacctcccagagtgctgggattacaggcgtgagctatccgtgcccggtcaatttttgtatttttggtagagatgaggtttcaccatgttggtcaggctggtcttgaacccctgacctcgggtgattcacccgcctcggcctcccaaagtgctgggattccagatgtgagccagcgcacccagcctggccatcttttataaaaagatgaagatgtcagaattccctaataagtttctggctctgttacccagactggagtgcagtgcatggcatgatctcagcacactgcaacctccatctcctgggctcaggccatcctcccagctactctggaggctgagtcagagaattgcttgaacctgggaggcggaggttgcagtgatcccagatcgcgccactgcgctctagcatgggcgacaaagcgagaccccatctcaaaaagaaaaacaaaatttttttgcagagtatctactgtgtgtcaagtacattacccaagactacaaagagaaatacaatttaactaatgtcctcaagaagctaacagtatactaaaagagatatgtaggcatcaattatagtaatgacataacatattctaatagaggtaagtacataacacagtgggcatgtctggttgtctttgtttctgctgttaaaacagaatatcacagactgggtgatgggttgattgattgactgattgaggcaactctgtcacccaggctggggttcagtggcatgatcatggttcactgcagcctcaacctccctggatcaagcagtcctcctgcctcagcctcctgaacagctggaactacaggtgtgagccaccatgccccactaatttttatttgtttattttttttttctgagacggagtctcggtttgtcgcccaggctgaagtgcggtggcacaatctcggctcactgcaacctccgcctcccgggttcagttttcctgcctcaatctactaggatctagctgggattgcaggtgtgcgccaccatgcccggctaatttttgtatttttggtagagacgtggtttcaccatgttggtcaggctggtctcaagcttctgacctcatgatctgcccgcctcggcctcccaaagtgctgggattacaggcgtaagccaccgcacccagctaatttttaaaaatattttatagagacaggtctcactatgttgcccaggctcgtcttgaacccctgggcccaggcgctcctcccaccttgacctcccaaagttctggaattacacatgtgagccaacacaccaggcccagactgggtaatttataaagaaatttacttctgcccacaccgccccgcctccccgcgcgagtggctgaggcgtagcgctgccatccccgcacccctgggaacatggcgctgcgagtggtgcggagcgtgcgggccgtgctctgcagcctgcacgtggtcctggcacctgcccgccctgcctatcgaggccctggcagcttgggatgggcgccgtctggttactgtaatctgcctgaagttgggacaaaattgaacaaacaagatgagtttggtgctttggagagtgtgaaagctgctagtgaactctattctcctttatcaggagaagtaaccgaaattaatgaagctcttgcagaaaatccaggacttgtaaacaaatctcgttatgaagatggttggctgatcaagatgacactgagtaacccttcataactagatgaacttatgagtgaagaagcatatgagaaatacataaaatctattgaggagtgaaaatggaaccactaaataagctagtatgaaataacgcaacccagcagagttgtcctaaattagtggtggatagaagacttagaatagcaacttttagcattacccatgggaaaaaaaaactactgttaacactgctaatgaaagaagatgccttttaactttctaatgattgtagataaacataatatgtgtctttttcacaacatcctatgatttttagactaggctctagtattcatgaaattatccatgaaattatccatggtaaaaattagttacaaaaattacataattcaaagataatgttgttattcttaagccttatataatattgtaacttgtgtatgtccatacctggatttgggatgaaatacttaatgatctttccattggaaataactgggagtgaagaagtttttgttgcttgtacagtgtcagatgaagaacaacactatcttaattttgcaatacactgcatttgctggtgctgtttttatatagtgaagcaacagctgtacagcaaaataataaaatactcacttcttcgtt

SEQ ID NO: 1268 - DNA, 2434 bp, Homo sapiens
gcaggcgcagtggtccccgcaggcttgcgcgcgcactcgctgcgggacaagcttctggaagctctttgcggtggcgttggtgctgtttgcggatgctgatgcagtttctgcaggactgtaaactggattcctggaacctttgatattcctggctgtgtatagtgcctgttggtggactgtactgatactcaactagagtgtgaagggactggattcctgcccctgagacacaatgcaagctgtagtgcccttgaacaagatgacagccatctcaccagaacctcaaactctggcctcgactgaacaaaatgaggtcccaagagtggttacttctggggaacaagaagctattttaagaggaaatgctgctgatgcagagtctttcagacagaggtttaggtggttttgttactcagaagtagctggacccaggaaagctctgagtcaactctgggagctctgcaatcagtggctgagaccagacattcacacgaaagaacagattttagagcttctggtgtttgagcagttcctgaccattttgcctggggagatcaggatttgggtaaagtcacaacatcctgagagtagtgaggaagtggtgaccctaatagaagatttgacccagatgcttgaagaaaaagatccagtctctcaagattctactgtttcccaagaggagaactcaaaagaggataaaatggtcactgtttgtcccaatactgagtcctgtgaatctataacattgaaggatgtagctgtgaacttttcaagaggagagtggaagaagctggagccttttcaaaaggagctatataaggaagtgctactggaaaacctcaggaacctagaatttctggactttccagtttcaaaattagagttgatttcccagctaaagtgggttgaattgccatggctgctggaagaagtctcaaaaagctcccgactagacatacatggagcagtaaaaaagatgcagatgttctctgaggctgaataagaccatgctctgccttcttgtttcaactgttacacagagatgaccagaggatggggccactgcagtgcagttcaagaggctctggttcggggaagagctggatggagtatgaatcccaactctgggggtattagctagtggagtggccataggcaagttacttaacacttctgaacctccttttgtctttcataaaataaaagctactaggatgagttgttttaaggatttcagattatagtctatgtgagatatgtgcaaacatgtacatatttcccctagaagcaatggttttcagccttggtggtgaccttatagaacataaatattgtgaataatgaaaatccactgaatctaataagggacttgtatcggtaagatgtaaagaactcttggccaggtgtggtggctcatgcctataatcccagcactttgggaggccaaggcaggtggatcacctgaggtcaggagttcgagaccaacctggccaacatgacgaaactccgtctctatttaaaatacaaaaattagctgggcatggtggtgcatgcctgtaatcccagctactcgggaggctgaggcaggagaatcacttgaactcgggaggtggaggttgcagtgagccaagatcgcgccactgcactccagcctggatgacagagcaaaaaactgtctcaaaaaaaaaaaaaatcttacaacctcacaaataacctagttcaaaaatgggcaaagattttgaacagatatttctccaaagaagatatacaaatggcaaatacatacgttgaaagatccttaatattgttagccatagggaaatgcaagtcaaactcaaatcagaatgaaatatcacttcaaacctactaggatggttataataaaaaagacagacaatagcacgtgttggtgagtatgtagagaagttggaaccctcatacactgcttgtgggaatgtaaagtactgtagccactttgcaaaacagtttgacagctcctcaaaatgttaaacatgaaattatcatatgacccagcaattctactcataggtatatacttaaaagaaatgaaaaatccacacaaaaacctctgcatgaatgttcatagtaacattatacttcatagccagaaagtataagctaatacccatcaggctgggtgtggtggctcacgcctgtaatcctagcactttgggaggccgagttgggaggtttgcttgagcccaggagttccagaccagcctgggcaacatggcgaaaccccatctctactaaaaatataaaaattagttgcgtgtggtggcacatccctatagtcccagctacttgggaggctgaggtggaaggactgcttgagcgagggaggtcgaggctgcagtgagccacgatcacaccactgcactccagcctaggtgacagagtgagatcctgtctc

SEQ ID NO: 1269 - DNA, 1908 bp, Homo sapiens
aattaggactcctcaggtcaccttctcacaatgaggctccttgctcagcttctggggctgctaatgctctgggtccctggatccagtggggatattgtgatgacccagactccactctcctcgcctgtcacccttgggcagccggcctccatctccttcaggtctagtcaaagcctcgtacgcagtgatagaattaccttcttgagtcggcttcgacagaggccaggccagcctccaagactcctactttataaggtttctaaccgcttctctggggtcccacacagattcagtggcagtggggcagggacagatttcacactgaaaatcagcaaggtggaggttgcggatgtcgggatttattactgcacccaacctacacaatctcctccttatgtacagttttggccaggggaccaagctggagatcaaacgtaagcgctttttcccactgattcttcattgttggtgattagtttactttgttttcctttgtgtagattttcattagtcggacgccagggatctaacaaacttcattcccaggttctctacagaggaggggaaattgttccacaggggggtagcttgtgactgatttctaggatttctaaatcaaaataagttcattgggggaaagaggcttgctgagctttcagggaggtttttttaaagggagaacttaagacgaatcactgtgagtcactttcggccctgggaccaatgtggatatcaaacgtaagtacatctgtctcatttattcgtgagattttagtgccgttgtgtcatttgtgcaagttttgtgatattttggttgaaaaaacctggtgacccagaagtaaatagcaggacaccagaaaatgagcttaaaaacctgagcaaatagacgaatcattgggtctgagaggagaatcggattcatgggggaaatggggaagaaatagctagatttttctctgaacaagcaacctatctcatatgattggcttcaagagaggtttttgttgaggggaaagggtgagatccctcactgtggctcactttcggcggagggaccaagatggagatcaaacgtaagtgcactttcctaatgctttttcttataagattttaaatttggagcgtttttgtgtttgagattttagctcaggtcaattccaaagagtaccagattctttcaaaaagtcagatgcgtaagggatagaaaattagttcatcttaaggaacagccaagcgctagccagttaagtgaggcatctcaattgcaagattttctctgcatcggtcaggttagtgatattaacagcgaaaagagatatttgttaaggggaaagtaattaagttaacactgtggatcaccttcggccaagggacacgactggagattgaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgc

SEQ ID NO: 1270 - DNA, 2213 bp, Homo sapiens
gcagacccagcgccgagcccgagccatggcgtccgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatgaacccatctgcgccgtcggccacggtgtcgctgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgcaagcgagcctgacgctgtccacgtcgtgctggaccgccacctggtcacaggccagaatgccagctccaccgtcccggccgtgcagaacctgctcttcctctgtggcagccggaaatgaacctgctgggtagatgcaccccctgagacagcccaggtgtctccagaggcagccccgtctcaggcttcagggaccccgcctcttccctcctgacaagggccctggatggcagcctggtctggccctgatgggattgttggaggcctcctggaatcagctctgagggggtgtcggctctcctggagggtccaaacccccatcctcctgcatgttctctggagcagcagcctcctgccccaaggccgaccggcactggcagcactttcctgttgaagaaatcttcctggcgtgtggtttcaaagtgtaagcacctcagtgatgcaccctgtcctaagcattgagaggcacgtttacttgtgaatatgagaccatgagattctcaatgataggaaagtgctgtcccccacggccttgcacagtggcctcgggtagagcggctatcaagagcagacagtggtccagcctgctgggcacctggcctgggctgtggccctccagcgggctgccccctggccccaggttagggcgtccaggagaggcttaggccctctacttcctcacagttccccagtttgagccatcgaaggccttcttcctgcccacctccccatctcagccacagccgttcccaagcaccagcgtggctcctggtgccagtgacctgccaggaggccccttgtgattataaaaccgttcagttgggccgggcgcggtggctcacacctgtaaccccggcactttgggaggccgaggcgggcggatcacgaggtcgggagatcgagaccatcctggctaacatggtgaaaccccatctctactaaaaaacaaaagtgcaaaaagttagcctggcgtggtggtgggtgtgtgtagtcccagctgcttgggaggctgaggcaggagaatggcgtgaacctgggaggcagagcttgcagtgggctgagatcgtgccactgcgctccagcctgggcaatagagtgagactccatctcaaaaaaaaaaaaagggaaaatattgtaaacctagtggcttataaacaacagaaatcagtttcagttttggaggctggaagcccaagatgaaagcaccagtagatgcaacctcttttgtaagggtgatggtcccatgatgaggctgtgcccctgccctgtgaccggatgacctcccaaatgccccacctaataccatccccttgcaggtgaggacttaagcaggtgggttttggggggacgtgctcaggccacagcagggtgcatgaagagccagtgagcctcattgagcccctctggtcagccagatctgacattgagcccagcattgaagatcaaagcaggtggggctttgggatgtgaagtgggttctgacgcggggccccacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagcatgc

SEQ ID NO: 1271 - DNA, 1803 bp, Homo sapiens
ttggatctcagttcgcgcccaccccgcaggcgcctcccgcgagccgggccctctgtgagtgagacaagctccccttcctttacgcgcctcacctggcgcgtggggagaggtcggcagccctccgccgcagaacctccggaagggatgtcctctgccctgcgcctctggccggggctgtggtccctccaggccgtcgaggggatgctgaggccggtccccagaggagcatgacttggctggtccggaggagctctgagggcatgggcaatcttggctcgctgcaacctcagcttccagagttcaagcgagtctcctgcttcagcctcatgagtagctgggactacagatgcgtgccactacgtccgtctgatgtttgtatttttagtagagacagggtttcaccatgttggtcaggctgctctcgaactccagatctcgtgatccgcccgcctgggcctactaaagtgctgggattacaggcgtgagctagatctgactttctagtgtcctagccttggcccgatggacatgtcatttctctcagctcgtttctgtcccctaaagtgagaatactacctgggaagattacattagacgatgtatatgcgaagacacttgatagctggtattgtcatgattctgattatttcactactgctactttccctgtggcctaggctttgcctatttccagtgggcgagctagctagatcctcgtcccttaaataagccagtgtttttaagacagaatactacttgcatagtggacaataatatcttaaagaactgagcaggatgaaaagaatttgatagaaagcaggtttgaggagcacattggaggttggcaggtttcgaggctgcttgagaggacttgggccgatctgggctgggcttggacgtgaccctggcacccaggcaggtggatcccagctggggcttccattcacgactttctggtccctggcaggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatgattttaccaacgaaagctatggcaacccaggaattgactgtcaaaagaaaactgagtgggaataccctgcaggttcaggcctcatctccagtggcactgggtgtaaggattcccactgtggctcttcacatgatggaactgtttgacacaactgtagagcagctgtatagcatcttcactgtaaaggagttaacaaataagaagatcatcatgaaatggagatgtgggaactggccagaagaacactatgccatggttgcactgaattttgtgcctactctagggcaaacagaattacaattgaaggagttcctatctatctgtaaagaagagaacatgaaattctgttggcagaagcagcattttgaagaaataaaaggttcactgcagctgacccccctaaatggttgaattaaaatttattataaggcattactttttgtaagcggaaaaagtgtcacatttacctcttccctatcttttgtttaaaaggactgtctttattttatattggatgaaatctatgaacatatatacaatgt

SEQ ID NO: 1272 - DNA, 2532 bp, Homo sapiens
actactaacagcgagcttccgccaatacttgttctcgttcttggttccgagcgtcccgggagccgggaagggaaggattgtctgcagggattggagcaaatatccagtggggggaaagccgggacttccgcgtcttgccggaagtgacgtgacaatcgcggccaccgccaggtggaacggcagttccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattgtgttgaagaaagtcaagcaccggctggtggagaacatgagttcagggaccgcagatgctctgggcctgagccgggccatcctgtgcaatgatgggcttgtcaagaggctagaggagctggagcggaccgctgagctatacaaagggatgacggaacacaccaagaacctcctacgggccttttatgagctgtcgcagactcaccgggcctttggggacgtgttctccgtgatcggggtgcgggagccccagccagctgcgagcgaggcttttgtgaagttcgccgatgcccaccgcagcatcgagaagttcggcattcggcttctgaaaaccatcaagccgatgctgacggatctgaacacgtacctcaacaaagccatcccggacactcgcctcaccatcaagaagtacctggacgtgaagtttgagtacctgtcgtactgcctgaaggtgaaggagatggatgacgaggaatacagctgcattgtgagtgttggagggggtggggggcttgtacttccccccacctggtctgccagggatagcaggtggctcaggccaacccgggagagaccggggggacttggctggactctcgttcctggagatttagggccatcttcccagtcccgctcgctgggcctcggggtgctgggcacccggccgggaaccactccctcagtctgggggactcttggagggaaatcggattttcttcactcctatgaggcgcttttaagtgtttgatttttctgctgtcgggatccatttcgtggccagtgttcattgaatgtggcagaggtttgggtttggttttttcctctcttcaaagctatcactgagtgcttctgagaaacactgaagtctcagaaatgaggtctcaggaatgaagaacagccgtggctttgaaagcacagtgcggtgcgaggccgtccctgagcaggcactcctgtcccacccccgccccaggccctaggcgagcccctttaccgggtgagcaccggcaactatgagtaccgcctgatcctgcgctgccgccaggaggcgcgcgcccgcttctcccagatgcgcaaggatgtgctggagaagatggagctgctggaccagaagcacgtccaggacatcgtgttccagctgcagcgcctcgtgtccaccatgtccaagtactacaacgactgctacgcagtgctgcgggatgccgacgtcttccccatcgaggtagacctggcgcacaccacattggcctatggcctcaaccaggaggagttcacagatggggaggaggaggaggaggaggaagacacggcagctggggagccgtccagggatacacgaggggctgctgggcccttggacaagggtggaagctggtgtgactcctgagtgccccgcggctgtggtgccgggggcagggtgcgtgggaggacggagcctgggagcggggcggggccgccgcgcaagggggcgacgcataaaggcctgctggcttggggcgcctgcctccctgctcctctgtcctcgcacagcgaacctgggctcctgcccaggacaggcaccagggtcatggcctgggacctggacactggcccctccaccctccctcccctcccggctccccggccagagggagagcttggtctctggacctgccttaggaaggagagggagggcaggaaggaaaagaaaggacttggaggtggcaggagtccgagccctgctccttgtgggcgctcacactgcccccggagcctgctgggagtggggccagccgtggacagctgaggttggggtcaatgcctcctgggcacccttgcctcgccccagaccggcccgtccagtccccatcacacctcggcggcctttatttattctgttcccccagctcggccacttctctgaaggagggctgggttctgggcctgtatcgaataaacacaaacctgg

SEQ ID NO: 1273 - DNA, 1809 bp, Homo sapiens
tgccctcggccgatcgaaagggagtcgggttcagatccccgaatccggagtggcggagatgggcgccgcgaggcgtccagtgcggtaacgcgaccgatcccggagaagccggcgggagccccggggagagttctcttttctttgtgaagggcagggcgccctggaatgggttcgccccgagagaggggcccgtgccttggaaagcgtcgcggttctgggagaggagcccagcactgggattccgaggtgtttccattcggtgatcagcactgaacacagaggactcaccatggagttttggctgagctgggttttccttgttgccattttagaaggtgtccagtgtgacgttcagttggtggagtctggaggaggctcgatccagccgggggggtccctgagactctcctgtacagcctctgggttcagtctcagtacatactacatggtctgggtccgccaggctccaggaaaggggcttgagtgggtctctcttatgtatagtggtgggaccacactgaacgcagactccgtcgagggccgactcaccgtctccagagccccctccgagaacaccctttatcttcaactgactggtgtgagagtcgacgacacggccgtctatttctgtgcgagaggggcacgggagggagtctggaacctcgatctctggggccgcggcaccctcgtcactgtctcgtcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgcgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctccccc

SEQ ID NO: 1274 - DNA, 2102 bp, Homo sapiens
acctctgctgcgcgcagcctgcggtgcgggtcatggcgcggctaccgaagctggcagtctttgatttggattacactctctggcctttctgggtcgacacgcacgtagaccctccgttccataagagcagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggtatgcggagataagggaggagcagggtgagaaagtatcagagaggcctgggaaaccaagatactagcttggttactcctgccctgtcttgaataggttgcagcagaagactggaattcctttctcccagatgatcttctttgatgatgagaggcggaatattgtagacgtcagcaaactgggtactgagtgatgaggaacagccatttggggtccctaggagggattaggtagatacatacaggttggatagtttgccctataggtggcactcacaaaggtcagagtaataatggagaaccctgaaagcttaatgaaatgtgacttcttatctttctaggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagattttacccacagtgtggggagtttctatttttctagcctgtgaaatggggttggttgtcctgaggtgcagagaccagaatgtgagacattagactgcatcaggtttgccatctaaacttagggcaaccccaagtgcttgaacctataccaccccactttcctgagctctgtaaagagcatgaagttttcccactgaccccatacactgaggtgccatcacactgcacatttccttccggagaacaagcacgtactcaggtggagatagaactgtctttttacttaatagaaaatgatgtggcagctttaagaggagcgcgtcggtctggggctggtggcttgggtcacgtgacaccggtggtctcgtttgcgcctcttgatgtcgcggcggcgccctgaggacggattgggcaaggctggtccctgtgtgatgagacatcaccctcccaggagcaaggcggaagtctggaggacgctgaggggcggaggcgggagaggcgagctcgcgatgagtggtctcggcaggctcttcgggaagggtgagccagggtgggactggccagccaggaggcgctggctggtgcaggggaagaggagaccccggcgagattcggccggaccgctgcgccgggcaggggaagagaatcaggagacaggctgactggaaaaccccggcggccgatggcggagcaaggctcatcgccggtgccaaaaggcacaccatgtcggggcgccttgttcccgtccgccgtcctcccccactctcagagggaagaactcaagatctgggaggggacttgagttgagggcgtggcgatcgtgctgactcccactgttcaggcttgaagacgagtttcctgctgtcttcagccattttcaaaaccttgttctataatactttgtgctgggcaagagggatctaaggtgaagaagaaagactgccttcttagcccggcgcgggggctcacgcctgtactcgcaacactttgggaggccgacgtgggtggatcatgaggtcaggagtttgagatcagcctggccaatatggtgaaaccccgtctctactaaaaatataaaaattggccgggcgcggtggctcacgcctgtaatcccagcactttgggaggccgaggtgggtggatcacctgaggtcaagagttcgagaccagcctggacaacatggtgaaaccttgtctctactaaaaatac

SEQ ID NO: 1275 - DNA, 2301 bp, Homo sapiens
gaacatttcagagaaacacaacggagggaaggagcccggccctgccttgtcagcgccctggaagacctggcttcctccctgacactcactctggggagggaagacacccgtgcgcctcgctccctcgtggccagtggcttccccggtgggctagggcgtgtcagcagggcgtgcccaccgagggagcaacagcgattcccaggcctaaggcttttcaaatcaaaagcgcctgacgctttttacaaccgagcagaagagggctgttccaggtggctgacgcttcccgtggcggggagggggttatggagaacgtggatgaagctcatcgtgtaagacgggaaatgccactgcaagtgagcgtccctgcaccaggccgcgtcccgcccagagtgaggcacggccgccccctcgctcagaacctgcagcccggccgggctgatgcgggaagccggccccgcctgtgagcgcgcagttctccctggagacgggccaccctcaccctgtgcctgcgtcccctcccagccctcgtccctgctctctacccacgacccggcctggggtgcctcggacggatctcctgccatttcctgcattctgcaggagcactcattgaaaatttgggtggccttgcttatttattttcctggaatgcagtgggttctattttcgtggtattttctcagcagtgcagcgtttccatttcaaactacaagaagaagaagaaaagccagtccccgtcagcacgcaaacacacaacagaaaaaaacgtcccgggtttgactcgcagtcctgcctttataaattgtaactaaatataagccaccagagttgcctgcttttgtcatgaaactaaaaagacaagtttacttcttcagggaaaaggggaaaacacagtgatgtgctcagttgctgtgaaaagcaaaagacaaatcagaggtaatataaaaagttatttggtaccatggaacaattgatgccgagtgtctaaaatcatcataaaatggactgaatctaaattttggtcagattaatataaaaaaactaaaattaaaaaagagcttgcttcatcactgtagcactggggcttcacacaaatttcaaaatgtgcgtgttacactagcattgttaggaatatgaaggttgacggtgaaatattttattttctcaagatgctataccacgtcgctctaataatctaccaccgctataaattttgtattgcctaccattcacagaaggctctatttcaatggattcatgtaaaaacacaattttggcaaaaattaaatttatatacctggcttagataatttacaccttaaaactgacttttgatttcatgttggatgtatgcatctttaatttctaaactaatgtagagagaataaattgttaaaatctgatgcattttgcatgatacatatttttaaaaagatttagaatggttgaaaatatgtacacgtttggtagacttagttatcaaagacggttacttttattcaataccctgaaagtgtgtccattgaaaggcaaatacatttccatttttctgtctttaaaatgagactgaacttaggtcattttcttaatcttgagagctactttctcttggtttatatgcatttctgctattggtgtaactgatgagcatggtaattgcacatcaatttaccttgaaacggaaaatgataagaactttctgtggagcaaaaggtggccatgtctgtgagctgaaagtaaaagctagaaaaacatttgatctctcatgtgggcaactgatttaagaaagaaaagaaacttcatctgtacatattaatcaaaaaattaatggtataaatttgctatttttcgttactttttataaattggtgatagcactaaactgtcaatcaaattttatctttacatttaacaaaacatgtaaaggtatctgacttcttggctgaaataacttattaatgccttactgtaattcataaatagaattttttcatacatattttgccctaaaattaaaggtgtcaaagaggggaaaaaaatctgtttggactatgcaaatattgctaagctgagccacttattttgaatatgcccatgtgagctaaataagataattagggtttttcacatgatactgattctgcatttgaaatgcagaatcataagaaatgctgcacatataataatggcaatactttatgtttttatagatcttcatagactatgaaagtatttttacatatgcaattgagattcataataattctctgaggctcacttgtttaaaaagtatattaaact

SEQ ID NO: 1276 - DNA, 2772 bp, Homo sapiens
agtgtcccgaagcggggcttgggaggtcgtgctcagacgcgtggcgtggcgtggcgtggcgtggtgtggcgcggcgcttgttccgtggagctcagggatgtgctccggctcaggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccgggtgagcactgaggggagggaggctcgggtcccctctccccacctcggcccgaccccgcccctcctggtctgcacacgttgggtctgagcactcaggtgaagtctcttcctcgggctggctccggtggggacccggctgcccgcagacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggcgcagccgtggatctgcgcggccctgctccagcccctgggcggccgctgcccccaggccgcctgccacagcgccctccggccccaggggcagtgctgtgacctctgtggagccgttgtgttgctgacccacggccccgcatttgacctggagcggtaccgggcgcggatactggacaccttcctgggtctgcctcagtaccacgggctgcaggtggccgtgtccaaggtgccacgctcgtcccggctccgtgaggccgatacggagatccaggtggtgctggtggagaatgggcccgagacaggcggagcggggcggctggcccgggccctcctggcggacgtcgccgagaacggcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtggaggaggcacgaggcggcggccccggctggagcgcccctcggcttccgcaacccggtgttcgacgtgacggcctccgaggagctgtgtcaggtgcaaactggagagcaagcctgagctgaccagacaccacctgccacccactgctcacccgtcacagatggactgtgctggcagggacctgcctctggtgtggactgtggaaggagagatgctctgggcttccaggggagccgcctgctgcagcagcagcccaggccatgctgcctggcacagagctcaaggtcccaagtgcccccgctgggtgccgggctgcctgccctggcttgcagtcttctcccaggtccgcactcttctgcaggggccatcactgcccttgtcctaccaaggacaactaggtctcagtgagtggcaaatagaagccaactccctgcataactcaggaaactgactccgagcattccctcaaccagggaccactcaccctggcccagacctccccgagaactcctgcctcttcctggggcctctggcctaccccatcctgtcccttggggctgctggcagggttggcgtgtatgggtgtggacaggcagaccctcgcgggcagcctgctcctggggccctggcactgcctggctggggctcacaggcacgctgccctcctcccttcactcctgccccaaggatgccctctgttcaggctgaacaccccaacagcagccttttgggtgacctccgagtgagttacccagaaaagcttctgctggcgaatagcatcttctgcaaggtggctccttcactgccttttggagctcaggcacttctggggcccagacacacgggtgacatgttaccacatccaaacggaccactgggaactttaaaactgccgtcttctgctttattgacagccttgccaagcagccgaccggtgggaggacaggggaagcctggcccaagctgtggacaagctgtgtctgccgccacagttaatcacaagcctctgacgacacagggccacagagctggtcactcaacatctggtacaaagggaggcagaagccgtggaagcgaatggaaaacagcacagctgacttcacagtagtagatactggtgacacttcatggctgcgacccagaatgaacttaatgcacacagggacgcagggtgtcactggtcctgggcctttgtccatgactaggtggtcagcaggacttctgcagctgactgtgcaatggctaaatgaaaagaaggccacagactaacctccactttcctgtcttcaaaattctagtgacactgggaatgctataggacctcctactattctcttaaggtcctaggaaagtttcaggaactagggaaaagactgggtactgaggctgtgtccccagatgtctgcttccgaagcagccgcgtcatgacgggtttctgctgaggaagtggtgttggcagggccccatatgccctctcgggttgtcaggggtgggagacaggctgtatgggggtccttcatgtgcagatggaacagcatcgcctcacagctgtgcagacgaacagatgtggtctactgccacgaacaatgcggcataaaactgatcaatattataataaagatttgtcttcttcatctcc

SEQ ID NO: 1277 - DNA, 2532 bp, Homo sapiens
atgttttatgggaaggaggagggaagcggctgagcagggcaagagcgaaagtccactgcctggcaaggacagcctagacacgggggaaagaagggacatggaggggctgagccctgtcacacgtcatgccctgcatgccgggctggacatggagaagctgagcgtgcagtctggagctgaggctgggaagccctgatacatggcttagaagtgagttggtgacaactggacggttccccagcaggggcaagcaccagagtgatgggaacagcccctgctgccaggagcccacggggggagtgtgcacgtgtgtgcgtgtgtgtggtgtatcctgtgtgcacgtggtatgttcatagatgtgtagtgtctgtgcatgtgtgcgtgtgtgtggggtatgttcttgtgtgtggcatatgttcatgtgtgcgtgtgtgtggtgtctgcttatgtgtgcatgtgtgtgtggtgctgtagcttctaattcagcccaagccacaacttagacttttaatgttacgttcaaacaaaaccatttggagactcacccacagctctgaggctttggacgacgcccgctcatcacctgccttcccctctgctgagtgcaatgaattcaagctccataaaggccacacatggagccctgtgtgcgtctacagttctgggtcccgagatgaggcggtgaaacagcaaacccacacccagaacccctgccccaggagccccagccagcaggagagcagggcaggggtgcaaagagcaagccgggggtgggggtgggagaggcagagcagcaggctggaggccggggctctggtgggattttacgttgagcacggggtgagcctcttgaagggtgagggcgtgtgtggccatccaggtgggggtggggagcgcaaaggccctggggcaggagcaggcctggagcgcaggccacagagccaggggccgggcgcaggtgagtgagccaaagggaaccaagaggggatggtggagggagcggcctggctgagcaacccggggctttgaccttctcaggggcaatgggaagcctggaattgcatgggctggtgtggaggtcaccgtgaccttgccaggcctgggggtgcagccgcagtgcccagggaggtgagaaggggctggccaggctgcctgttgtgaagagcggagaagtatgagagagatgtggagcagggcgtctggcttttctctgacctgcgatgggctggtgggagcaggagcgagctggcctcactgtgaatgtgaaaatgctggttggagcacaccacggtgggtacttccttcaacggctaaatgcgccgaaggcctccaagcttgacagggttgaatttcctccaaggccctgggaggggcgccctgtgctccctggatggggccgacattcctggcctgtccccagctgcgtcgcctctgcccagccctcaatcactgcagctctcaagtggtcctgggtgccgtgatcttgctgaactctgatgctttccaaataccataaacttagtttattttctgtctgacagaaacggcgccacttaagtcctgcaaagaaccctcgggttccactcaggctgagttattcgggggccactgctgaacggtttgcatttgtttcctctgtgacatcggagtggggaggacgctgcctccagcacagggccaggggccagggctgctcacacagagctgctggagcctacagggtcccggctgtgggtcctgggctgcccgcccccaggaagggcaccttgccaccattgaagtggggcgagctgattcgggcacagctggaaaccaggaggcagccagcagcagcggccctgagcaagaacaggaaccccaggccgaggcgggcgcatcacacgagaccagcctggccaacatggtgaaaccccgtctctactgaaaatacaaaaattagccgggcatggtggcacccacctgtaatctcagctactcgggagggtgaggcaggagaattgcttgaacccgggaggtggcggttgcagtgagccgagattgtgccactgcactccggcctgggcaacagagtaggactctgtctcaaaaataaagaagaaagaaagaaggagagtccggaagccactgctgcccccaccagcagagtggaactgtgatttcatagaacagacacagcctggcagcgagaatgaccacagtgctcacagccactcaggtggaatctcaggaactcaatgtcaggaggaggagtggggccctaaggcccgtgtgcgggagacagtggccatggcgtcgagctcaaaggtgagccgggtgtggctggggatgggaaggcgtggcgcagagccacggggaaggcacacgaggtccagagacggcagcctgcgaagtggagggagggtggacgccggggtgatcacccactttcctagactgagcgttgggcacaggctttgtattgcttcattcatcgtcatatttgatgtatgtttgataaatatccctttaaaaattaaagacagtttgttaatt

SEQ ID NO: 1278 - DNA, 2465 bp, Homo sapiens
attttgagaacttgcaaaaacagcttgcaaggaaaatgaagcttcctattttcatagcagatgcattcacagcaagagcattttgtgggaatcctgctgctgtttgcctcctagaaaatgaattggatgaagacatgcatcagaaaattgcaagggagatgaacctctctgaaactgcttttatccgaaaactgcacccgacagacaactttgcacaaaaaaacatgaatagcacgctcacgtttgtcactctgagtggagaactaagggccagacgagcagaggatggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtaagatttttggctgcatcagcactttggggagggctgagtacccagatttatagctcttccttagtctggctgtgctgtgtccagtcaaaccatgatttacgcagccagagtgtttctttccctgataggaagacattcccacttgttcttccttcccctcctgttaagctctttgagcaagctgcaccctggcctgcttcacagagtctgtgtggtgagtgggctgtgaaatgggtttgtcctaatccatcttgtttatgaacaaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacaggtactttttacttgagcccaggggagggttaaacaatggaagaggaggatcacaaatagttatttaagtgcacttcctgtgacctttcgggtggcttgagttttgagctgccttgttcctctatctttccccatccctgccatcccttcactgaagtcttccatgaaaaacataaaatagagcaggtggataacagggttaaacctgagtgtcagacagcctgggtttacattcctagcttcctagcttttgaccttgggcaagtgacttgacttttaaaagtctcagttccctcctctataaattgtatataatacctcatagggctataaaagcacaatgcatgttaagggcttaatacaatgcctggcacctagtaagtgcccaataactactagctattatattgtattattatatctttttgggacatagtctcacttcatcacccaggctggaacggagtggcatgatcccggctcactgcaacctcagcctcccgggttcaggtgattctcctgccttggcctccccggtagctggaactacaggcgtctgccactacacccggctaatttttgtatttttactagggatgggatttcatcatgttggccaggatggtcccgaactcctgacctcaaatgatccctcctcggcctcccagggtgctgggattgcgggcatgagccactgcgcctagctaactactagctattttaataataacaacaaaactagctccttgagccaacacttctagattgtccaccacctgggagcagagggatgagtcaaagatgggcagaaatgtcatgactcctactctccctctctttgggaacagtgggctgcactgcaaaggacgagaatgcttgatgtgggaggatggtgggtgggatggtgaaggggccacaggaggctgggcagagccttcagggctcctgttctggtcagatggcagggcctggatggctcagttactctctgagtaacaaaacacgtgaaattcaaaactcagcaaacaagcacttttaagactcaggaaaatgcccaaccatatccagagtgcagcttccccatggaagaaaagttccaagcagatttgcacaagcacagctgcttcacaaagattttaattggcacagagtgcaagtttgtttgtttgtttgtttgtttgtttttccccgtaatgcttttctagagtataaaggcctttggactttgataaccaacatctgagtttgcttgggactgaagggtttctcagggctcagaactttcagtgctaaaaccagaacagtctcaggcaaaccaggcaggatggttggttgccttacttgaacatcccataacacttttttttttttttttgcccaggctggagtgcaatggcacgttctcagctccctgcaacctctatctcccgagttcaagagattctcctgcctcagctacttgcggggggctgaggtaggaggatggcttgagaacgggatgtcaagactgcagtgagccatgattgtgtcactgcactcccggctggacaacagagcaagactgtgtctc

SEQ ID NO: 1279 - DNA, 2760 bp, Homo sapiens
gtcttccggcgggtccgcccagttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggtcagtctattagtcaagttcagccgttattctcagtcaggctccgtcaccgccctgacccaggcgggcagtggctccgcggcttccctgagctttttggccaggcttggcggtcagtgtggcaagcagggccctcttaggcccgatctgaggtgagcgcctcccctgggagacgccaggctcctgggatccgcccagccaaggcccaccctccaggaaccccagacgcaattctaatcattctgttccgcaggtagtcactcggtccctggcttgtgccagactctggctttgcctgcggggctacggaataagcagaaacaagaccgttgtgtgctgaaggcacgcactttgttgggggaggaggcggcacaggaataatgatctaaacagtgcagtgtaattgctgtaaaatattattccggctgggcgcgttgactcacgtccgtaatcccagcactttgggaggccgaggcaggtggattacctgaggtcaggagttcgagaccagcctggccaacatggtgaaaccccgtttctactaaaaatcaggcgagtgtggtggtgcgtgcctgtaatcccagctactcaagaggctgaggcaggagaattgcatgaacccaggaggcggaagttggggtgagccgagatttcgccattgcacttctgcctaggtgacagagcgagactcagtctcaaaaagaaaaaaaaagaccgtattttcttattgtaaagagacagagattcagccatccctgctcaggagcatcagaggaagttgtagacaggaggtgacttttgagctggaccttgaaataagagggggcgtgcatgaggcaaagagaaacagggcatttctaacaatgggaaaattatgcacaggcatgttggggaactggttgagatgaatctatgtaaaggcgaactggcgcaacagctgctgccgctcttttttattttgattgattattactgagcttccatggggcggattcgaaagggtctcaccaagctaaagggtttggagtcaccagaagttttaactaggagagtgaggttagatttgtgtgtagaaacagcacccaggtcagcctgggcaacgtaatgaaacctcgtctctacaataagtagaaaaattagccatgtgtggtagtgcatgcctgtggtcccaggtacttgggaggctgaggcagcaggatcacttggacctgaggggtcgaggctgcagtcagccctgattgctgccactgcactccagtctgggcaacagagaagactgtctcaaaacaaaaacaacattactcaggaatgaaggaaatggattggaattgagaagacgggactaaagccaattaatggggtatggcaatagtctagttggaagaggttaaggtcatgcagtaggacataatagggctgaagaagtatggatggaattgacaaacttttaaagggtagaattcacaagatttgatgaacaaatgcatgtaagagaacatatacaatgcattgtaagggacttactgctataattaaccattgtatgtttccaaaatgtatgtgtataaatagtcaacagtgataacaggatccaatcatggacaaccagtttgattggatataaattttgaaagaaagtgtgtgtgtgtttgtgtgtgtgtatgtgtgaatgtgtctggggaagttaagaaaaattttgagtttgccctattgatggcagccagctgcagcagggaggtgtgactggggctgcacactccatggagcctgtgggagccccgccccttctgagttgaggcaggagcccctggtgccattgtggctgccctcccaggtgcaggacctgggcatctctgcagcctgcacccttgggggaccagcaagacaccctactgcaatccctgcaggctcaggagtgtctgctcccaccgcctggactctctctactcccggggcctgctccaatctcagagcgggcttggggccaagaatggcaatgggaggcagattgattccagggtagaagtgggtgagtccccagtaagaccccaccttcaggtcagggagggcctgaagacaggggtccaggctgccagtcctgcagactggagtagggactcgtggtgcatcttctggcctgcccatggaccaatcggcatgtacttcctcccctcggaggtccataaaaaccctgggttcagccagagtagggcagaggactgccagaggaccaagagggcagagacctatgggtcaacaagcctaagagaggagctaccctctctgctgatagttggagatgatggaacagccagttgcagaaaggacctaccctccctgctgacagctgcagagacaacctgtgggcagagaagagccaccctctccagggcctcctctcttctgagagctgcagacattaggacgatcagttgcagagaggagccatcctctccagggcctcctctctactgagaactgaatacctgatggacaacctgcctacagagaggaaatacccactggaggtctctgagctgttgtaacactcaataaagttcatctttgtcttgttc

SEQ ID NO: 1280 - DNA, 2615 bp, Homo sapiens
gttgaacattttttatgtggaacattgattgatttttgtacgttgaactatccttgcattccaggaataaatcctgcttggtcagggtgtataatttttttattatactcctgaattggttttgctggcattttgttgaggacttttccaacgatgcttatcagggatattggcatgtcatttttcttgtggtgtctttgtctggctttgatatgagggtaatgctggcctcttaggatgagtgaggaaatgttcttcaatttgtccaagagtttgaggagtgatactgattcttcttaatgttttgtgaatcacatgtgaagacatcaggtccaggtcttgtctttcaacttttatagtttgaagattttaggttcccagaaaagttgcaagagtagcacagagacttcctgggcctgggaccttgccacgtggtgaacatcatgtgtcactgttggacccacctgtgactgggttttgccccagaatcccacccaggacgccacgtgacatttagctgtcacttctggtgggctcctgccaggtcccgtgcttcctggaggggtggccccgtgagcatctgcatagcccctttcctctgctgggccctgggtggggtgcagccactcgggtggaccctgagggtccctgcacctgtttgccctctcttgggtgcgctcaagaccaaaaatgatgttgagcagtcctgggccccggacccacagtggtggtgcggctctggtcagtgtctcctgcgctcccaggcccctgacccacagtggcggtgcggctctggtcagtgtctcctgcactccggggcccctgacccacagtggcggtgcggctccggtcagtgtctcctgcgctcccgggcccccgacccacagtggtggtccggctccggtcagtgtctccccacacagtggctcttggtgaggggtgggcgcttgcagaggggacgggcaccacgtggtcatccccatggcaggttccgtcgtggcgacggtgttgtgggaggatggtgtgctgctgcccctgcaccccgtgagatgaatcctgcctctgggaggtacagctgggacggggcgagggacccactcagctgtccaggaagggtcccctgccctgtgcttcctccaggtgtcctggtgcgctcctgagcacggtgcccagtgggggtccccacaccctgaccctgaccctgacccacgggtgcctccccttggggactccacgcccttcgctggcattgggatggagagtgacccgttcattgcagaagggctggacctgaggctgcctgaagccacaccaagggccacagccccagcagctccagccttcacgtgccagatgccaagccctgtgctcaggaggacagggaggtgggggcagaggtggccttggtgccaccactcatgtgcctcaaggtgggcagtggctgcctctgccctggaggcctgtgagggtcagggtctgagggtctgaggtgcactatgacccgggggcactgcctggccacggctgagactcgcagagggtctgcagttcccacctgcctctcggaagctgccctgggtcggcggtcagtgaggctccgccttgggctttctattattagaaagtcattgagcaacagcagtgctgaggacgcaggcagggctgtgggcactgcaggggctgctcccggtgtccacacacgtgctgggctctgccgaggtgcgggaagcctgtgtttcacgctcaggccatcctggagcccctggtttggtccctccccacctcggggccctggcgtgcatttggggtggggggttcccatggcggcctccctcagctgcctctctccccactaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccctccccatcctgagtccacagggagatccacagctcacggagcctggccgcggacccctcccacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgagcccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctc

SEQ ID NO: 1281 - DNA, 2274 bp, Homo sapiens
attcttctcagcaccacactgcactttttctaacactgaccacataattggaagtaaaacactcctcagcatacacaaaagaatggaaatcataacaacctgtctctcagaccacagtgcaatcaaattagaactcaggattaagaaactcactcaaaaccacacaactacatggaaactgaacaacctgctcctgaatgactggtaaaaaatgaaggcagaaataaagatgttctttgaaaccaatgagaacaaagacacaacgtaccagaatctctgggacacacttaaagcagtgtgtagagggaaatttacagcactaaatgcccacaagagaaagcaggaaagttctaaaatcgacatcctaacatcacagttaaaagaactagagaagcaagagcaaacaaactcaaaagctagcagaaggcaagaaataactaagatcaaagcagaactgaaggagacagagacaccagaaactgttcaaaaaatcaaatcaatgaatccaggagctggttttttgaaaagatcaacaaaacagactgctagccagactaataaagaaggaaagagagaagaatcaaatagaggcaataaaaaatgataaagggaatatcaccagtgatcccccggaaatacaaaataccatcagataatactataaacacctctacgcaaataaactagaaaatctagaagaaatggataaattcctggacacatacaccctcccaagactaaaccaggaagaaatcaaatccctgaatagaccaataacaagttctgaaattgaggcagtaattaatagcctaccaaccaaaaaaagcccaggaccagatggattcacagccgaattctaccagaggtacaaagaggagctggtaccattccttctgaaactattccaatcaatagaaaaagagggaatcctcccgaactcattttatgaggccagcatcatcctgataccaaagccgggcagagacacaaccaaaaaaaatttgaggccaatatccctgatgaacatcgatgcaaaaatcctcaataaaatactggaaaaccgaatccagcagcacatcaaaaagcttatccaccatgatcaagtgggcttcatccctgggatgcaaggctggttcaacatatgcaattcaataaatgtaatccatcacataaacagaaccaaagacaaaaaccacatgattatctcaatagatgcagaaaaggactttgacaaaattcaacagcccttcatgttaaaaactctcaataaaccaggtattgatggaacatatctcaaaatagtaagagctattatgacaaacccacagtcaatatcatactgaatgggcaaaaactggaagcattccatttgaaaaccggcacaagagaaggatgccctctctcaccccatcaaaaagtgggtgaaggatatgaacagacacttctcaaaagacatttatgcagccaacaaacatatgaaaaaatgctcatcctcactggtcattagagaaatgcaaatcaaaaccacaatgagataccatctcacaccagttagaatggcgatcattaaaaagtcagggaacaacagatgctggagaggatggggagaaataggaatgcttttacactgttggtgggagtgtaaattagttcaaccattgtggaagatggtgtggcgattccttaaggatgtagaaccagaaataccatttgacccagcaatcccattcctgggtatatacccaaaggattataaatcattgtactataaagacgcatgcacacgtatgtttattgtggcattgttcacaatagcaaagacctggaaccaacccaaatgcccatcaatgattgatagactggattaagaaaacgtggcacatatacaccatggaatactatgcagccataaaaaaggatgagttcatgtcctttgcagggacatggatgaagctggaaaccatcatcctcagcaaactaacacaagaacagaaaaccaaacactgcatgttctccacccataagtgggagttgaacaatgagaacccatgaacacagggaggggaacatcacacactggggcctgttggcgggtcgggggctaggggagggatagcattaggaggaatacctaatgtagatgatgggttgatgggtgcagcaaaccaccacggcacatgtatacctgcacattctgcacatgtaccccagaacttaaagtataataaaaacacaacaatgaaatacagcatacaaataaacaaaaatgtttgc

SEQ ID NO: 1282 - DNA, 1887 bp, Homo sapiens
acacacggcgcgacaagatggcggataaggagaagaagaaaaaggagagcatcttggacttgtccaagtacatcgacaagacgatccgggtaaagttccagggaggccgcgaaggtgaggaggctcccgctgtcggtaccccctctttaaaaatttcaaataaacccagcaacagagatgatgaggacgcatgcggaagcacctcttttatttatttttattattttttttgagacgcagtctcgctctgtcgcccgggctggagtgcagtggtgcgatctcagctcactgcaacctccgcctcccaggttcgggtgattcttgtgcctcagcctcccgagtagctggaattaatgtgtaccaccacgcccggctgatatttgtatttttagtggagacgccatgttggccaggatggtctcgaactcctggcctcaagcgatctgcctgcctcagccccctaaattgctgggatttcaggcatgagccaccatgcccagcctagcatttttgactgggcaagtgagctgccttctcctagcctccgtttcctcatttgtcaaatggggctggtaactccacccacttcacagggggtggtgagaatgaatggttacaggcatgtaatgtaattgaggcagctctcagcaggaagtaagcagtcagacaacacgtcacttattcaatagcctcttggatctttggtttcttttttttgtaagacggggacccaaacctctttgtccctggattgtagacaactgggtggcatgagagttattaaaaatcacagtgccccagccggacggggcggctcacgtgtgtaatcccagcactttgggaggccgaggtgggtggatcacctgaggtcaggagtttaggaccagcctggccaatatggtgaaggcccgtctctactaaaaatgcaaaaattagttggttgtggtggtgggcacctgtggtcccagctgctttggaggctgagacgggagcattgcttgaactaactgcactccagcctgggcaacagagcgagactccgtcccaaaaaaaagggtgaatgtgagcaggccacgaatgaccaggataaggggacacgaaagaccattcccggcagagaacagagatgaaaatattgagccttgtcagaaaatcacaagaaatacaatattcatggagcacaaggctcctcttcctttataaagtctttccagccagcccggcaaagcgtaggtttcaacttctcctttgttgcagccttttccaaagtgtcagatgtaaaagagaggagcaggccttggcaggggatgggactgataaggcaggcacaggcccaggtactgtagaccacatcagggagcttcagatgtatcgtgtaggtaatggggagccactgaagatgtttgaggagcagaagagcatggtccaagatcagtttgagatgatcactctggctgcttcgtggggaatggattgcagaagtgagcctagaggcaaggaatcagaaaaggggacattcagttcaggggagttatgataaaggcctgaactgggacagggaaagtgggaaaggaaaggaggggacagatttgagggccattaaaatgtagaacgggggccgggtgcggtggctcacgcctataatcccagcactttgggaggccgaggtgggtgaggtcaggagttcaagaccagcctggccagcatggcgaaaccccgtttctactaaaaatgcaaaaattggccggacgtggtggcgcatgcctgtgatcacagctactcgggaggctgagaagaatcacttgaaccctggagacagaggctggagtgagccgagatggcgtcactgcgctccagcctgggtgacagagcaagactctgtctcac

SEQ ID NO: 1283 - DNA, 1759 bp, Homo sapiens
agctctggttctgacaccctcagacacggccagctgaccccagaagaaaggtaggtgttgggggtgcccatctctttgggaaatttgaaggaatcaaagaaggtggaggaggggaggtgacctggagcccggcatgtccttgtggccgggccacacccaggctggccccagggtgctgctgctgaagcccaatgggaacgacagatttcttttgagacacaaggaactcagaggttgtctcactcaccctgagtctgagcacctacttgtgccaggccctgtggggaaactgaggccctgggaggggaatgacttgccagggtcccgtgtcaggaggctgagcaggcagatcataggacttcacgtctctggccctcacctctgtccctctgttcagacctctgagctgatagagaagaaacaggctgtgctgtgtccctaatgggaaacatggctgagacaggggagtgagaaggtcgcattgcagaatggtacctgtggcatgacgccagctttgcaatcatgagattcaaaagccacactgtggaattgtgagtataactacaggagtgagagcttaggtctctgtgtttgtagaagcagaatcaaacctggacactgttggattattaaaatcacccatttttgcttcaatatcagagtcacaagggcagatgttggcctcccctctgccctccaagagctgtgtgactctgggcaagtcacctcccctcccagcctaagatttttcccctctaaaaaacttgatagagctgccaaaagtccatgaaatcaggggggtaatttctgtgaaatatgagtcatggtcttatttgttcttcaccaaaaagagatgcccatcaagatagaaagaaaaattaaattcaatttctcaactgaaagtgaaactgaagctgggccatgtcatccagaggctggttgcttttagttcaagtaatgcctcctgcacctgggatttcagccaggctgtgccagggagggcggagggcatccgggtcagtcgtagggggtgcagctgggaacacaacagtgtccccattgaatgttcagagtctaaaggggagacagaggcccaaagagccacatacaggtagagctccctctggaaagcagagtgctcagggagcctggggagggttgggggccgccgcatggaccaggcagctttgggtgggtctctgaggacaggtgacttgcacatggtggggacagtgggggggacattccagggcgagggagcagctgagtgaaggcctgaggctggggatgggagtgggaggagtagatgggctccaggaggcaccgaagcagggcgtcagtgggtgcctggacctaaggtgactgtggtgtcagggagcggtgaggaaggtgggggccagagcatcagagggcctgtgtgccctgctatggggtttgaacttgaccgtggcttttcactgaagattcctcagaagggtgcagtgccacggctgaggcctgtaattcagtgctgtgggaggcagaggcgggagaatcacatgatgctaggagctcaagacagcttgggcaacacaggagatgctgtctctctgaaatgaaaaattaacaaattagtcctgcatggtgccgtgtgcctgtagtcccagctacctggaaggctgaggcaggaggatcacttgagcccaggggctctaggctacagcaagctgtgatagccccaaagcactccagactgggtgacagagcaagacagtttctc

SEQ ID NO: 1284 - DNA, 2560 bp, Homo sapiens
tttggccctgtggccgtggcccggtactgagtggtgctggggtgcagcccaagcccccacgccgctgaccccagccccttgctcctttgggatccgcagaagctggaggatcaggagcagcgggcccgacagctcaaggagaggctgcgcagcaagcagcagagcctgcagcggcagctggagcagctccgggggctgacaggggcggccgagcgggagcggctgcgggcggacagtctggactcctcaggcctctcctctgagcgctcagactcagaccaaggtgagtgccccgaggctgaggggttgtgtggccctcggggcgagccaggtcttctgaccggacccctccccgcgcagaggagctggaggtggatgtggagagcctggtgtttgggggtgaggccgagctgctgcagggcttcgtcgccggccaggagcacagctactcgcacggcggcggcgcctggctatgatgttcctcacccagggcgggcctctgccctctactcgtgccaggcccacttgccaggcaggagccctccccaagccttcagggctgctcggagtcacctgttggaatggactaaaaggacccttgcgtgggaacaggtgctccccaaacaccctgctgctggctgccaggcaggccctctggaagggaaggggcaggactcatcaggacctccctggacccctgcagggcaggcagcttgggcccgagcccaagcatttggctctgctgcccccaaggggacaggaagcctcttgggcctcttcccttcctggacaaggccccctgcctttgcctcacataaactgtacagtattttcattaaaagcctctttcataacttcccgtccatagtcttgcctaatgaaaacgggggaactcccaaccacagacccactggaagaggaaataatatcagttcccatcactgacactgttggccgtgccaggcagtgcacttaattctcacaacttgaggctgttctgtctccacttcacggatggtagaaatgaggctgagtgacgtgactcgcctgaggtccaaaaacagtgaagccaagattcaaaccagagccttccgactccagagctggggccaactgaattcaacaagtatttattgagtgtctattatgtgctagatactgagacacatcagagaacaaaaccaaaagccctgcccttgtcgggcttacagtctagcacttaccgccagttaacctgcaggctacctggagccccgggcaagtcaccgcacctctgtgcctcggtcctcagctgcccaatgggagaataagcagacctggctcagacatgaatcatgtgcttggtgtactgcagatgccaaactgcatccccacaacccaccacgtagacagcagacagggctggaagttgatttttaatgataaagtacaatgaagggagggcagaggggctaagcctagctgtctggggtgctgtggtggtggtagactggctacacaaactgttgctgctgctgctgcttcttggtggccgccttgctggcgaggtccttggccttctctgtagctgccagtgccgtctcctttgccttctccttggcttccttggctgtctcaacaagtgttttggaaggggcctcgcctgtcgcgaacggcaggtggctgcctttagaagatgcctgaaagaccaacctaatttccctcccccatgacaccaatctcccctgggccaggctccactaaaaaggtggtattcaccctcctcccacccccagtacagacaaggagtcccagctcagagcagggcaatgactaacccagactccacgcccgctaggctgaatgagcctctccctatgaggaatatccacatacccagaaactcaccttgcagcttagccaagatatattcaaaacccttcatagtcttggtcacgttgcttttgaaccgggcaagaccaaattcctggcatgagatgagaatgggaaggatactgagttgcccactgaccccagcccagccccaacaccgaaagcactgggtcccagagccccagcagccccaacaacactgctcacctggacagctctggagacaccaaataagctagaggagacccaggcttcccggcggatttcagtccagccactgttgtcagagttcacacagtaaacacatcgttcctccaccacctatgcagaggccaaccacaatcgtggaacagtctttcattttgccaacttgcacataaatctgactccctgtcacttttcatgaggcgaagcaatacaatgaaaatccattccttcccctgactgcacctccaagtggcactgacagaacaagaagccataaataaggtcgttttgctctcgaaaacctctcttctgactcttaaactagaaggcaaaaggtctcttgagatcaacaaagggccttccagcccatcctgctcctggattttgttttgtgcatctagacgcatgcagtgttttagccgccttccaccagctgcagctctggagcttcctgacagtccaaataaaaacatttgcccgg

SEQ ID NO: 1285 - DNA, 2536 bp, Homo sapiens
gcgcttcttccgggtggggccccgggccgaggcgatggcgccctgggcgctcctcagccctggggtcctggtgcggaccgggcacaccgtgctgacctggggaatcacgctggtgctcttcctgcacgataccggtgagccggaccccgagcgaccccggacccacccgatcccgcgtacttccccagacgttctggtcacactgggtctcccgcctaatccctggagatcctgggattggcccgatctccaccagctcctgaagccctctccccatctatcattccaagagccacctgctctctgtctgataccccgttgatccctaattaatcccagcatcttcctgatcattgccaaatgccctgtccatcccaggacccagccggtgcccaccagatccaaggaccgacttgagccccatgtcccctgatcctgggacccacatgatccttcccaggaactgaccccaaatcttcctatccatacgattaggaggctcaactagatgcaaagattggcattctgcccacacccacaccccccacacccccatggccactagctgcccaagtccaggcaaaccctcaggccagagaacactccatggggtgcggcctgtctcccatcttcccacagattcacccacccacccacctccatttccctcattcctcttagtagccccctacccagcgcctcacctgccacaggcagcctcccccactgtcccccacagcagaccccagccctccttccatggcggtccagcctcagtttctggactggggccccttctggctttcctcccaagacagacctcctccaccaccttcaccctttagcctaaaaacttgctcaggtctccgtatcagaaaacccccctcaaaacccaccctttcttctctgctcccccttacaaccaagggacacgggatttgtctacactctgctgtctggtggtctcatgccccctcactccttgccctgcaccctacctccccaaaatcctgtcacctccctgggctgaagcctgctggacccttccgtatgcccctctgcagcatctgagcctgccagctgcacccttcccactgtatctctctcaggcatttcagacctaaccagtctctcaccattgcagagccagagacgctggacccctcttccctctctcccacatccagtcaggtctggctcccttgacccagcagccccctgtccattccttcctccctcacttcctgccaggcctttgtagcgactctcttcttcctcctggccagattctctgcccccaggcttcccctgatccatttctttagcaatgaggttttccaaaacagatctggctctataaccttccatggttccctctgaccctccagataaaagtgcagatgaactgctggccacacacagccactcatggaaccaacatctccaggcctttgctcagccaggaacacacttccccacctccaactgcaccccaaccccacccactcctgttctacccggcccagcctcactgtgctctccggcttctccagagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatgccctggggtctgtggttgcggtccagcgggctcctgttcgccaccttcctgctgctgtccctcttctcgttggtggccagcctgctcctcgtctcgcacctctacctggtggccagcaacaccaccacctgggaattcatctcctcacaccgcatcgcctatctccgccagcgccccagcaaccccttcgaccgaggcctgacccgcaacctggcccacttcttctgtggatggccctcagggtcctgggagaccctctgggctgaggaggaggaagagggcagcagcccagctgtttagggttgctggaggccgggctaccgtcttgtgcctgaaaaccacggggcctgtccccagctggggtgagcgctcagagggcctggggccctcactcctgcccacgcctcccagaccccagaacggagcttcaagtcagacagatccctgccttggtgggcagttctgccttccaaggaagaaggggaagaaaaggacctgtgggtggctcaggcccaagcagaccccgggctccaccccagccccgcccaggctgctgccagtgcacacttttacaaatttaatataaagcaagtccagtctt

SEQ ID NO: 1286 - DNA, 1764 bp, Homo sapiens
acagaacacagcccaaactgcagacggatcacactgaggtgttcacagaactgcaggagaagtatggggagattgaagagatgaatgtgtgcgacaaccttggggaccacctcgtgggcaacgtctatgtcaaggtgcttgctgccccccacttagggcccagaagtggaggcgtttcaatgcctgatggtggccactgtaggctctcagcttgaatttcatcactaaatccagtccagccccagagcgggtagtgagtcccctgaagatctctgagttctcctgctgaccctgactgacatttcctgcagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtacctcaggaccagcctgctatgtctcctcatgtcctaaggcccctatatcctcagatgagcctaaccctaagccccagtaaccacgttcccaagaatctttttttttttttttttttttttgagatggagcctcactctgttgcccaggctggagtgcattggcaccatcttggttcatggcaacttccgcctcccgggttcaagcaattctctgcctcggcctcccaaatagctgggattacaggcacctgccaccatgcccggctaatttttgtgtttttagtagagatggggtttcaccatcttggccaggctggtctgaactcctaacctcgtgatccacctgcctcaccctcccaaagtgctgggattacaggcgtgagccaccactcccggctgactgttttttttttttttttttttttttttttttgagacggagttttgctcttcttccgcaggctggagtgcaaaggcgcagtcttggctcagtgcaacctctgcctcccaggttcaagcaattctcctttctcagcctcccaagtagctgggattataggcacctgccaccatgcctggctaatttttgtatttttagtagagatggggtttcaccacgttggccagcctggtctcgaactccggacctcaggtaatccacccatctcggcctcccaaagtgtggggattacaggcgtgaaccactgcgcccggtcattcccaagactcttataccctaagagtagttctgagctccatctggagaccagtacctaagtcccaatccccaaaccagcctgaacccctaatccacgaccagcctggattgccacccctgatactggccactgagttcccctgatactggccactgaggtcgtgtcttagaactctagttatttcagcaccctcctgcctcatcccagagcagagaggcaggcctgcaggatctctgcaccactcctcagggttctaacagaactctcaacgctcctattcccaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatc

SEQ ID NO: 1287 - DNA, 2200 bp, Homo sapiens
gtctttctatactttacagcctgatttagcagctaatgaagcccagcttctgaggaaaattcagttgttgtgcctcatggaggtaagcgaacacccaggagccactttgtctgtggtttcagattttggtcaggtgggggcgctgcactctccaagcctgtgctgagcagtgtgagctttcagtggtgctgcttctgctgtgcgccgctctcttcaccaccttccttttcctttgctaccacttgctcttttaagtttatatttggctcttagctcagacgacaccctctcaccccactgccaccaccctgaggccttccctgaccatctgaactgagatgaagtagctgcccctctccccgtgatgcagttgttgcctcattgcatgtcgcttcttgtgtatacgcacatctgtctttccccactagaacttaagcttcgtcaggaagtggcccttagatttctggtttgccgtggtcacccctggtcaaccctggcaaattgtggcctcaagtacttgttcggggattgaacaatggctactgtcagaaactcctgtaaggcattttgctgttatccttcttatctaagcattaaaagcttgttcttaacaagatatatgtctaatattaggaaactttttagtatgtggggtactaataagatctctattttcagagccaatattgacaaaacatccttatcagttctctatttttatttggaaaaatagtttaaaatagttaataaaattttttccagatgactttcacacggcctgccaatcacagacaactcacttttgaagaaattgccaaaagtgctaaaatcacagtgaatgaggtacggtccctaggctcagggtgttagagcagcgaagctgccacatggaggagtcaaggctcttgtgtgagcgctgtgctccctagacagtaaaaaatgacgggaggagcggcatctgcttctcacaagccatctgggtccatgggggtgtgtcaggctatcttgtcttacacacgcctccctctctgcacaggtggagcttctggtgatgaaggccctttcggtggggctggtgaaaggcagtatagacgaggtggacaaacgagtccacatgacctgggtgcagccccgagtgttggatttgcaacaggtgatgtgtttgaaacccattattcacctctgtggattttgaggggttgtgtctataccgtcttagtttcatttggatggaagccatttgggaagacagcattattagacaagaggttttggagaaggaaatactgctgttgggtttttctaagagcctaatttaatgcaagcctagggtttgaaccctgcatttaaaagcttatgatgacaatggcactggttgtgctgacggtgccttttaatcttaagataggagctctgatcagatacgttcctggttctgtgatttgagctcacgtcgctcttacatttgctggaaatgcgatcctgtggatttcctctgtccttgtctgctttctttcatgcaagttttttctaacgttcctgtgaaaagaattaacccggcaagtcccgtcccactcccccagctcagaggtcctttttactagagctgccctagagagttagctggagatgtagagtcaccccatcaggtgctgtgccggccgctcggcctgtgtctcctgcgtgtcttaacgtcccttgtgtccggatttccatttcagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttct

SEQ ID NO: 1288 - DNA, 2144 bp, Homo sapiens
ttagagtgtatttctagtaaaatcagaagctcaccaaagcaacatgcttgagattttgtcattttaaaaatatggttacacgtaccttagatgacccaagatggttttctggggtctgtccctgcctcccagttgtagccagagaaggttgttgctgtgggctggaggtcactttagttgcctgtttctcatggttgtgatgtgtgctccagggtcaagccgagccacgttccttctcagctcagttccacccacgtcagtcatttcagctgtgtgctttacttgcggttgcggccctggctgtgaggtggattcttgtactgccctctgtcagctgtttacagatgggttgactaccactgccagtattgccatcatatcgccgctcggcacaaaagcctcatttcctcccagggttgggtatgctccaccccatcactctggtgagggccccatgagaaggaaaaggcaggagctggcgccaggaatggactggcattggcctttgtatttaattttaactctttatcacccaaatcaggtacgtttggaataaacctaagagccactctttggggtcatgtgcagctgaccagggtttgtgcagtgatcttcttcagaggtgttcccttccgcctggactcattttcactccgccccttggtctctctgtcttatcacgtgtgtacatgtctgtctgtctggttttttatcttctccgtctgtgcctctctcctcccatctccaccccttcctgtcatcctctatgtcccactgtctctctccttctctccagttttggtcccatcttcctgctacccttggccctccctgcagccccttccccctgccttgctgctgccgcacactttgcaccagggcctttcatggcccctttccacctcccttgcagctcaggtttcctggcttctccatgcactgtccctgcccacactcgcttctccccaagctcccaggttccatccctaggcccatcatacccctggcattggctaatccctcatgccaggggccaggcacttgcaagtctaacttcatcttcccaacaaatttaggaggtccgcagccttgtgatacccacatttacagcggagaagactgaggtccaaaaaggaaaaagtctccatgaggtcagggaccttgtttgtcttaaatatcactacatccctgctgtatggtctggcaaacagtagatgctcaacacatattgttgaatgaattgctaatgtaagttactaattaggtcattatttcctatttgtgagtgattttgcctccaggaacatttggcagtgcctggagacatttttggtggtcacaagtaggggagacgggtgccaccagtatccagtgggtgaggccagagatgctgctgaacgttctataatgcggtaatgcacggaacatcccccacaacacaaaatgatccagcccaaaatgtgagtagcgccgaggcggagaaatcctgacttggaagaagaaagccaagtactttagagaagaaaaacggtctcagctgaacctgtagtgagagcatgcaggagagtgacctcaccctgcccctctgggagcaagaagaaaacctatgcatgtacgttattataaatcttcaaagaacctaaaaggcagaagtgatccctattttgcacatgagaaatccaaaattcagagaggttcagcaacttgcccaacatcacacagcaaccaagggcagagtcaggtttagagcccatgtccacccatgtccatctgactcctgagcctgtgcttctcccacattcccgctggagcagcagcagcatctgtggcatcacctggatgctggttagaaatgcaacatcaggctgagcatgttggctcactcctgcaatcccaatactttgggaggccaaggcaggaggatcaattaaggccaggagttcaaccagcctggacaacaaagcaagaccccatctctattaaaaattaaacagccaattagtctggcatggtggtttgcgcctgcaatcccagctacttgggaggccgaggcaggagaatcgcttgaacctgggaggcgaaggttgcagtgagccaagatcgcaacactgccttccagcctgggcaacagagcaagacatctc

SEQ ID NO: 1289 - DNA, 2193 bp, Homo sapiens
aatctaatcacattttctgcctcaagggactgagcagctcccaataagattttcctgagtgtgtctctgcagcagttggtgggagtgacacgactggtgagactgagacagcctggggctcagagcagatggtagtctgaaagggacagaatgagagagggagctggagaaagaaatgaataaacacgaatgcatctggagaatgaggcatcttggaatctggaaagtgaggcatcctggaagagagatgaagatggagtctcactctgttgctcaggctggagtgcaatggtgtgatctcggctcactgcaacctccgcctcccgggttcaagcgattctcctgcctcagcctcctgagtggctgggattacaggttcaagctccaagatgtccagaaccaaacgcgaagaagaattaatgaaatggatatatgcaaaactcgtcaagattctcatttggctacagcaaattatttggcgagttgaaagtttagttgtgttaatgatatgctacaccttctatacctgtaatgtgccaaaaataactgaacactttagatttctcgttaaatccagtaataatccattaaagagataaaggtgccaatgtgcaggcaagtaaaccacattgccaagtatacaagctaatacatttcccaggatggatttagagtttcctatttcaagcaaaatttacagaaagttaaatgcacaaatcttcagtgcacaattacacgagtttagcaactatatacatccatgtaaacaacactatcatgatgcagaacatttttatcacccaggaaattacttcatgtccccttccagtcaatccactctccacaggaaacaactagagttctgatttttatcattatgtactagaacttcacatcttaggaaatcatatagtgctgtctcatttgtttcttgctagtttaggcagtatcatttttttgaaatccattcatattgttccatgttatcagtaatttgttaccttgatgtagctgaggagtattccattatatgaatataccacaacttatgtacccattgtactcttgacattggctattgttagtaaagcttttggctatttactagtaaagctgctataaacatgctcaagtcttgttgtagaaacattttcatttctcataggtaaatagtcagggatggaatttctgagtcacaacagaggtatatgcttaactttatgaaaatcatcaagctgttttccaaactggatgctccattacctacttctctgagtaagatctgggagttccacttactccacatcctcaccaacatttgttgttgccacaacgaagtggtgcaatagtttatttttattttcgtttacatttctctgatgattaatgatatcaagcacattttcatgtgcaattcaccattttttttaaatgtccaaaactttcattcagttgtaaaaaaaaacaacagtatctttttattaatggtttgctcttgttctgggtgaagttcatcatcgaatatatattgctaatattttttcccacattacagctaaacttttaattttcttttgatgggcagagaatttttgttgttttatttttgtgaaatccgatttattgcttttttgcagctagtgttttttctttcatctctataaaatcttgcctagcctaagattgtagtatagtcttctgtgttttttttcttcataaaacctttacagctttagcttttataattgaatctataatttatctacattaattttgtgaatattgtgaattgtggctaagaagattcattatttccatggttatctagttattccagcactgtttgttcaaaaagactttccattgaagtgtctttgagcttttattgaaattaactgactatgtgtgtattgatttctttctgagctttactttgtcccagggatcagcttgtataaccttatgctaatgcaatactatcttgattattgtggcttgctgcaggtcttgatataaagtaataatataatttatctgaatttgttctttttcaagatagctttggaagttctttatttcttgtattttcatataaattttagaataaacttgtgtatttccaccaaaaaaatgcaaatttcatttagtttgtaattaggtctaatcaaaccatattaaatcttccagttcatt

SEQ ID NO: 1290 - DNA, 2577 bp, Homo sapiens
ctcttgctttacagtaactctcctcctggggaaaaggcttttcacggagcaggctcggagcctacggggctggcctcggactggatggggagggtgctcaacttgctggagtcatctctgctatggctttatttgccaacaacagagaacttgctctgcagcagccccaggctctctggggaccccacaggctatgcagatcccccaccccagaaccacagaaggagacagagcagaagcacaccccgtcttccaggcccaggacagctgctgagctccaggacacgggctcttgaaggttgattttgactacttactaagctccagctgaaccagttccacttctttaaccttcccatgatccctgtgaggggtctgtggtattgctatttgcaagtaaagaaagtgagattgagggaggctgaaagacttggccccaagtcacaatgccctgctgaatgtggtgctgcctcctggatatcctgggtgcttcaacatcaacagctcttggcaagtgagtgggccacgaaggatggacgagggacatgggggagcaagcccagctgcatggttccagctctttccgccacatcacagcttctgcagttgggaagactgaacagtgatcttcagtttgttcgtcaaagggccaagaaatctgtgtcctcaccttctctgcttcaattctggtgctgcttaagccgattatcatttcatgccctaaaccaaaaaataaactctacaaacatcaacattacataggacaggatctggcccacagattgggggcaggagctgctttttcaatgagaagaatgaacagacctagtgggcgttgcctttagacccaggtaagaggaatcccagccttgggacattactttcaagggccaagcccataggccatccttctagaacattctttgggtagctagggcttcataagtcacttactgggtttgtcctccttgagtggactgtgttgtcggtgtgcacacctgtatttccatggaatggtatcttagtcctgctgctataacaatacctgagactgaaaaatgtataaacaatagacatttatttctcacagttctggaggctgggaaatccaagatcaaggcaccagctggtttggtgtctggcgagggctgctctctgcttccaaaatggtgccttggggctgggcgtgatggctcatacctataatcccagcactttgggaggccaaggcgggcagatcacctgaggtcaggaggttaagaccagcctggccaacatggtgaaaaccccatccctactaaaaatacaaaaaattggccaggcatggtgatgcatgcctgtaattccagctacttgggaggctgaggcaggagaattgcttgaacccaggaggcagaatttgcagtgagccgagattgcaccactgcactccagcctgagtgatagagcgagactctgtctcaaaagacaaacaaaaaaccaaaatggtgcctcattgctggatcttccaaaagggatgaacgtatgttctcgaatgacagaaaagacagaagggcagaaagtgtccaaactcactccatcaatcccttttataaggtgctaatcactccctaaacaccccatctcttattactgttgcactggggattcagtttcagcatgagttttggagggatacagacattcaaaccacagcattgtgcacactcctttttctatggaatggccaaggtgcagctatttgcagaggctctgacagagctccgctgtggagctggggtgtccacatgcctgtatggaagaactttcatggcaccggagcctggtgggaagagaagtgggctgggctatagactgggcaccagggactatcacctcgtgccaccacatttagtgtagagttccagagaggccacaaattcttcatttgaactggactccccagcctcatgttcctctgcaggatgtaaaaggtaatgccagcagacgttggcagtgctggagacacctggtgggcagaggttacctggctggagtggcaggtgtgaggagatgcctcccagcataaggaatgtgggcttctgttggatctcttgttccaggcctcacacatgttcaaggcagcctgggtatgtcttggcccattcaatccctcaaagccctgtttaattctcatcttgctgtcacctatgtggtgccaagaaacaagtcaccaaaataatgaaatgcctacctaagcttaaaaacaaaaccatgaggtctttctaaataaattatgaaaaagtgcaaactgcaggtccctgtaatgatttcaaagactccgttccaacaatgcattaatttaaaaagggagtataaggcaaaggggggtgattagaagaggaaggcagctgacatcaaactgaatataccaagtttcctcctcaaaaacgagtgtgcattatttgtggtgaccattcttggtattgttctattacgtaaaacacagcatagcatcattcttttagatgccattcatttaatatatgggcaaatgtacatggttaggctagactggagcacttgtctacactgctt

SEQ ID NO: 1291 - DNA, 2325 bp, Homo sapiens
tacaattgggccactctgatcctgctgtaggggtctgagactggttctctgtttccaactaagtggatctagccagctgcctcacacagagttgatgctcagtaaacacttaagaagtgcgaaggggtggatccaagttagaaataagaatggggaattagccaaagccagggcccctcagtcccctgtgccccaacatctattcttctgatggcagatggttcacctagttgagcagcctctgggggctctgctcagcatcccacccactgactcggtcgctcaccccatgagagagattaggagctttcacaggatcttggaacatccactacaggctgtgtggagccttccctctgtgaagttgctggtctgtgagggtggccacgctgcgctggggtggggaggggactcaggggcctagaaaagagcagggccttcatctgagcattcttccatccctcctgggtaaggcacacaggtattcattcattccacaaagataggttgtacttaagaaataattgcttgattagttaactataatggtttgtaggtgttttaccaaatgtgcctggctcagcaggtgcttaatgcatatttgactaattaatgactagttttcaggcccttaaccagatgtgcttagcatagtgcctgtgccataggtgtgcagatagtaaaatgaataaattaatgttcgaatgaacgaaggggtaggaaggaagatcaggctgggaacagcctttctctgctgagtgtatgtatattgtgtgatcgtgtcctggtgtgtgtgtgtgtgtgtttgtgcctcctctgctaacaggacacaagctcgtcatcctctcctgccactgccatgtcgcctcagcctaaatcagctctagttctgaaccccctcctggtcagtgtggaccctggccagcacgtctgcacagctcttggctcagagcagcgggagctggccagactccggcagccagtgttaccctgagactgcccctcggagctccaaagatatgtcttcaccagaaaccaggggggagtccccacgggccagctcctgatgatcagacccaaaacatttctgttgttattgcccagtggggccccttgggaggaatcctgcttctgcctctgttgtgtccctctctgggtctcagaagggttttctccagcctggacctgggagaggaacattcttcccctggagtggagctgggcagagtatcaggtgacccctgagccacctgggaaagcagtgaccaccccagatattaacagtaacctcattacccaggagcaggtgctggtgctggccacatctgagcaaacatcaggccagtcaaagcaaatctggccgggcgcagtagcttacgcctgtaatcccagcactttgggaggccgagatggacagatcacctgaggtcaagatgttcgagaccagcctgaccaacatggtgaaaccccgtctctactaaaaatacaaaaattagccagggatggtggcgcacaactgtagtcccagctactcaggtggctgtgatggtgcacaccggctactcgagaggttgaggcaggagaatcacttgaacctgggaggcagaggttgcagtgagccaagatggcaccactgcactccagcctgggcgacagagcgagactccgtctcaaaaaaaaaaaaaaaaaagaaagcaaatctgatgattctgaaggccagcctctgggaatgtctggacacatagtacgtgtttacttaccttcctgctatgcttcctttccagaaacatgctggtgctttgcaaacagaggcagcaaaacaaacaatacattctccaagaacatattttaaagaaagcattctacacagttttgaggccaggctgtccagatgagtgtctgtaaattaaatctaggatctgtttctgctttctcaattgatcacgcatgtcccaacggaaagaaatgtttgctgcctctgcaggtggtgaacaagtgctgaataaggcctttcattcattcggttgttcattcaaaaacacgtattgaggccgggcgcagtggctcacgcctgtaatcctagccctttgggaggccgaggcgggtggatcacctgaggtcgggagttcgggaccggcctggccaacatggtgaaacctcgtgtctactaaaagtgcaaaaattggccaggcgtggtgttggatgcctgtggtcctagctactcgggaggctgaggcgggagaattgcttgaatccgggaggcgggggttgcagcgagtcgagattatgccactgcactgggtgacagagcaaaaactctgtctc

SEQ ID NO: 1292 - DNA, 2400 bp, Homo sapiens
aatgtctgttgaactgaatgagtgagggtcatgttgctctctcgcttaaaaaccttccatggctccctattgccttcaacatgcctcctctgggcagcttggcgttcctgcctcatcttccactgccaccacccatcccacacacctcctcctgtagctgcgctgggtcggctccccgtcggctgagctctcgagtcctttctcatcatggtgctctgctcatatcatcccccttgctgcctcctccgtgttaccaagactcagttcaggcatgaagtctccgtgggctctgagggttcggggctcttccggggtagaatttgtcgttcccacctctgttttccatggcactttgtacagactcctgtacaaagacctctgtacatgtgtcacgctgttttgtgatcatgtgtttctgtgtctgtctccctcagtagactgtgagctcctcgagggcaggaaccgtgtcttactcatctctgtattcccagcgcctagcacagtgcctggcacagagtacgttgttcataaatgtgtgttgagtgcatgacggggtggggggagatgaggaggagttgctgggactgggaacattcgtgcctaggacagtgcctcgcattatgtaggttctcagtaagcgtgaatggtgtgtctgtgtgagtggggggccacgaggcatgcgcatgtccagcaaagggctcactacccctgcccccccagccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcggcgcctttggggacctcgaccagaaccaggatggctgcatcagcagggaggagatggtttcctatttcctgcgctccagctctgtgttgggggggcgcatgggcttcgtacacaacttccaggagagcaactcttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagcagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaatt

SEQ ID NO: 1293 - DNA, 1879 bp, Homo sapiens
tagaaaccacaatttcacaaaatcttttaccttttgtgagtttagtagtcacaacatttaggtaggcttatactgataaaatcttggctatgaatacctctgaagtaaaatcaactagtatagaatatgcagatgttaaagcaatacaaacttactatcttacgcttctgtggattagaagtccaacacagatctcactgggccaaaatccagatgtcagtagggctatgttctgttttagggcctctaggggaaaatctatttccttgccttttccagcattttttgactcatgtccctcttccttagtgcaagatgcaagactaatttactttaatttttaaggtaaaaatggatggacatagtacctaaagtttaattagccttgttagatttattttgttgagtttaatatatatggaacttgatttacctcattgttactataaatatttgttcagacctgatggccaaaagaaaggaagaaaatttttcctctcctaaaaatgccaaaaggccaagacaagaagaattggaggattttgataaagatggtgacgaagacgaatgtaaaggtactactttgactgcagcagaagttggaataattgagagtattcacctaaaaaacttcatgtgtcattcaatgcttggaccttttaagtttggttctaatgtcaactttgttgttggcaacaatggaagtgggaagagtgcagtactcacagctctcatagtcggtcttggtggaagagcagttgctactaatagaggatcctctttaaaaggttttgtgaaagatggacagaactctgcagatatctcaataacattgaggaacagaggagatgatgcctttaaagccagtgtgtatggtaactctatacttatacagcaacacatcagcatagatggaagtcgatcttataaacttaaaagtgcaacaggctccgtggtttccacgaggaaagaagagctgattgcaattcttgatcattttaacatccaggtggataatccagtttctgttttaacacaagaaatgagcaagcagttcttacagtctaaaaatgaaggagacaaatacaaattcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctggtttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaacatttatctgcccttgaaaaagatattaaacacaatgaggaacttcttaaaaggtgccaactacattataaag

SEQ ID NO: 1294 - DNA, 1837 bp, Homo sapiens
agatcagacccacggggctgccctcccctgcgcactcccctcgctgcccgggcccggagcgcagcgcggccgcacaggtatttttgctgtgctgtgcaaggaactctgctagctcaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagtcctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtagagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggg

SEQ ID NO: 1295 - DNA, 3243 bp, Homo sapiens
aggccagggaaagaagtctggaacaaagggaagacagatgaccatgattgacttcattcttttacctcctgagatggcgatgggatgggggacacacaggaagaagcagggtccatgagcctcagcccttggcttaggaggaggagcagtacatttccacctaccttctctaagacatcttccctttgcttaggcttacctgggggtggaggtacacagggaaggtcaagcaggtgtaccagggcacctcctggggaggggtccagatggggaggatgctggacatccccagaagccccatccaggagatctagcagatccaggagctgtgaggcctggcagaagggacagaaggggcagggctgggtatgaagctcagcccgtcttcctaccccagagtttctagccttctcacctggggctctgtgggcactggggctgcttctgaaagctgggctgcttctttgctttcctttgcttcctcatcagcctgagggccatctcgctccacaagaggcattttttccaggatggcagccctgagaggatggaatgcaagtgtgcctctgtgtggtctctgggcctttcacaagaggcatctaggatgaggactaggaatatggagccctgggcacatggtggctcagaagtacccttctgatttcctaaaatgacatgttgttgctgattttcagatgaacaaggagggttggaagccagcttagcttcaattaacagtgggtgggaagctctcaccgtggatatggaagaacacagggtctcactctgtcgcccaaagctcactgcagccttgacctcccaggctctgatgatcctcctgcctcagcctcctgagtggctgggactacaggcacatgccaacaagcccaggtcctgggatgacccgagcaatcctgtgcctgctactctgctgcccaggacactgagagaaccagtgttctctgggaggaaaccactggtcatggtcttactgctatgccctctctgatccagggatacagcagtgaaaggtcaccccacctgcaggaaggggtcgctgactccagatatgctgtgttctgtggagtatcccattgtcaccagagtccggaggatgtgtaccagctggggtaccacctggagggagggcacaactttgggcattcgttctaatcctctccagctaaagccccattccttccccactgaccctgtcttccaggcccagggcctgccccttcaccagcccacctttcggaagtgcctgagggctgcagggcttcgttcgcagagctccgtgatcagcgtgatggtgcccagcaggatgcctggggtcagcgtcggggaagtgaatggtgggggccaggggcaagagagtctattgcgtgtgtgcctgtgtgtgtgcactacccttctcctgtgagctggggttcccatccgattttcaattcttctgtccatagacctgaagcaaaggatggggggccccacagccttaccatggtgacgctcatgaagcagttgggcacagggtgggaggaagacactggagagttcagggaccttccggatcatgtgcactgcagtcagaatagcctgcagaggtcaggggcctcagacaggggtcagaggagatggacccctgcatctactactatatagcacgcagcaggcagtgtgcaggagcacgtgccaggagtcccgccatctcaccttcttgcgcacgtagggactgggctgcaggagcagtttctccacctctggggccaggtctcggcacatctcagcagagcccatggtgctcaaagtgcacaaggccaggccttgtactggctgaatcccctggctcaggtcactgcagggtttgggaggacggtcagtcaaacctctgagaaaatcagtccttttcaatacccacaacaggcagtcccctgggatttccaaggtccctactctcccatctccctgattccaagtgattgccagaaccctctcacttcttgatgctgttggtaatgagcaggtgggcatcgtgcctctcatccaatagaagcatggcccccaggtagcccaccctcttgtctgtgaatctggaggaggcgatcagtttcaggcactccatctatagtgaagggggcagaccaggaagaggcaggggtgaaaccatagacactcacatccctgttccatcttcctctttaaaaccagattaacctgtggggcatcatatctcatcactctccctttaacaagaggagaagcttaggaaattcaggcgttagtgggtaggaggaactaggagttgaggaggatgggagcggagaggaggagatgcctgccctaaaggaggctggccagagaatgaagggttcaggccagctgatgaccagtaggggtagcaatggggaaagaggtttgcagtgcaggctgtgaagactctgaaattgtagaatttaaaaaaccagggcataaacaggtgagagagtctgggactctgccccactagccttcatcaagctcaggagggaggtattcctggccagtacctgtccaaagtgggcggggtagcccaacatgtggacgtagagcagtttggccagctgccggtgcctgtgcactgggtccccgtcgcggaaggaggcccggatgtgggcacactccttttggatcacctcccgctcctgggcctgagtcttggccccgcgaatctcttcgatgaggtcctgaagcttcagcgaaggcaccaccatcctgactggcagagtccgggagtggagaaacactctctggtcgggcgtgcctgggctttcggcccaggcccgtcctgtgtcaagaccctaagagcccgggtcccacaggcagcggcagcggcagcgacagcctgcctaccccaggactccagcctcacctggcttctgcctcaactccgctcctctgccccccagcgcttcctggtacggggccgagcaggggttggtgctccgtgcggtccttccctctccccgcctccaccacgggaccccgccctcctgggccgactgcagagccttcctgaatcctctgacctcgggcctcaggctttagcggagagacagcatgataggcctggagttcttcaagaggcctcctcgcacatccttaccacccggagagcctcagtttggatttgaagccatcgcaccccaaaggagatgacaatccccccccttttttgaacttttttattaatatattttttttgtt

SEQ ID NO: 1296 - DNA, 2405 bp, Homo sapiens
agatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctctgctgctgctcttcctgggtcttgcctgctgtgcctgctgctgctgggccccccgatcagacctcaaggacaggccagcgagagatggagctaccgtgtccaggatgaagctgcaggtctgggggacactgaccagcttgggctccacgctgccctgccgttccctcagctcccacaagctaccctgggtgacagtctcacatcacgacccggaggtccccttcaaccacagcttcattgagccgccctctgccggctgggccactgatgactccttctcatccgatcctgagtctggagaggcagatgaggttcctgcctactgtgtgccaccccaagaagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagacgaagcagaagcccccgagtcctttccggcggctgccagtcccggggattcagccactggccaccggcggcccccacttggtagccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaaattttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctcccaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacag

SEQ ID NO: 1297 - DNA, 2367 bp, Homo sapiens
ggagtcagctggagttgcccaggccctgtgagcaagtggcaggcgtgcccagctgcattggggagagggctgttctcaaggccaaggtcatttttggagggagaactggacgcctgatcaaatctggcccacaatggactcagcagccaaggatgagatgcagccggcgttgtcccctggacctgagtggccagagcaggagcgggcagagcagctggcccggggtgcagcgctcaagtgggcctcaggcatcttctaccggccggagcagctggccaggctaggccagtaccgcagccgcgaggtgcagcgtacctgctccctggaatcgcgcctcaagtcagtgatgcagtcatacctggaaggcgtgcagactggtgtgtggcagctggcccaggccattgaggtggtgcagggaacccgggaggccctgagccaggcccgtgggttgctccagggcatgtcccaggccttacagactctagagcccctacgggagcgggttgcccagcacaagcaactgcaggccctgtctcacctgctgcctcggctgcgggcagtgccggctgcagtgtcccacacacagactctgattgatggccaacagttcttggaggcatatgtgagccttcgggagctggagcagctgcgagaggatacgtgggcacccctggggggcctggagttgccagtcttccaggggctggaccttctgttcgaggcactgggccaggctgtggaagcagctgcaggggccgcagggaagctggcacgggaggacccagccctgttggtggctgctgtgcgtgtggcggaggtggagactggacgaacaacccccctgggccaggtcccccgggactggcgtcagcgctgtctgagggcactacaggagggcctggagcaggcccactttgggtcacctctgctgcctgcaccaggggccctaccagggtggctggaggctctgcgagtggccctgccagtcgagttggccacagctgaggcactagtagcgccttgctgcccgccacagtacaacgtggtccagctatgggcccacacgctgcatagtggtttgcgccgcagcctgcagaacctccttgcagggcctgagctagaagctgcggatgccttcgccttgctgcactgggcactgcatgtgtacctggggcaggaaatgatggggagcctggagttggggcctgaggctgatgtgtcccagctggagccccttctgaccttggagaacattgagcagctggaggcaacatttgtggccaacatccaggcaagtgtgtctcagtggctgcagaatgcactggatggggaggtagctgagtggggccgggagcatgggcccaacacagacccgtctggctcctattactcaccaatgccagccattgtgctgcagatcctggaagagaacattcgtgtggccagcctggtcagtgagtcactgcaacagcgagtgcatggcatggcactgtcagaactgggcacattcttgaggagcttcagtgatgctctgatccgattctcccgagaccacttcagggggaaatcaatggcccctcattacgtgccctacctactggccgccctcaaccacaagtcagcactcagctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaacggacggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttgggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccgg

SEQ ID NO: 1298 - DNA, 3346 bp, Homo sapiens
agagctggagccggagccaagggagtccaggctgccgggggctgcagacatggagggccagagcagcaggggcagcaggaggccagggacccgggctggcctgggttccctgcccatgccccagggtgttgcccaaactggggcaccctccaaggtggactcaagttttcagctcccagcaaagaagaacgcagccctaggaccctcggaaccaaggttggctctggcacctgtagggccacgggcagctatgtcagcttcctcggaaggaccgaggctggctctggcatctccccgaccaatcctggctccactgtgtacccctgaagggcagaaaacagctactgcccaccgcagctccagcctggccccaacatctgtgggccagctggtgatgtctgcctcagctggaccaaagcctcccccagcgaccacaggctcagttctggctccgacgtccctggggctggtgatgcctgcctcagcagggccaagatctcccccagtcaccctggggcccaatctggccccaacctccagagaccagaagcaggagccacctgcctccgtgggacccaagccaacactggcagcctctggcctgagcctggccctggcttctgaggagcagcccccagaactcccctccaccccttccccggtgcccagtccagttctgtctccaactcaggaacaggccctggctccagcatccacggcatcaggcgcagcctctgtgggacagacatcagctagaaagagggatgccccagcccctagacctctccctgcttctgaggggcatctccagcctccagctcagacatctggtcctacaggctcccaccctgcatccaaacctccccagaccctcggctctccccctccttccgagcccggcctgaggccctccacagcagccctgaggatcctgttttgccacggccaccccagaccttgcccttggatgtgggccagggtccttcagagcctggcactcactcccctggacttctgtcccccaccttccggcctggggccccctcaggccagactgtgcccccacctctgcccaagccaccccgatcacccagccgttccccaagccactccccgaatcgctctccctgtgttcccccagcccctgacatggccctcccaaggcttggcacccagagtacagggcctggcaggtgcctgagccccaaccttcaggcccaagaagccccagccccagtcaccacctcctcttctacatccaccctgtcatcctccccttggtcagctcagcccacctggaagagcgaccccggcttccggatcactgtggtcacatggaacgtgggcactgccatgcccccagacgatgtcacatccctcctccacctgggcggtggtgacgacagcgacggcgcagacatgatcgccatagggttgcaggaagtgaactccatgctcaacaagcgactcaaggacgccctcttcacggaccagtggagtgagctgttcatggatgcgctagggcccttcaacttcgtgctggtgagttcggtgaggatgcagggtgtcatcctgctgctgttcgccaagtactaccacctgcccttcctgcgagacgtgcagaccgactgcacgcgcactggcctgggcggctactggggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgacctcgtgttctggttcggggacctgaacttccgcattgagagctatgacctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacataccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgcggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctc

SEQ ID NO: 1299 - DNA, 2444 bp, Homo sapiens
aatgagaggacccgcgtgggcaccctgcaggtggtcagacatgtcatcaactcagctgctgctcagatggaagataaaaagccctttatcctgtcttccatgaggcttcctctcctggacaccaacagcaaggtgaagcgggcagtggtgcaggtgattagcgccatggcccaccacggctacctggagcagcctggaggtgaggcgatgatcgagtacatcgtgcagcagtgcgcgctgccccccgagcaggagcctgagaagccaggccccggcagcaaggaccccaaggccgacagcgtgcgggccatcagcgtgcgcaccctctacctggtcagcaccaccgtggacaggatgagtcacgtcctctggccatacctgctccagttcctcacccctgtgcgcttcactggggccctgactccgctctgcaggagcctcgtgcatctggcgcagaagaggcaggaggccggggccgacgccttcctcatccagtacgacgcccatgcgagcctcccgtctccctatgctgtaaccggaagactgttggttgtgtcttccagcccctacctaggggacggacgtggggcagcggcgctgcgcctcctcagtgttctgcacccaaacattcaccctttgctgggtcagcattgggaaacgactgtcccgctgctgctggggtacctggatggtgaggccagggtcaggatggggtgcatagccctgtggggagggcaggtctcagagtaggagggtgctagctctgaccccacctttgccaagtggcactagggtggccaatggggactagggttgtataattggaaaatacagtctcccctgttgtccaagaaaggccccagatgacctggggcttgaaaggcactcccgctgggtgcttcctgggagcaggtggggggcagcggggcggcggggcctgtctgtgctgagcatccccagctccagggcaggtgctgggctctgagccccactggtgcgttttgggatgggctggcctgcgcggctgtcgtttcagagcacacagaagagaccctgccacaggaggagtgggaggagaagctgttgatggtgagggccggggtacggcccatcctgggccttaaggtgttgtctggcctggggggtgctggggtggcagaggctgggccacctgcctcgacctcacctcgtggtttggctggggagccaaggatcaggcagcatcaaggctgaagaccccagcagccttgcagcgggggccttgctgtgacaaggcaccggccctctagcagtcgcagccccaagcgtcgggggcaacctctcaccctgcctggtgagccaactgtggcatggctgtcccctgagggttggctctgccgcccccggcctccgctggaaggcggtctgcagcccctgcagccacagcacatggggatgtgcccaggctccagccagccctgtgaggggtcgggctcccagcccctcagtggcatcttggcctgcagttcctgcgagacaccctggccatcatttctgacaacgcgtggatctgccagctgagcctggagctgtgcaggcagctgccctgctacgatgaggcaccccaggagaagaacttcctgtacaaatgcataggcaccaccctgggtgctgcttcaagtaaggaggtggtgaggaagcaccttcaagagctgctggagacggccagataccaggaggaggcagaacgcgagggcctcgcctgctgcttcgggatctgtgccatctcccacctcgaggacacgctggcccagctggaggacttcgtgaggtcagaggtcttcagaaaatccattggcattctcaacatttttaaggatcgaagtgagaacgaagtggagaaggtgaagagtgctctgatcctgtgctatgggcacgtggcggcccgggccccccgggagctggtgctggccaaggtagagtcagacatcctccggaacatctgccagcacttcagcaccaaggacccagccctgaagctgtgccttgtccagagtgtgtgcatggtcagccgcgccatctgcagcagcacccaggctggctccttccacttcacccctgttcaccgggttcctggtgctgcactcggagcccaggcagcagccgcaggtggacctggaccagctcattgcggcgctccagatcctgctgaaggacccggcccccgaggtgcggacgagggctgctgaggccctgggccgcctggtgaagctcgcctaaggctccggccagcacccccagcgaggagtatgcacccagacctgtgcctgagctccaagacagggcctcctgaggaccacagcctgggcacacgactggaggggcctggccccagaacaggcactgctggggaccaaacccaagcccttcagtgagggatgtgcccaataaactcatctgctccc

SEQ ID NO: 1300 - DNA, 2566 bp, Homo sapiens
attttttatgagatgtaattccatgtcattgtccttgtcacggtggaattactaacttgcggtggattgtaggattaaccctctctgtgcacttgggcgcccctccagcgtcagacccacctgtctgcttggccgtgccctcactcctggaacttgctctctctggacagaagtctttgtctttgctccttgtccgctgtcttacagtctccgcggatggcaccatctctctgccacctgcactgggaactgggtccccatccctgccaggctctcctctgggaccactgcccttcccacgttgaaagctccctgtccccctcacccactccgtggctgggtcctgctctccacttctgggccttcacggtgccactccttttctgggctgctcccagagtgacctcaacatgccacttctcttcttgactcctcttgggggactcaggatggcacagagggtccctcccctcacctgccttctgcctgccccttctcccacctgtacccagccacacgggaccacgtgcagcccccaggagcctgtgctgctcaaaactgcacctgggcacctgcgcgggcgtcagccccatcaccgctgcctcgtcctctgtgaggcctgcctccagccatcctcttagccctccctgtcccagtctcagtaggctcctgactgtcaaggaacctagaagagcacctgtactgtgggaaaacttcactcactgccagccgcccggcctccctctccttgtcagggagccctggagggtgggggcaggtcacatttgtcggcagctctgagccagcaccgtgccagccgctgtagttgttcagtgtttgttgtagggatgaggattgttgttttagagaagcttatatttgatcttcagtttttgtgaaaagttgggtttcattcgtcaaaggaaattccccaggtggtgatgactttcagcctcatactaccttgggctggggcctgctgaggctgcgggacctgggaagcaggctgagccccgggaggtcaggagactggccacgcagacccaggcccacgagaaggccacgccttgaggacggctccctcctctggttccatgaggccgggactgcgtggcagaggatggaggaggcgtggggccttgtcttcaagttgtcgcttgtgttgtcagcttccccagaagcaattgtggtgaggggccgctgtgactgatgacgctgattagaagcagcgtcttgtctgtagttttcagagtgataactacagaaagaaagaagcagaggttaaatgataaacatgttctttgtttttttatcaaattaggtgtcacaattgggtgggggtgagattatggttcttttttgacaacggtgccttgaggttcctaagtgactgggcttcctgtccccattgctccccgctgcttctggtaaatgggttttaatgaactaagcagctggctgcgactccctggagttagactggaggtctccaccctgacccagcaggaagccatgcccccacctgaccaccgtgaccacggtgggagaaggaaggggttcttgggagcatccacgtggcttatctctttgatgatgccaaattctctgacaaatttaacgatagtgttgggtggaaattgggggctcctgatcggaaggggaagcctctctcgtgtttgcttggctaaggggttatcagatgtgcacctgagacacgctgcttctgggttccttgtaatcatcactttatgaatttgtggattgctgttctaggcaagctgtatgggagaggttcgactgatgataagggcccggtggccggctggataaacgccctggaagcgtatcagaaaacaggccaggtatgccccccacgctgacttctgcctgagtcctgggttccatctgagccatacaaagacaggctctctgttcacacgacagcttataaagctcacaggaaaagataagacaagcgtcccccagcccttatcagcacagatgactcggatgtaagagtataggtttgttttccagctttaggaaacattcaaagtgtaattgttttacagctgcttaaaggtcacaatattggcgactcagcgtgatttttgccaccgcatgaaatgtgacttttcagtccctgcctgtctctgtgagtgtggtcccttgccagaacatagtgcaggctctgtcacatcacacaggcccctcactgtctctgtgtggtttacgtcctcctaaaaataaattctgatttttaaaatgtattctctggctgggtgcagtggctcacacctgtaattcctttgggaggaattactttgggaggctgaggtgggtggatcacttggggtcaggagttcaagaccagcctggccagcatggtgaaaccccgtctctactcaaactacaaaattagccgggcatggtggtgggcacctgtagtcccagctcctgggaggctgaggcaggaaagttgcctgaaccagggaggcggaggttgcagtgagccgggatcatgccactgcactccagcctgggtgacagggcgagactctgtctc

SEQ ID NO: 1301 - DNA, 2163 bp, Homo sapiens
agccagccaggaggacgggcccgcccgcgcgctactcggagcccagcctcgttgcggccatcgccctgccggaccgcgcctcaggctcccccagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggt

SEQ ID NO: 1302 - DNA, 3153 bp, Homo sapiens
cagtcttcaggcctcaccacgtgctactggagtaacacccgtgtcagttatggagcctcacacagcagatgtgtctagtaaatactgtgaatagcgtatactgtgttttgcttttgttttctttagtaatgaggtctcgttatgttgcccaggctggtctcaaactcctgagctcaagcgctcttccttcctcggcctcccaggtagctgggattacaagtgtgtgatactacgcccagctatactgcattattgaaccagcttcctggctgtttcccctactctgaacctggtggtctgtaacccctgaccacagctgttcctacagtgggaagggcctgctcatcaggggctgtggctcctggtcccgctgcaccagggaggtggggtcttaccgggatcaataggcaggcagtcactttctcttcataggaatcttgtcgattggcctggctgctgcctactacagcggaggtaaagcaccccccgccccacccccccatgactgtctcagctgtttggaaaacagagaaaagaaggaaaaactgtcatttgtgactgtccatggggcggcctttaggatcggcacctctgccccttgattgctggcgggcaccgcgccctccatgcgctgctgttcttccgcacgcccatcctgcccagcgctcggcccacatttcacttcttcttttttttttttgagacggagtctcgctctgtcacccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccactgcgcccggccacatttcacttcttaagtcttctgtgtttttgggtcatcaaatattcccggagagatgctcttgaggatctaagatccagctgtgggatgaggtgtacttcccaccctgccacaatcactgggcctgcccagacgggcagaggccctgtgcgccccacctgcctctctcacgtggactctgggggtcagagctgggtggggtgtgccgcgtgtgggtcctgagtggccagggcagggtcagcagcacaggaagctgcccagggggtccttgcaagcgtgggctctggccagcgtctgggggaggctgtgctaggcggggcctcccgtgggcatgtccctggagctcacaggctggcgccctatgcccatctccagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccctgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggtgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcgggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtc

SEQ ID NO: 1303 - DNA, 1939 bp, Homo sapiens
aaaacgggtgtccgtcccagctccggtgagtggcccctgctggaccgtggatcccgggcgggcgtgcgggcggcagcgtacgaggccttctactcgcccgggtgtccggtgcctcgcttctccctgggaccctgtcgtcaacatcgaggtctccaacaccaccttgctttggtgccgggcccactgactgtcctcggtgtatagtgcgaccgaatctccatcatcccgtcctcagtgtacaggatgccccagcgcccccaaccgtctccctcagcattcagggtccccaaatcctaatgccttgtcctgagcctcacagccccacattcacctgttcttggtacttagcgtttccgcccatcctgtcctcctctatcagaacccccacaattgctctgtcctcggtgcccacagtctccaaaacaccggtgcaccggcccgcgtcatcccccgctctcagtcgtatcaaggactccagggcctcacccatagttctggagagggaagctgaacttgcaagccataacttcttttggggcatggcgatgaaggaggggctcgggccagcacttggataattttcaggtctacctgtccccctttatgtgtccccgggacaatcccagtgttctcagctgctcccttttggctcctcattcctgcctccagtctccgttagccccttcccatttggcaaggctcccgtgaccctgttctgcttcttgccctcctgggccccatgccctacaactgggcctcactcacatctgtctcaggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggtgagtgtgggtggtcgggcaggttgctgtcaatcaggcacggctctaacagcagtgaacaagagagaccagacaccaaacacaggtgctttcagcaaaacgagtggagtgaaaggtcagcagggcttccctagtttgagggtctggaaggctgcctccaaggaactggtatgagatccaaggcttgagtgatgagagtgagcctacagatctgggcagggaatgtgttaagcagacagagcagcaaatgttaaaaaagagcctcaaaaaaatgggagatgacaggtgagcttcaagagttgggcatggaccagacaattcagaactctgggccaaagtgggagctaagttggaaggttagggattacagggccgggcgcagtagctcagagacctgtaatcccagcactttgggaggcagaggtggttggatcacctgaggtcaggacttcgagaccagcctgaccaacacagagtaaccccgtctctactgaaaataaaaaaaactagccaggcatggtggcgcacgcctgtaatcccagctactcagcagggctgaggcaggacaatctcttgaacccaggaggcggaggttacagtgagccaagatcatgccactgcactccagcctgggtgacagagcgagactctgtctcaaaaaaaaaaaaaaaaaaaccagttaactataaggataagctggcccggcatgatggctcaagcctgtaatcccagcactttgggaggctgaggtgggtggatcacctgaggtcaggatttcgagaccagcctggccaacatggcaaaaccccactctaccaaaaattagccgggcatggtggtgcatacttgttatcccagctattcgagaggctgaggcagaagaatcgcttgaggccgggaggcacagtttgcagtgagccaagattgtgccactgcactccagcctaggcaacaaagcaagactccaactc

SEQ ID NO: 1304 - DNA, 2491 bp, Homo sapiens
aagttaatttgggagagagccaagaattcttcgggcacataggggtgagtccctctacccaccctcagtcctcaccccaagttgcccctggcacagaattccttcgacaatcctgagtggttttatcggcatgtggaagcacacagtctgtgctgtgaatacgaagcagtcggcaaggacaacccggtggtgctgtgtggctggaaaggtagggctgcttcttaacttgtggcttctggaggaaacgctggggttcctgaagagctgggacagaaagggataggggtcctacaggggcaaggttgactgccggctggagagactcaggggtaccagatcctaggcaaaactggggttttgtggcaggagactgatagggcttccttcccaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcgtaagtagtcagaggaagtggggtggatgcaggctgtcctgcttggaatgggttaggggcatgtttctagtgggggtggccactgaagagacctgccttttggctgcctcttctttttgggctcaggcacctcccatagtctctttgctgattcagattcgtaggcattgttattcagtacttactgtacctcgtatcagttacttagggaatcctcacaacagccccatgaggtaggcttcttatccccctttttgcagatgaggaaactgaggctcagagaggttaaatcacttacctgagatcacacagctagtaagtggtgaagctggaattctaactcaggttctctaagtcccatgctctttccatgatactgtgtccattcatagctccctaagctctccttttctccttgggtggttcccttctgcctgggatggttcccctctcctttctgtgcctctccactatcacctacagccctcctttcttctgcctgccccaccccagagcagcacttccagtgttctcactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatgaaggagactctgagccaaggtacaaatgtcatgtgtgtgacaaatgcttcacacggggcaacaacctcaccgtgcaccttcgcaagaagcaccagttcaagtggccctcagggcatccccgttttcggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctcaggacaaccccagttctgtcatccacgtggtgaatcagaccaatgcccaaggccagcaagagattgtctactatgtgctgtctgaagccccaggggagcctcccccagtccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaactataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggactctt

SEQ ID NO: 1305 - DNA, 2811 bp, Homo sapiens
aagtacgataattggctgccctgattcagataacatatccttattgtgacataggggtgactattgtcagaaaaccctgaaaatgttttaaaacaagaactaatggggcttggcgattcttgccacgcttttccagagctcggaccttgctattatttgctactagacacccacaaacccttgcttgttaaactgatctccttcaagactcaagaaaagcgccatgcgactccctcctagggctcgcctgacctttcctcaccaatgccgagagtggtcctgctggagaacgcacacgcctgcagttcgtgcaccttttcccggagctgcaccaggaaattatggatcaactggaagcagccaagaagaagggtcttggcgatcacatccagctattcagccatctcagactgcggacctccgtgcaccccctggcaggttccctccgcctagggtcgaaagcttcagaggcagccccaactcttccacttcttcctccatctctggctcccaggcttgggaggccccgcgccaccgcttcaactggctggggtgggaagattgaaacggctcttgagactctgcttttgcgcttactgctcgtttgcccgactattttctcatagtccctattccagtcaatttctggcacagcccagcttgaaactgctcttgagcctccgattttgagcttactcctggtttgcccgactattttctcataatccctgttccggtcagtttccggcacagcccagctaggattacaggcacatgccaccatgcccgtataattttttgtatttttagtagagacggggtttcgccatgttgcccaggctggtctcaaacacctgacctcaggtgatccgcccatctcggcctcccaaagtgctgggattacaggtgtaagccgccacgccctgcctataaccattctttttttagggaggtgtggtatatggtgctaccctggatctgtagtcaggatttgaagaagggagaaggtatttgcttgtgaagaaggcaccatgcattgtgctctgtagtggtgactggagagagagctgggaggggcacaggcagcaaggtccctgcttaaagacagttatctagtttggagaaacttagctggatagtcagttcttacatgcatttggcaagcacttatcatacactgtaaagaggcaatatgtctagcttgttagagggtgggctctggagtcagacttctggctttgaaccccaacttccctgccattttcaaatgacactggagaagtcgcaaaacctatttctgtctcagattcctccccagtaaaagtgggatattaatagtacctcctttggcttgatatgaaaattcaatgagttgatatatgcagaacatcttagaacagcaactagcttagagtaaatcttcagtaattgtaaactgtgaatatactatgtttttggcactgaagccacgtcgtggtaagacagtgcctgacctcaagaagctcagagtctagtactggagacaggtgaacaaatacttgcaaagtgtgtggtgtgagagaggtgtgacaggtgggcgggagcctgcagcaggcacatctgacccatcctaggtgtgtgttgtgcagaaaagttagcctaggctttctaggggcactgatgtctgggccgagtcttgtagggcagggaattagtcaaggggagctgtagtgatccagctggggctgagcaggagctgaaagtgaacagctcacatctgtagggttgccagatttagcaacggaaagtacaggatgccctattaaatgtgaatttcagataaaataataactttgaagaatatgtgtcatgcaatatttttagtataagtatgtcccaaatattgtataaccacacacattattcatcgtttatctgaaattcaaatttcactgggcatcctatgaaaagtctgtcaattttatctgtccgcatttaggaaggtgcagtatgtttcagagtagctggagtgatgcagggaggaaaggcagagtgggccggatggggctgagaggcacacaggaggcagtttgtaaaaaacctatgctatgttaagggatttagattttatcctgaaattagtgatgagcccttggagagctttaaccacagggatgtgaaaccacagagacagcagtgtcgggcacgaagaaatgagtgtcactttctatggctgaatagcaaattactccaaatttaaagtcttaaacagtaaacattatctcccagtttctgtggctcaggaattcagaggcaacttagctgggtggttctggctgaggtttctcatgaggttgtagataagatagtgaccagagtggcagttatctaaaggatgtactgaagctggagaatttgtttctaaggtgactcactctaatggttgggaaggtactgctggctgtcagcaggagagctcagttccttgctacaggaccccccataggacaacttgagcctcctcacaacatgacagctggcttagtaatccaagacagcaaagtgacattaactttggaagtcacatgccaccttgtcattcccatatatcccggtgctaacacagctcagccctgctcagtgcaggagggtcctacacaaggatgtacatacaagaaggtggggatcatggggttatcttggaggctggttttctgggatgggaggcttacatggtgatgcctgtgaccttggaggtggaggagaatgatgggcgtacagaggagtgaagaaaggctgggaggaatagagatgtgggagaggaggtgaggc

SEQ ID NO: 1306 - DNA, 2082 bp, Homo sapiens
aaaagttttcctggcagcgcctagacctgggcttagccactgcccctcttgcccatggaaccagctctggggcctggggtccagaaggacctgggttacctgcagcagtggctgaaggcctttgtaggtgccttcaagaagagcatctcactgtcctctctggagccacgaaggccagaggaggcaggtgcagaggtcccgctgctaccactggatgagctgcatgtgctggccgaacagctgcaccaggctgacctggagcaagcccccctgctgctcaagctcttcatcattctctgcaggaacctggagaacatagaggcaggccggggccaagtgctagtgccccgagtgctggcactgttgaccaagttggtggcggagctgaaaggatgcccaccaccccagggccgaggcacgcagttggagaatgtggccctacatgctctgcttctctgcgagggcctctttgacccttaccaaacctggcggcgccagcgcagtggggaagtcatcagctccaaggagaagagcaaatacaagttccctcctgctgctttgccccaggaattcagcgccttcttccaagagagcctacagaatgcagaccacttgcctcccatactgctgttacgtctcatccacctcttctgcgccgtcctcgctggaggaaaggagaacgggcagatggctgtaagtgatggctctgtgaagggcctgctgagtgtggtgcggggctggagccgtgggccagccccggacccgtgcctagtgccactggctctagaggcactggtaggtgcagtccatgtcttgcatgccagccgcgcacctcctcgtggcccagagcttcgtgccctgcttgagagctacttccatgtccttaatgctgactggccagctggtctgagctcaggccccgaagaggcccttgtcaccctccgggtcagcatgctcgacgccatccccatgatgctggcatgtgaagaccggccagtgctgcaagccaccttcctcagcaacaattgctttgaacacctcactcggctcattcagaacagcaaggtcctggaccaagacacagacgccattgcagtccatgtagtcagagtgctgacctgcatcatgagtgactccccctcggccaaggaggtgtttaaggagcgcatcggctaccctcacctgcaggaggttctgcagagccatggtccccccacccatcggctgttgcaagagctgctcaacatggctgtggagggtgaccacagcatgtgcccacctccaccaatccgcaacgagcagccggtactggtgctggcgcagtggctgccgtcattgcccaccgctgagctgcggctcttcctagcgcaacgcctcaggtggctctgtgacagctgccctgccagccgtgccacctgtgtgcaggcaggcctggtgggctgcctgttggagacactcagcacagggctagccctggaggccggctgccaagagcagctgctggcactgctacaagcactgggccgtgtatcaataaggcccatggagctgcgtcacctgctgcgcccccggccaggattggactcggaaccaggcggagctgaggctggaaaggcccgacacgcaggtgctgtcatccgcacattatcaggcatggccaggcaccagggtcctgcacgtgctctgcgctactttgacctcacgcccagcatggcgggcatcatggtaccccctgtacagcgatggccagggcctggcttcacctttcatgcctggctctgtctgcaccctatggatacagcacctacccctgcccccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgt

SEQ ID NO: 1307 - DNA, 2405 bp, Homo sapiens
cattcatttatttcttcaacaaacaggccaggctcagcactgtggaagcagcaggaaccaaaaaagatctcatccctaaccccccagaacttatattccagatgggaaaaccagtagcaaagatgcagccaaataaacaaggaaataattccagaaagtgacagttatcatgaaaaaaaatacattgttgtgttggaatatgtctgcgtagaaaaggtggctggggagggcctctcggaggggctgacttttgagcagtctcagatgaccaaatggagcagccttgggaggttttccaggccacatgggaccagcaagtataaaggccctggggggaccgagcctgctgatttttgaaggtcaggcaccaggccactggaggcaagtgggggccatgggaggcttcttggggcggggaggtgacatggctggactcagggactcaggtttccctagggtccctctggctgccgtgaagcgagcaggggatgatgggtccaggcaggaggtgatggtggctggccccgcgtggggtcgggggcagtgggcgaattgcaggtaggttttggaggcagagctgcccggccttgctgatggcttaggtagaaaggtcgtgggaggccaggtgcagtggctcatacttgtaatcctggcactttgggagcctgaggcgggtggaccactgcaggtcccccatctctactaaaaatgtagaaattagctgggtgtgttgtaggggggtgtccctataatcccagctactcaagaggctgaggcaggagaatcaatcacttgaacccaggaggctgagcttgcagtgagccgagatcatgccactgcactctagcctgagcgacagcgcgaggctccatctcaaaaaacaaaaacaagaaaaggtcatgggagaaggcttgaggctctggctcctggctttggcgtgggtgctgggcagcccatgcggtgctgggagagtgagcagtgggcggggctgtgggctctctacttgggatccttcgtgaaagtttgcacaggtgtgggcccgaagcggacaggttggggtgtattttggactcagatgcctggtttggggcttaagcagtcatgtttggtcgcatttactcccaggcagtacggggtggagattggggtgaagcgagggagcaggagagggaatgactgagtgggtgcagctgtggctgtagtggggtaatctcacccctccttgcctgccctctgcaggcttcaccatcatcatcgagccctttgacgacagaaccccgaccattgccaaccccatcctgcacttcaggtgggaccctgcccggtgagggtgtgaatgctctgtgggtcgggggcccagccccccgggccctcactgccctcatctctctccagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgctgtgatccggaactatgggaacctcctgctggagatgtccgctgtggtccctgatggcatcgtggccttctacaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgggaggatcagctgggcctgtccctgctcagcctggagcagctagaatcagaggagacgctgaagaggatagagcagattgctcagcagctctgagtggggcgggtggggccataaacggttcctggtg

SEQ ID NO: 1308 - DNA, 2352 bp, Homo sapiens
acagatggttgccttcttggagcaaagagccagtgctctgctagctagctgttcaaaaaactgcacaaactcacctgcaattgtgaggttttctggccaatccagaggtgtgcctgcagtgtctgagtcctattctgccccaggagcttgtgaagaacccacagaaaggggaaatcttgaggttggtgaaccacagagcgaaccagtccgtgtccttgacatggtagccaagttggagtctgagtgcctgaagcggcagggccagcgtgagcctgggagcctctcaaggaataacagcttccgtcgaaatgtgggcagagtattgcttgcaaatagcactcaggctgatgaaggcaaaacaaagaaaggcgtcttggaggcacctgacactcaggtgaatcctgtggggtctgtatctgtggattgtggcccttcaagagctgatcgttgttctcctaaggaggaccaggcctgggacggtgcttctcaggactgccccccattgccagcaggagtgagtttccacatagacagtgcagagttagagccgggttcgcaaactgccgtgaaaaacagcaacagatatgatgtggaaatgacagatgaactcgttgggttacctttttcctctcatacctattcccaagcctctgaattgcccacagatgctgttgattgtatgagcagagagcttgtgtcccttactagccgaaatcctgatcaaagaaaagaatctttgtgcattagtatcactgtgtccaaggtagacaaagaccagccttccattttaaactcctgtgaagacccagttccagggatgttgttttttttgccacctggtcagcacttgtcagactattcccagttgaatgaaagcacaacaaaagagtcttcagaggccagccagcttgaagatgctgctgggggtgacagtgcatctgaggaaaaaagtgggtctgctgagccatttgtactgccagcctcttctgtggaaagtacattaccagtgcttgaggcatccagttggaagaagcaggtgtcgcatgacttcctggagaccaggtttaaaatccagcagcttttggagcctcagcagtacatggcttttctgccccaccacattatggtaaaaatcttcaggttacttcccaccaagagtttagtggcccttaaatgtacctgctgctatttcaagtttatcattgagtactacaatatcaggccagcagattctcgctgggttcgagatccacgctatagagaggatccttgcaaacagtgcaagaaaaagtatgtgaaaggggatgtgtccctgtgccgatggcaccccaagccctattgccaggcattgccctatgggccagggtattggatgtgctgccaccggtctcagaaaggattccctggctgtaagctggggcttcatgacaatcactgggttcctgcctgccacagctttaatcgggcaatccataagaaagcaaaagggactgaagctgaagaggaatactaaagtccatgtgagaggcaacaaaaggaccggtttctaaagctgcaaaacacctagatacaccgttcaaatgagcgtagccccctgagtcatcactctagaagaatccgtacatcatcaggactgcattgctcaggcattttctaaactctaaatttacgagctgtacaaaaaaaattggtcttgttgtttatagtggcatctcatgtttgaacccgggtggtatcccacagttggattcagttggctgtgaataactgcctgttttcctaaatcaaacccatcctcaaaggatgaagactcaccaccatccaggacattcagaagagttcactgcagatgctgcaggtagtcctcaaaaatgggttccagaaatgttttgagcactggcaacatatttgaaataagtgaatattgtcctgtgaaaagaatagcaggacttttagatgaaaagtattcttaaaaagaaaagtcaggcaccccaccttagacctcgtatgcttgatcctgtgagattgatgtttgtggctggaggtggatttcatgccctgtggtgtttacagtgtatataatggttgtgttttcatggggctatgaaagtgcacgttaaacctgagcgcctttacctttagatgagtgctttggcccctctgtgaatagcacgattaaaatccagttgtatataatggacagctaacggaacaatataatcaccacaatgcagctaggatagtgttgcggctataattttgtgtttttttttttttaattgtctagtcttaaatttgtacatcttgtataaaatatgaatgtttcccaaataaactatgaatgtttcctgt

SEQ ID NO: 1309 - DNA, 2483 bp, Homo sapiens
aatatattctgggggctgggcacggtggctcacacctgtaatcccagcactttgagaggccaaggtgggcggatcacttgaggtcaggtgttcaagaccagcctggccaacatggtgaaaccccgtctgtactaaaaatacaaaaattagccaggcgtggtggcgggtgcctgtaatcccaggtactcaggaggctgaggcagagagaattgcttgaacctgggaggcggaggttgcagtgaggtgagagcacaccactgtactccagcttgggtgacagagcgagactctgcctcaaaaaaaataaaaaaaatattctggggaaccattggttcctcaggaccttagaggtgttaaagatgtataagtttgttgggattggaaggacctaccttctgtggtcaaataagttttgggagaaacaaattgatttcttgattgcaggacttctcagagcctttaatttgctaatgtgcattgtgactccccaagggagagttacaatatgcaatattccttggattcctttgaccaaagaaatcttttcaagagcaccccaacccagctactcaggaggctgacgtgggaggattgcttaaggccagcctaggcaacagcaagaccttgtccctaaaaaggaaaaaaaaaaaattacaaaaaaagagcagctcaagaaactataggaaacactttggttaacacaaatctgttctctgtgctgccttcaaactaatctataagaaataatgaagtccatgttagggaacacagataacttttctcaaatgagaaatctcaaatccctgtactttggagttaaaaaaaattattctagcttttccaacagtagagacattaggaaggccaactttggtgggcagattggggattttcctttgcttctgatgactctcttgtgccctttctcctctcaggtgccagatcggctagggatactcactcacctgtatagggactttgataaatgcaggtttgctgggttttgccggaaaattgcagaaggtactggaggtggggggtgggttttatctggctttgttctccaaagatccccagttgggagattgagtggggttcagacaggactgacaacaattttcctctcaccaagtgacctcagttctctgccaccactggccttggtggtggtgggccttggggtggaggcagaagggcacgtgggtcgtgttgacagttttgtattacctgtgtttttttctttaatagctatcatggcttgcttaggctgtatgcctgtttctgaggaatttatggagcagttgtcctttggacaaatctataactttcttttcctagccaattatactcaaagaactaggggattatagagaggttaggcatattttgttgggtgtcaggagatgctgaacagagggcttgtatatctgtacattgctctttctccactgtgaggtccatcctgccttaatttgggttcctgcagcctcagggcattctagggctctcttagatcctgctggactgagtcccctctagaaaagaagcaggaacaggctaaccaacagcagactgttagaagttggtggagggcactgacaggagtaccagccagctgttcagctaggatcctgggtccccagagctgacagcctcataggaacagacttacagtaactcagtgtgagctggatgcatactaggtgccagtgcattcctttagtgggtgctgccctcccttcctgagttgggggcctgagtgagcacctctgtacagggcacccctctacagagggaggtagctggtatgtttgtcagtggagacttgcttctccacctgccacgaggcgggcatccatccggcagtagactcctagctcagggtgctcctgtgatggctgccttgcaacagagagaggatagcccaggaatggcagctccctcctttctcaccagtttccttcttccgccctccctaccccaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtatggaagagctgggagctgctgaaggaaggttttcttttggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactcccc

SEQ ID NO: 1310 - DNA, 5347 bp, Homo sapiens
acccccaagatccccctaaacctgcacctccatcacgacccattcaggagcctccaggagcccagacaccagccccccaccatgggcagcaaggagcgcttccactggcagagccacaacgtgaagcagagcggcgtggatgacatggtgcttcttccccagatcaccgaagacgccattgccgccaacctccggaagcgcttcatggacgactacatcttcacctacatcggctctgtgctcatctctgtaaaccccttcaagcagatgccctacttcaccgaccgtgagatcgacctctatcagggcgcggcccagtatgagaatcccccgcacatctacgccctcacggacaacatgtaccggaacatgcttatcgactgtgagaaccagtgtgtcatcattagtggagagagtggagctgggaagacagtggcagccaaatatatcatgggctacatctccaaggtgtctggcggaggcgagaaggtccagcacgtcaaagatatcatcctgcagtccaacccgctgctcgaggccttcggcaacgccaagactgtgcgcaacaacaattccagccgctttggcaagtactttgagatccagttcagccgaggtggggagccagatgggggcaagatctccaacttcttgctggagaagtcccgcgtggtcatgcaaaatgaaaatgagaggaacttccacatctactaccagctgctggaaggggcctcccaggagcaaaggcagaacctgggcctcatgacaccggactactattactacctcaaccaatcggacacctaccaggtggacggcacggacgacagaagcgactttggtgagactctgagtgttatgcaggttattgggatcccgcccagcatccagcagctggtcctgcagctcgtggcggggatcttgcacctggggaacatcagtttctgtgaagacgggaattacgcccgagtggagagtgtggacctcctggcctttcccgcctacctgctgggcattgacagcgggcgactgcaggagaagctgaccagccgcaagatggacagccgctggggcgggcgcagcgagtccatcaatgtgaccctcaacgtggagcaggcagcctacacccgtgatgccctggccaaggggctctatgcccgcctcttcgacttcctcgtggaggccatcaaccgtgctatgcagaaaccccaggaagagtacagcatcggtgtgctggacatttacggcttcgagatcttccagaaaaatggcttcgagcagttttgcatcaacttcgtcaatgagaagctgcagcaaatctttatcgaacttaccctgaaggccgagcaggaggagtatgtgcaggaaggcatccgctggactccaatccagtacttcaacaacaaggtcgtctgtgacctcatcgaaaacaagctgagccccccaggcatcatgagcgtcttggacgacgtgtgcgccaccatgcacgccacgggcgggggagcagaccagacactgctgcagaagctgcaggcggctgtggggacccacgagcatttcaacagctggagcgccggcttcgtcatccaccactacgctggcaaggtctcctacgacgtcagcggcttctgcgagaggaaccgagacgttctcttctccgacctcatagagctgatgcagaccagtgagcaggccttcctccggatgctcttccccgagaagctggatggagacaagaaggggcgccccagcaccgccggctccaagatcaagaaacaagccaacgacctggtggccacactgatgaggtgcacaccccactacatccgctgcatcaaacccaacgagaccaagaggccccgagactgggaggagaacagagtcaagcaccaggtggaatacctgggcctgaaggagaacatcagggtgcgcagagccggcttcgcctaccgccgccagttcgccaaattcctgcagaggtatgccattctgacccccgagacgtggccgcggtggcgtggggacgaacgccagggcgtccagcacctgcttcgggcggtcaacatggagcccgaccagtaccagatggggagcaccaaggtctttgtcaagaacccagagtcgcttttcctcctggaggaggtgcgagagcgaaagttcgatggctttgcccgaaccatccagaaggcctggcggcgccacgtggctgtccggaagtacgaggagatgcgggaggaagcttccaacatcctgctgaacaagaaggagcggaggcgcaacagcatcaatcggaacttcgtcggggactacctggggctggaggagcggcccgagctgcgtcagttcctgggcaagagggagcgggtggacttcgccgattcggtcaccaagtacgaccgccgcttcaagcccatcaagcgggacttgatcctgacgcccaagtgtgtgtatgtgattgggcgagagaaagtgaagaagggacctgagaagggccaggtgtgtgaagtcttgaagaagaaagtggacatccaggctctgcggggagtctccctcagcacgcgacaggacgacttcttcatcctccaagaggatgccgccgacagcttcctggagagcgtcttcaagaccgagtttgtcagccttctgtgcaagcgcttcgaggaggcgacgcggaggcccctgcccctcaccttcagcgacacactacagtttcgggtgaagaaggagggctggggcggtggcggcacccgcagcgtcaccttctcccgcggcttcggcgacttggcagtgctcaaggttggcggtcggaccctcacggtcagcgtgggcgatgggctgcccaagagctccaagcctacgcggaagggaatggccaagggaaaacctcggaggtcgtcccaagcccctacccgggcggcccctgcgccccccagaggcatggatcgcaatggggtgcccccctctgccagagggggccccctgcccctggagatcatgtctggagggggcacccacaggcctccccggggccctccgtccacatccctgggagccagcagacgaccccgggcacgtccgccctcagagcacaacacagaattcctcaacgtgcctgaccagggcatggccggcatgcagaggaagcgcagcgtggggcaacggccagtgcctggtgtgggccgacccaagccccagcctcggacacatggtcccaggtgccgggccctataccagtacgtgggccaagatgtggacgagctgagcttcaacgtgaacgaggtcattgagatcctcatggaagatccctcgggctggtggaagggccggcttcacggccaggagggccttggcagcccctcagcaagaagccctgcctgatgagacagaggtggtggaagaaactgtggcagaggtgactgaggtatctgtgggagctaatcctgtccaggtggaagtaggagaatttgatggtggtgcagaggaaaccgaagaggaggtggtggcggaaaatccctgccagaaccaccactgcgaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaataaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactg

SEQ ID NO: 1311 - DNA, 3587 bp, Homo sapiens
aaaagcctgctgaaggagaaagaggcattagaggccagcatcaaggtgctgtcggtatcccacgaggcagatgtgggcctcgcaggtgtccagcttccaggcctcacctttcctgactctgtggatgaccggtgctccactcacagcgaggatagcactgggaccgccactagcttggatactgcggccagtctcaccagcaccaagggtgagtttggggtagaagatgacagaccggcccgtggaccaccacctccaaagtccgaagaggccagttggtccgagagtggcgttagcagtagcagtggggatgggccatttgcaggtggggaggtggacaaaagactgcaccagctgaagactcagttggctactttgaccagttctttggctacagtcactcaggagaagtcccgcatggaggcttcttacttggctgacaagaaaaagatgaaacaggacttagaggatgccagtaacaaggcggaggaggagagggcccgcctggagggagaattgaaggggctgcaggagcaaatagcagaaaccaaagcccggcttatcacgcagcagcatgatcgggcccaagagcagagtgaccatgcctcgatgctgcgtgagctccagaagctgctgcaggaggagaggacccagcgccaggacttggagcttaggttagaagagacccgagaagccttggcaggacgagcatatgcagctgaacagatggaaggatttgaactgcagaccaagcagctgacccgtgaggtggaggagctgaaaagtgaactgcaggccattcgagatgagaagaatcagccagacccccggctgcaagaacttcaggaagaggctgcccgccttaagagccatttccaggctcagttacagcaggaaatgagaaagacagctcttgcagaggatcaactccgtcagcaatctcaggtagaagaacagagggtggcagccctggagaatcaaatatccgaggtgtctgagctgctaggcacctacgagaaagccaagcagaaggaccagctggccattcagaagctgaaggagcgcattctgcagctggacctggagaacaagacactggctctagcagcctccagcaggtcccctttagacagccatggagaggagtccagtctggatgtcaatgtcctgaaagataagatggagaagctgaagaggctgctgcaggttgcggccaggaaaagccaggtgaccctggatgtggagaagctctgtgacctggagataatgcccagctcggaggctgctgatggggagaaggctactgcactctattaccaacaggagctgaaacagctgaaggaagagtttgagaggtacaagatgagagcccaggttgtcctcaaaagcaagaataccaaagatggtaacctgggaaaggagctggaggcagcccaggaacagcttgcagagctgaaggagaagtatatttccctgcggctctcctgcgaggagctggagcaccaacaccagcaggaggctgatgactggaagcaggagctggcccggctgcagcagctccaccggcaggagctggaacggtgccagctggacttcagggaccgcacactgaaactggaggaggagctgcacaagcagcgggatcgtgccctagctgtgctcaccgagaaggacttggaactggagcaactgcgttctgtggccttggcctctgggctgccaggacgcagaagtcctgtgggtggtggcggtcctggggacccagctgacacatcatcctctgatagcctgacccaagcattacaacttgcagcggccaatgagcccactttctttctgtacgctgagcaactggcccgcaaggaggtggagatcacatcactgaggaagcagaagcacaggctggaggtcgaggtgcatcagctgcaggatcggctgctggaggagggcgaacggcatcgtgaggaggttgcagccctgcagagccacatcgaaaagaacatcagggaccagagcagggagggagccaatctggagtacctcaaaaacatcatctaccgcttcctgaccttacctgactccctgggccgccagcagactctcacagccatattgactatcttgcacttcagtccagaggagaaacaagtgataatgcgactcccaaccagtgccagctggtggccttctggcaagagatgatgccattttcatgaattcctggaatttctgtgcctcttttatgtgggaaagggcaggctctggtttctgctgcctcttctcttacattgtcatttatttcttcactgtgttgagctgggaggagtcttcaatgtgggaagggattttctgccaaatgccattaatgctgctttatccttaggccctagagatactgaaagtcctggggcagtatcttctgatggtgtgcatgtgaggagaagatgaggttaggactgagaagtgcagaagttggaacagtggtaaggctgttttaaaataagatgttttgttttaataatatgctcctggcacaaagctaggagtaaatgtgactccaaagggagttcagttaatctctgaaatgcacaaaacctagctattttctccctctcatcacagtctgagtctggtccattgctaccccaattctctggggacataaaaccaggctggaaagggaccaggaagtttgaaatagtgacatatcatccactagtcccaagggctaaggaatagtgagtttattctggaaggaactgggaagcttagtctaattagtgcctggggatgacctatgcaatcacaccgcttatgaccatcctagagagggccctgagcaccagcttgatcttagggatttccaaagtaacctgctttttgcctggatagggttaaaatagacctttcttgcctatccttgccttaacctatctgcctgaggttggcctgagattgtgagtcaacgactttgctatcttttcctcagtgttgaactttcattaagaaataaagtcctagcttcttacagagaggggtccaaatggtgaatgctcatcctgcctggatccaaggaattagctcagagattggcccctagcttttctgcctttgtagggacagcaaaaggggaaaatttgctgcagaaaattccaaaagattgctgtagctctcacagggaagtggtaaagatcagctaaacctgggttggggtgctttctgcccagtgggtcttggcataagtagattaatcctgctcttttaagaaaaggcaacttattcaggcagtctggaaagggggttctcagaaaactcagtttctttattccttcttttctcccaactactgttgctggttatagaggtctttggactctaaagaccaatgtttggccactaactggactaatatgtatctttctgtgatttcatcatagaggtccgttttgtgagggtttggggtgcagaaaactttgattaaatcttaatgggaggctgggtgacctggattatctacagtgagcagacttaaatggaacagaagtttatgtgtccaaatgatggaatcattaaacctgagtgacttg

SEQ ID NO: 1312 - DNA, 3405 bp, Homo sapiens
gttttagccaaacaaatgggtttcggggcgagcgttgggcgccgccgcgccgcgctgggtgctcggtccgactcagcggtggggagcgagccaggcctcccgccaccgctgctgccgccaccactgcgtcgggctggtgcagccccgggccaggccgcggccggggctggagcgcaggggctttgttatgcacctaaagccatattggaagctccagaagaaagagcaccccccggaagtcagcagggaaacgcagagaactcctatgaaccaccaaaaggctgtaaatgatgaaacatgcaaagctagccacataacatcaagtgtctttccttcagcctctctcggtaaagcatcatctcgaaagccatttgggatcctttctccaaatgttctgtgcagtatgagtgggaagagtcctgtagagagcagcttgaatgttaaaaccaaaaagaatgcaccatctgcaacgatccaccagggcgaagaagaaggaccacttgatatctgggctgttgtgaaacctggaaataccaaggaaaaaattgcattctttgcatcccaccagtgtagtaacaggataggatctatgaaaataaaagttcctgggatattgatgggagagctactaagagaaggaaaaaatcaggggatcttaaaaaagccaaggtacaggtggaaaggatgagggaggttaacagcaggtgctaccaacctgagccttttgcatgtggcattgagcactgttctgtgcactatgtgagtgacagtggggatggagtctacgctgggaggcctctgtcagttatacagatggttgccttcttggagcaaagagccagtgctctgctagctagctgttcaaaaaactgcacaaactcacctgcaattgtgaggttttctggccaatccagaggtgtgcctgcagtgtctgagtcctattctgccccaggagcttgtgaagaacccacagaaaggggaaatcttgaggttggcgaaccacagagcgaaccagtccgtgtccttgacatggtagccaagttggagtctgagtgcctgaagcggcagggtcagcgtgagcctgggagcctctcaaggaataacagcttccgtcgaaatgtgggcagagtattgcttgcaaatagcactcaggctgatgaaggcaaaacaaagaaaggcgtcttggaggcacctgacactcaggtgaatcctgtggggtctgtatctgtggattgtggcccttcaagagctgatcgttgttctcctaaggaggaccaggcctgggacggtgcttctcaggactgccccccattgccagcaggagtgagtttccacatagacagtgcagagttagagccgggttcgcaaactgccgtgaaaaacagcaacagatatgatgtggaaatgacagatgaactcgttgggttacctttttcctctcatacctattcccaagcctctgaattgcccacagatgctgttgattgtatgagcagagagcttgtgtcccttactagccgaaatcctgatcaaagaaaagaatctttgtgcattagtatcactgtgtccaaggtagacaaagaccagccttccaatttaaactcctgtgaagacccagttccagggatgttgttttttttgccacctagtcagcacttgtcagactattcccagttgaatgaaagcacaacaaaagagtcttcagaggccagccagcttgaagatgctgctgggggtgacagtgcatctgaggaaaaaagtgggtctgctgagccatttgtaccgccagcctcttctgtggaaagtacattaccagtgcttgaggcatccagttggaagaagcaggtgtcgcatgacttcctggagaccaggtttaaaatccagcagcttttggagcctcagcagtacatggcttttcttcccccaccacattatggtaaaaatcttcaggttacttcccaccaagagtttagtggcccttaaatgtacctgctgctatttcaagtttatcattgagtactacaatatcaggccagcagattctcgctgggttcgagatccacgctatagagaggatccttgcaaacagtgcaagaaaaagtatgtgaaaggggatgtgtccctgtgccgatggcaccccaagccctattgccaggcattgccctatgggccagggtattggatgtgctgccaccggtctcagaaaggattccctggctgtaagctggggcttcatgacaatcactgggttcctgcctgccacagctttaatcgggcaatccataagaaagcaaaagggactgaagctgaagaggaatactaaagtccatgtgagaggcaacaaaaggaccggtttctaaagctgcaaaacacctagatacaccgttcaaatgagcgtagccccctgagtcatcactctagaagaatctgtacatcatcaggactgcattgctcaggcattttctaaactctaaatttacgagctgtacaaaaaaattggtcttgttgtttatagtggcatctcatgtttgaacccgggtggtatcccacagttggattcagttggctgtgaataactgcctgttttcctaaatcaaacccatcctcaaaggatgaagactcaccaccatccaggacattcagaagagttcactgcagatgctgcaggtagtcctcaaaaatgggttccagaaatgttttgagcactggcaacatatttgaaataagtgaatattgtcctgtgaaaagaatagcaggacttttagatgaaaagtattcttaaaaagaaaagtcaggcaccccaccttagacctcgtatgcttgatcctgtgagattgatgtttgtggctggaggtggatttcatgccctgtggtgtttacagtgtatataatggttgtgttttcatggggctatgaaagtgcacgttaaacctgagcgcctttacctttagatgagtgctttggcccctctgtgaatagcacgattaaaatccagttgtatataatggacagctaacggaacaatataatcaccacaatgcagctaggatagtgttgcggctataattttgtgtttttttttttaattgtctagtcttaaatttgtacatcttgtataaaatatgaatgtttcccaaataaactatgaatgtttcctgtataatatatgaatgtttctgagaagaaactctaaatagttgaaaggctaacctgctcaaaggataccaaataatggtttaactggacaacctgaaaattagcatagaaaacaatcctttgttatattttagtgatccacaagattgagaaaatattatatagttagataataacattcttgtctactttatcctgtctggttacaaaattttttaaaacttaaataaaaacatgcatcttaaatgg

SEQ ID NO: 1313 - DNA, 3151 bp, Homo sapiens
ataatgctgcccaggctggtctcaaactcctgagctcaagcaatcctcccgactcggcttcccaaagcacttggattacagattctggctgtgactcagtcactgacactgagcctgaggacgagaaggttgtttcctactcgaagcagcagaacctgccgacggtgacttcacctgggaacctgatggtggtgcagccggaccgcattcgctgtggggcagaaaccactgtctatgttattgtgagatgtaagctggatgacagggtggcgacagaagcagagttttctcctgaggattctccctctgtaaggatggaagccaaggtggagaatgagtacaccatttcagtgaaggctcccaacctttcatctgggaacgtttctctgaagatatattctggagacttagtggtgtgtgaaaccgttatcagctattatactgacatggaagaaattgggaatttattgtccaatgccgcgaatcctgtggaattcatgtgtcaggcctttaaaattgtgccctacaacacagagacccttgataaactgctaaccgaatccctgaagaacaatatccctgcaagcggactgcacctctttggaatcaaccagctggaagaagaagatatgatgacaaatcagagggatgaagagctgcccaccctgttgcattttgctgcgaagtatggactgaagaacctcactgccttgttgctcacctgcccaggagccctgcaggcgtacagcgtggccaacaagcatggccactaccccaacaccatcgctgagaaacacggcttcagggacctgcggcagttcatcgacgagtatgtggaaacggtggacatgctcaagagtcacattaaagaggaactgatgcacggggaggaggctgatgctgtgtacgagtccatggcccacctttccacagacctgcttatgaaatgctcgctcaaccccggctgtgacgaggatctctatgagtccatggctgcctttgtcccagctgccactgaagacctctatgttgaaatgcttcaggccagtacatctaacccaatccctggagatggtttctctcgggccactaaggactctatgatccgcaagtttttagaaggcaacagcatgggaatgaccaatctggagagagatcagtgccatcttggtcaggaagaagatgtttatcacacggtggatgacgatgaggccttttctgtggacttggccagcaggccccctgtcccagtgcccagaccagagaccactgctcctggtgctcaccagctgcctgacaacgaaccatacatttttaaagtttttgcagaaaaaagtcaagagcggcctgggaatttctacgtttcctcagagagcatcaggaaagggccgcccgtcagaccatggagggacaggccccagtcgagtatatatgacccttttgcgggaatgaaaacgccaggccagcggcagcttatcaccctccaggagcaggtgaagctgggcattgtcaacgtggatgaggctgtgctccacttcaaagagtggcagctcaaccagaagaaacgatcggagtcctttcgtttccagcaggaaaatcttaaacggctaagagacagcatcacccgaagacagagagagaagcaaaaatcaggaaagcagacagacttggagatcacggtcccaattcggcactcacagcacctgcctgcaaaagtggagtttggagtctatgagagtggccccaggaaaagtgtcattccccctaggacggagctgagacgaggagactggaaaacagacagcacctccagcacagcaagtagcccaagtaaccgctccagcacccggagcctcctcagtgtgagcagcgggatggaaggggacaacgaggataatgaagtccctgaggttaccagaagtcgcagtccaggccccccacaagtggatgggacacccaccatgtccctcgagagaccccccagggtgcctccgagagctgcctcacagaggcctccgaccagggagaccttccatcctcctccacctgttccacccagaggacgctgattccacctcctaaaacctgcctacttcaggactttaagactcacagtcttcagcctgttaatgatgtcttcatgttgagttttatagcatgactgttgaccttaagatccattctcattgctgataatgctgcagccctgctggtttgggcttgcctcgaagattttattaaggcacgaagaagtgaaaaactaagggcttcattcaccatcaccaagtatatcgaaccatatacttgtttgccaaaaggatgaagacttaatcgaaatacttacctctaatttgccatatcagaagcctaaaaagaatgatcataaatgtacttcaccagtgattttactgaaatgcacttatattagtctttatgtatttgctagttcagcctgatttctagaagaggttatagtgtgagacttgtagtattcaagtaagataagtgacctaattttaaaataattcttctacttttctgtatattcagcagggtatttaagtgctagggctggtcacacacaaccaaccgaaaaagactagagggattagtacaaactcctcttatacagaaggcaaatctgaggttccacagaagtctggaaccaagactattcagttggttaaacaaagaggttagtctagactgggcctgctcattctaggtcaccacattttccatctccaaatagccaggccctctctccctcaagaaatgcccagatgtagaaattcatcagtgcctattggtcttccagaattttccatcttccgtatctcccaggcatgagactaccaagtttgtttgttttctttccaatttgggaatttatacttcagtatggtttcaacgcagttatgtttccagagaacatctagaagtggctggaaaccagaagctggggattccagggaccccacttagtgctctatttcctttataggttttatttctggtcatagagagagaaggacctttgactttttcttcgttgaggcttctgaggaggaaaaacaaacctaaaatagaaatacagtcagcctttcaaatccatgggttctgtgtccgtggattcaaccaaccttggatc

SEQ ID NO: 1314 - DNA, 2248 bp, Homo sapiens
agactattgtttcttgggaattgtctgtatcagacatcatgggagcagatccagggcgacatcaaagggaagcatgagtctccaggaccagaggggcttggatgcagatgatcatcatctgggcactgctggatactgaagttctcattatgttgcctagactggtctcaaacctccggcttcaagagatcctctcacctcgaccttcaaattactgggattgcaggcatgagccaccatgtcctaccagactttgttaaaagaggaacaggccaggcatcgtgggctcacatgaacactcatgccccagaagtaaacaagtgttagccaaccaggaggcctatcctccccctaacctcacccaaagccatctctgtgccctcccccttgcaggggaaacagcacacactagtgaaatcttgtcttagtgtgtccggaattggtgggttcttggtctcactgagttctagaatgaagctgcagaccctcgcagtgagtgttacagctcttaaggtagcgcgtctggagtttgtttcttttgatgtttggatgtttggagtttcttccttctggtgggtttgtggtcttgttggctcaggagtgaagctgcagaccttcgtggctctctgactgccacccctgcctgcctgcccggccctgcacaacatgcagccctccggcctcgagggtcccggcacgtttggtcggtggcctctgctgagtctgctgctcctgctgctgctgctccagcctgtaacctgtgcctacaccacgccaggcccccccagagccctcaccacgctgggcgcccccagagcccacaccatgccgggcacctacgctccctcgaccacactcagtagtcccagcacccagggcctgcaagagcaggcacgggccctgatgcgggacttcccgctcgtggacggccacaacgacctgcccctggtcctaaggcaggtttaccagaaagggctacaggatgttaacctgcgcaatttcagctatggccagaccagcctggacaggcttagagatggcctcgtgggcgcccagttctggtcagcctatgtgccatgccagacccaggaccgggatgccctgcgcctcaccctggagcagattgacctcatacgccgcatgtgtgcctcctattctgagctggagcttgtgacctcggctaaagctctgaacgacactcagaaattggcctgcctcatcggtgtagagggtggccactcgctggacaatagcctctccatcttacgtaccttctacatgctgggagtgcgctacctgacgctcacccacacctgcaacacaccctgggcagagagctccgctaagggcgtccactccttctacaacaacatcagcgggctgactgactttggtgagatgctgtggcacggcgggccctggaagtgtcacaggcacctgtgatcttctcccactcggctgcccggggtgtgtgcaacagtgctcggaatgttcctgatgacatcctgcagcttctgaagaagaacggtggcgtcgtgatggtgtctttgtccatgggagtaatacagtgcaacccatcagccaatgtgtccactgtggcagatcacttcgaccacatcaaggctgtcattggatccaagttcatcgggattggtggagattatgatggggccggcaaaccctggactgtggttctgagtcatgatcagggaatcaggtctgaaacccactagctggtggccacacagattccctcaggggctggaagacgtgtccacatacccggtcctgatagaggagttgctgagtcgtggctggagtgaggaagagcttcagggtgtccttcgtggaaacctgctgcgggtcttcagacaagtggaaaaggtacaggaagaaaacaaatggcaaagccccttggaggacaagttcccggatgagcagctgagcagttcctgccactccgacctctcacgtctgcgtcagagacagagtctgacttcaggccaggaactcactgagattcccatacactggacagccaagttaccagccaagtggtcagtctcagagtcctccccccacatggccccagtccttgcagttgtggccaccttcccagtccttattctgtggctctgatgacccagttagtcctgccagatgtcactgtagcaagccacagacaccccacaaagttcccctgttgtgcaggcacaaatatttcctgaaataaatgttttggacatag

SEQ ID NO: 1315 - DNA, 3008 bp, Homo sapiens
agacaccgaccgcggcggcagcagcagcagcagcagcgagaggcagaggcggcggcggcggggaggacagcacggccgaggctgcccagaggcgcctcctccacaccccccgccgcagcagcaccggcgacagattttttaaaaaatggatttggccaaccatggacttattctactgcaacagttaaacgctcagcgagagtttggtttcctgtgtgactgcacggttgcaatcggcgatgtatacttcaaggcacacaaatcagttcttgcttcattctccaattactttaagatgttgtttgtccatcagaccagtgagtgtgtccgcttgaaaccaactgacatacagcccgacatcttcagctatctcttacacttgatgtacactgggaagatggcgcctcagctcatcgacccggttcgattagaacagggcatcaagtttctgcacgcctacccgctcattcaggaagccagcctcgccagccagggagccttttctcaccctgaccaagttttcccactggcttcttcattgtatggcattcagattgcagatcatcagttgagacaagccaccaagattgcttcagcacctgaaaaactcgggcgagatccacggccacagacctccaggataagccaggagcaggtccctgaggcctcacagctctcccagctgacttcaaatctggcccaggtgaatcggacaaatatgactccctcagaccccctgcagacctcgctgtctccagaacttgtttccactcctgttcctccccctcctcccggggaggagaccaatctggaagcatcttcctccgatgagcagcctgcgtccctcacaatagcccacgtcaagccaagcatcacgaagaggaatgggagctttccaaagtactatgcctgccacctgtgtggacggcgcttcactctccggagcagcttacgtgaacacctccagatccacacaggagtacctttcacatctagccaacagggagaaagtcgcgtccccctgactctctgattctcccatcatcgatgggcagcagcagtcggaaaccccacccccctcagacattgctgacattgacaacctggagcaggccgaccaggagagggaggtgaagaggcggaagtacgagtgcacaatatgtggacgcaaatttatccagaaaagccactggagggaacacatgtacatacacaccgggaagcctttcaagtgcagcacttgtgacaaaagcttttgcagggccaaccaggctgcccgccacgtgtgcctcaaccagagcatcgacacttacaccatggtggacaaacagactctggaactctgcacatttgaagaagggagtcagatggacaacatgctggtgcaaacaaacaaaccctacaaatgcaacttgtgtgacaaaacattctccactcccaatgaggttgttaaacattcatgccaaaaccagaactcggatgtttttgccctagacgaagggcgatccattctcctgggcagtggggactcggaagtaacggagcctgaccacccagtgttagcttccatcaaaaaggaacaagaaaccgtcttactagactgaatgtcacttatctttttaaaaaactctcatttttacaaagactatcttccctcccttccctgaattcagaactgtagttctccatggcatgatacaaacaggtccttgttctcttctcctcttccccttttccacatcccagccccacctctgtaaaggctttgtgcattataaacctggaatgtatcgactttctttcaggggatattggaaagataatggtcattatacttataaactcaaattttgagaggttttagattattcagaagcatacttggaactaatgaagggtatataataaaacaactggaatccaatttggtaagctaaaattatgactttccctgggtaaaaagtcttctcagaaaaacaatgtcagaaaataacagcgtgctgcttagaaatacggctgggctctgtactatgcaaaatctagaaagtgtggggaaactttaaacccaagaaaacgttcttagtattcatcctccaggtgtcttacttcagaatgcatcctttgagattatgtccacttaagagaaatcatcagttaagaaatctactttaacaaaacaaaaaggagaaaaagtaataatgtgatggcaatcttaatttttgggtacaacatgacaagctgtgagtttgtgtgtttgtaagagaaaaatgtgtgggtacttgctaataaacaggtgaattaatgcacatccttatctcattgctggcttctttccaagttgagcaacaacaaaatgctgtatttgagtttctgacaaatttgttttaaaaatcaaatttgaatgtactattctataaattgcctttctgaatagaacatgacatgccattttctagcagctgccagtgataatttgttttacactaacttttaaatcagtgtgtgtactgcagggaaaaggatataggaatactcatcttacaggggaatttgtgaccagaagatgtagtaacttcaatgactgaaagtcaatgctgatagtttactggcaacattaattgaagcatcaaaaataaatggcaaagagaaatcaggacaaaaaatctaattgctgtttgggaaaaaacttgattttgatgtttattctccaggtttttggttgttttttttctttcttctttcttaatgcctgaaattttctccattggcccgaaagcagtaaaaattgttcattaatcttccgttaggccaataaaagaagggcctcacaagacaaaacaggagccagaagtaaggactgaaggagaaggggagaatagctaatagctatagtatatgtatatgttaaaaactgaatatcccatcatcctatttcatgtatagttgagttctcaaatttgtaagtttttatacatcctttcattgaataaacgtttaattaaatgagt

SEQ ID NO: 1316 - DNA, 2841 bp, Homo sapiens
attcggctcagtttttctcaatattcataagtaacattgaaaacaaagagttatgtggtcaaagaaaggacaaactggttaatggtaatcgtcccctgtgggccctgggcgttggtgtcacacagaactgagaagcaaagcgggtggtgacagaccctggtaatgtgcagggagcgtctggatcggagtctcgacctggtgggtggtttgtccagggaaggacagttctcttctttaggtacacacggtagggactatgattaaactacttgacagcggcacctctgtgacctcattttcgtgtgacacatgcagatctggaagccgccgtcaccgtgagtctcagttggctctctctcacggtcttgcctctgaaaatgcaactgcattgtgcacagaaatccttttctgggtaaaactgggtcttctataactgctgtccgtgtggcttcatgttcatggtgtgatgtgcatgtgtcagccaccagcaccaggtccctgttgggatgtgggagccccttgggctgtctcatcatttagcagttgtctttacagtggtcccatcctctgtaaagacacacagagccacatcacacatcctctatcctaggtggagcccggggtctgcctcccagctgcaccacctttgtctgtctgcaggtcgccagctctgctggggccttctgaagcagcctctctccgtcttgccattcttttcacactgctcccatgttaagatttctacacgtttcgaagacactaaattcttacctaggattattggggaatggaatatatggttagaaatagatgaatttttatttttaaaaaatgacaataagggctggacgaggtggctcatgcctgtaatcccaggactttgggaggccgaggcgggtggatcacttgaggccaggagttcgagaccagcctggccaacatggcgaaaactcgtctgtgcgaaaaaaacaaaaatcagccaggcatggtcgtgcgcgcctgtaatcccagttactcaggaggctgaggcggggaattgcttgaacccagtaggtggaggctgcattgagccaagatcatgccactgcactccagcctgggtgacagagccagaatctgtctcaaattacactagtaagacaactagaatatgccaaaaataaataaacttaagcactaaattatctgagatcctactgtatacagataataacgatgactgcatatttttaaactgtgaacacattatcctattaatcctgctcaggtaacccacctttgtaatgtgaatattctttcccagtaatataaagaggtagacagtttcttaagctgttagaatgcagtgaatcctcccaggccctgaagtccagttgaatggaaatctgcctgggccagggcagccgccggccttccccctggttctcacagccaaggtcctcaggtggcaagttcagggaagcaggcagactgacccagagtggggcagacccgctccactgccaaccccaggtgctggtctgggtctgcagaggctcagggaggaggaggcagctgggtcggaccccaattctgggactcctgggcccattgcccagctgtcagctgtcagcttgctactccagcagctgcagaggggagagagagcatgagtgagcgtgtgtgcacgcgtgtgtgtgtgtgtcacatgaaatacttttgaatctgagtgaaatgaatcttctgtgttctgccaagcatttagttgaggtgtattataaactactgtagtgtagcgctgagttttgaaatgaacagcaggggctgcactgttaatgacgatacgttagcattttagcatcctttttctcaagagcagcaaaaacttatgttttcttgtcctccccacatttttgaggtgttggtaacaagtgttatttttccattttaaagatgaggaaaatgaagctcgggctggttaactgacttgctcagcgtcccatggtgagtccgagcgggcggggcgcaggccctgccgtctggcgcttctgtcgagacgtcggctttccaacctggcaggacccaggacgcattgctgcctgtggaaattaattttcttttggattatcaactgcatgtttaaaatgggctgtagacttttaaagtccgtggtttcctaaagtttctgaaatgtctaaaatgtgtttttaagagaatgaaagtcatacctgtagcctttattttggtccctatgtttttcattgcataatctccttatatacagttacttgtaaagccttttacaccaagtgtcaaggagatttctaatacgttgccaatctttacgcttaaagtgttgacatttactttgatgaccattgggaatggaccagtctggattctgtgaaatgcaccatgaggcccagcacctgctttatgctggactggtagaagcaggcagaaggtcatcccagtcctaaagccactcagaaggctgctgagacttgtgacctagaaatactgtaagccaggctgttatgcagagcctgttgcctttcctcgccgcggtttcacgtgggttttctctctcctttctgtctgacaggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgt

SEQ ID NO: 1317 - DNA, 3284 bp, Homo sapiens
tagataggatacaaggaaatggtcacaaagtgagcagggagaagatcttggttccaatcccagcttagccatcgatgacttgtctacccacctatgccgtagacaagtccctcggcctccctgagcctcatttctagcccctgtaaagagagtgttttggtttgctctggttgcataaccagcacaaatttagcaacactcagcagggaatgttcttttgtttgtttgtttctttgagacagggtcttactccgtcgcccaggccagagtgcagtggtgcaatctcagctcactgcaacctctacctctcaggttcaggtgatcctcccaccttagcctcccaggtaactgggattacgggcacccgccaccacacccagctaatttttgtatttttagtagagatggggtttcatcatgctggccaggctggtctcgaactcctgacctcaggtgatccatctacctcggccttccaaagtgctggaattaacaggcgtgagtcaccgcacctggctaatttttgtatttttagtggacacagggtttcatcatgttggccaggctggtcaacttggaatgttctatgttcagggtgtcccatggacaaaaccaagatgctggttaggcagggctcttctcttatctggaaaatcctcttgtttaggttgttggaagaatccccgtcgcctcctcagttgtgactgaggtcttggtttccctgctggccgccatctgggacctcagctccttcaagctgcccaggttccttcccatgtgcgtcctctcccccagttgtccggccaccctctcatccccctcgtatttcagatctcacttcctattctgtcaccagccagagaaggctctctgtgttgaacactcctgtgattccagtggctgcacccagatcctccgggccgtttcccctcccttaaggattcctatgccatgtaacagcacaggcatgggtgtgatctcacgtgttcacagcttccgggggctaggatgagacatgcttgggggcgggggccacttagaaatgtgcctgcactgtgggcgtgatgctctgcactgtggaaggaaaaggagttaaatgagaaatgatggtgggcgctgagcctgagcagcgccgctttgtgccgcagcatcaacctgtgggaaatggcggagttcctgctgaaacaggacgtggtcaacgccatcaacctggatgggggtggctctgccacctttgtgctcaacgggaccttggccagttacccgtcagatcactggtgagcacgtgagagccgccttcgtgagggctgaagtccgggtctgccccagcctgtctcattcagccaatattgagtgcctgctatgtgccaggccccgggggttcaagagagcagaaattgctgcagtccctcccccaggatgccagtactacccaggcctaggagcagggtcagttggtcagcagggacctccctggggatgacagagtaagaactgagatctgaaggaggtggtagctgggtgggggtgggagagccttccgggcagagggcaccacatgtgaagggcccagggctgggagggattgtagggagcggaggaacctataaaagactggagagggctgggcacaggggctcacgcctggaatcccagtgctttgggaggccgaggtgggaggttcgcttgggcccaggagtttaagaccagtgtgggcaacatagaccctgtctttatgaaaaaataaaaaaaaattaggcaggcgtgatggtgcacaccttacggttacagctgctcaggaggctcgggtggaaggatcgcaatacctcatctcaaaaatagatagacgccatcttgtaggtaggtaggtagacaggtgagaatggagagaggggtggttgggggcagcctggagggagttgaggggccgtctgggggtgtcctctcctcacacatcacatccctctacagccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagagtgtccccttggctggcatgggccgggctgccagaggccttgtaagtgtgagcaccattgtccctgtgaccccaagactggcaactgcagcgtctccagaggtacctatccctccaaggggaggggtatgggcagacgctcctgctccggccccttcagcctgtctctggtatgttacagtaaagcagtgtctccagccacctgaagccaccctgagggcgggagaactctcctttttcaccaggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaatggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggggaggctcagctgcctgcttttcgcctgcctgtgtctgctgctgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgcgacacgggaccccttttctacagacctcatcactggatttgccaactagaattcgatttcctgtcataggaagctccttggaagaagggatggggggatgaaatcatgtttacagacctgttttgtcatcctgctgccaagaagttttttaatcacttgaataaattgatataataaaagg

SEQ ID NO: 1318 - DNA, 2856 bp, Homo sapiens
gtttttccctgttgccctgtgccagcactggggtagtgcccctgggctctacccccaaagccttcccagggctctgtcccggcagttcagaggggccaggatggtggacataatcgccaaagtgaccaggaggcagagtcgagccttgccggcacaggtaggggatgctggggtcaaggggtgcccggtgggcctctaccacaagccctgttaggagctgggtgagctggggcttagagcagggagcctcttggaagttggggctcatacttccttttctctttccttctcggaggccctgcccatccaagaggtggtcagcttggggcaagagtggcagggctgccacctgcttgtggacaggggagggaactggagataaggggtgaaccactgtaaggcagtaccagggggctgggcagcctggagcctgagagccaggtccctcttggctcctcctctggcctgaggtgggaaggccacttcttgtctctaggatgcgacccaagagccattgatcccgtagtcaggcccctgcttatgagctgcatctgggtcttgtctgggcctccatgaacaggagcaaggaggagggtaggggtggcaggcgcctgtaactccttgaaggccagaggatgtggagggcgtgactgcacctggccccaggagctggttagaacccagctgaggctctgccaggagaggagagcatctctatctcagcactgtgcagggtctgccgagagttccagagtttgaaggggcctgaaggacactgcagttcaacacccaccacagggctatggcttctctaacagggagtagactctgctcagtcacctccagtgagggcccctcactacctccagaagcagcctgtgtctctggcagccctagtcctcagaatgcttccttcagaggaatgctgctgtgcccctgcagcatgataccccatcttctcttccttgtgacagccctgtcatgctggggacctaaacttctacctccgaaatctcctctgtacctgctggggacattccttcgtgtgaggaccccatcagcctcactggcctgggactcctcgtggacccagagccatggcccacagcctgccaagtagaaattcctgctccaaagagcctgttccttatcagctcatccacccctggtggagcctttcaactcctgccccagtgcgttcagctgggaggatgggaggtgtgtctggttcctctgccttcctctccccgctgcttccatcctgccctccccaggaatctcctggtttctgtggctccgaccctcctcctcagaaagctcaagctcattccaggctcttctgtcatgtcaggcatgtttgttgctgaaactgggcatgggttagacttgtgtacacaagcagtttgtggcagacctgctatgtgcttcagggcattggcccagctgctggggggcaaatggaatcagctacattatccttagtcttgctctcaagaaaatcctgccttttggggcagaggaggtgggcagatggttggacaactggctgcccaccaaggcagaacgccattgggcctcaacagagcagtgagcagagtgccagcaggtttgacctctccctggagaggcttgtcagctgagcaccgtgagagagcaggatttgggtaggcagagaaccagagaagggaattccaggctgagggaatggctggagcaaacgcttcgaggtgggaggatgccttttctgttgggggccggtgagaggcctgttgtggttggactacaggatgccacatcagagctatggtgggggtagagaaaggacaagtggggtggagggtcccctctcagccacacagcagcctggaggaaggggagaggagagaagaactgatgggctgggatccccagctctccctgtcccccaggcgcctggggactggcaccctgtctaaaactgtaatatcctcttcattgacagtgttttcatttcttgcttagcagtgatcagcactgacatgctgtccatttactcatcacccccaccatttacacacaggtgcacttgagtgccagctctgccagggaaggatttgtgtccctttcttccctgctgtattccccgtgcctcaaacagtgcttggcacagagcaggtgaatctttgttgggtaaacaaatgttcttcttttccttcttcttttcattgttttggtttggtttgcttttttggcatcagtttggtgaaaaatgaatttttttttttttttggcatctgcctaaggctcagggagagaccaccctgaacaggtgcttcctctttcgaggagtttacagcttagtgatggtgtcacagtcagcagaggaacttctgtgaatttttaaaagttttgtagtacaaaattttgaggctgcaggaaagttcaaagaaaacaaaacaaaaacaaacccctataatcacagtgctcagaagggacctctgttagcattttggaaagtttccgaaaacacaaaattgaaatgtggaaatctgcttttccctgaagtattgtgtatgcttagaaaatagtagtaattggccaggtgcggtggctcacacctgtaatcccagcactttgggaggccctggtgggcggatcacctgaggtcaggagttcaagaccagcctggccaacagggcaaaaccccatctctactaaaatacaaaaattagccaggcgtggtggtgcgtgcctgcaatgccagctacttgggaggctgaggcatgagaatcgcttgaacccaggaggcggaggttgcagtgagccgagatcacaccattccactccagtctggacgacagagcgagactccatctc

SEQ ID NO: 1319 - DNA, 2848 bp, Homo sapiens
ttttttgggtcctgaaccccggaagagaaactgcgttgtacccttttacgtgaggcggtgacggcggttcggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaacttctgccgcggctgcctgcaccgcaactgggcgccgggcggcggcccgttcccctgccccgaatgtcggcacccatcggcgcccgccgcgctgcgacccaactgggccctggccaggctgactgagaagacgcagcgccggcgcctgggccccgtgcccccgggcctgtgcggccgccactgggagccgctgcggctcttctgcgaggacgaccagcggccagtgtgcctggtgtgcagggagtcccaggagcaccagactcacgccatggcacccatcgacgaggccttcgagagctaccgggagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcagaatccaaaagaagtgttgaccaggagtgagatccaggatgtgaactattcccttgaagctgtaaaggtgaagacagtgtgccagataccattgatgaaggaaatgctaaagcgattccaagtggctgtaaacctagctgaagacacagctcatcccaaactcgtcttctcccaggaagggagatacgtgaaaaatacagcatcagccagttcttggccagtgttttcttcagcatggaactactttgctggatggaggaatcctcagaagactgcttttgtagagagatttcagcacttatcctgtgttctgggaaaaaacgttttcacctcagggaaacattactgggaagttgagagtagagatagtctggaggttgctgttggggtgtgtcgggaggacgtcatgggaattactgatcgttcaaaaatgtccccagatgtgggcatctgggcgatttattggagtgctgctggctattggcccttgataggcttccctggaactcccacccagcaagagccagctctccaccgagtgggggtttacctggatcgtgggactgggaatgtctccttctacagcgctgtggacggagtgcacctgcacaccttttcttgttgttctgtctcacgcctccggccatttttttggttgagtccattagcatctttagtcattccaccagtgactgataggaaatgaggcttttcttcccctgaccaaaactccttccctgtagtccagctgagggacacacatccctgggccctcttctgcccttcatgtctctatcctggatggtccatcttctgggtctccctaacggtaccgtttggtatctgccctttgtgtgcttcacaagaggcagtcccatgggaggtgggtctggccaatggagatgggacaggaaattttccaagacgcttttgggaaatctttttgtagcttttaaagagatgtgcggggaagacatatggatgttagcagccatattggaactgagaacacaggaatggtggaaaggtagaagaaacagagtttttgttgccgttgtgaaattgttgaaatttccttcatgccaagcttcttgttatatgagataattacgcccttattgtataagacaattttagttgtatttggttacttgcagcctgaagtaccgtaactgcactaaagggacgtagtgtgaacatcccgcagtataggcttaagtcacttttgtgaaatttgacaaaggcatagaatctttttctatccagtcaggcattgcctattctttccagtaactactgattcccccacttttctgtcttagaaaattgtgggaatcccccctcactctgcctatgttgcactctctctcttcccaaccataactctgccctcagctattaactgtgctgtgtatttatcaagttggtatgttgtatgtacagtgttattcatgtcatcatgagaatgttgaacgcttgttaaataccttttgctagcctcttcatatgctgttgcatatgactctcatcacaactcagtgagatggaaagacaaatcctatttgtacaaatgagaaaactgaactctttagagtaactagctcagtattggccagctggtaaatggcagtgttgggattaaaatccagttcttatctactctccctttattcagaagcatttattggatgttgatctttgtttcaggttttgattttgttacttttttatactgtgtatattttcctcagtctacccttctgctctagattgtctggactcaggagattgtggcagttactggatagttatttttaagataatgattgcttttctctgtttatataagtcatgtgtacttattgtagaaagtttgtaagatgcaaaaagtataaaaattaaagttatgcactactaacatttcaatatattttctcccagattttcaataaagactttcaggcagtg

SEQ ID NO: 1320 - DNA, 2612 bp, Homo sapiens
ttgttggctttcaatgtagttgtctgttatgagagacagtttttctttcagaggagcttgtaactgattaggtgggattccaaggaaaaagagacttttgaatcaacccagttgaaagaaagatgacagcagccctgaggaagaaacttcttgtacactttcttacacagaaagcattttgcttttgttgctaaagatttggtttgaatgaaagatgctgatcagaaccaatggggatcagatagacaagctcccagcatggagtggctgtcacggccgtgatgaaaacagggccccttcagtgtggaaccgtgggagacgcggaacacaacacagggtggtggattcctgggcggagctctgcctgccccacgggcctgtggtctgctctgtctgccggggcccagtttaccgaactacttggtggccagatagccaccgtagggcgtgagcggccggcacgaaagcccagggcctctgtctcccgggagctgctggcgcggcgcggctgggacacgccgtactcggtgccacgttcttgcccagttcctcgctgtggtgagctgctggctgttaggaagcctttccctcggctgcggccctcccacacggcccccagacccctgactgcagggtgggcgggcgtaccaggggaggcactctggccggcccgcttggcagcagggccacagctcctcctcgcagggctttgtgggattttaaaggatgaatcgtcttgttctccatgttccccctgccgcccatgcgcgccatgctctgtgtgaggatgaattggagggactggccatgagcggtggcttttttcgtgtttggggtcgggagggtgttgggtggaatgaacatcaagggaaccacccattgagcttagaaattcttgccaggcagttggtttgtgtttgtgtttagatgagagcagtgttgattgcagtttgacatctgattttttttttaattgagttggtacaagcaggatgtcattggctaggtgacaaagtcactgggggaccaaataccaagatgcccgttggtgagagagaccctccccaggaccctccccaggcgcctccttctccgtgacgttcaggaccctccccaggcgcctccttccccgtgacgttcaggacccctccccagggccctccccaggcgcctccttccccgtgacgttcaggaccctccccaggcgcctccttccctgtcatgttcaggaccctccccaggcgcctccttccccgtgacgttcaggaccctccccaggcgcctccttccctgtcatgttcaggaccctccccaggcgcctccttccctgtgacattcaagaccctccccagggccctccccaggcgcctccttccccgtgtggttcaggaccctccccaggcgcctccttccccgtgacgttcaggaccctccccagggctctccacaggcgcctccttccacgtgtcgttcaggtgacgaggcgagaccccgcgctggacgtggcactcgggtgttggagtgaggtggcggcgccgtgtgcttgatggtttccatcagagaagagtcagccttcctccagaaggagcgggggatggtggttccccagcccggaaggaaaaggagccgagctctagctgtgatcacggcctcagcctgcctgcctttgtgcatggaaggaacttgctagtgaccgctgctctcctgggcagtgtaagagtgttgtgtggaggccgggggcgctggaggccagtctcgttttcatagcccagatggctcccggcgcaggttgcagtcacctccattactctttcacgagagagctgcagcaatgccatctggggcctggccacacctggtcactggtgtcccgaggcacacaagcagtccctgccggaagctgacacactgtcatggccaagggccacagtgcaggtaccacggtgacccggcttccctgagtccagctcacgcccgttttccttgtctcaaccttcagagcccttccaagcccccactggctgcagcccacccaggggacccacctttagaggctggactcaggcttcactgaggggtgagaagcgcaggtttacaaagctctggctgggaagaaattgagtaaccactccctgagaaacaaacggagacgtttaattacatgaacgcacacattttaaaaaccgcctgtgcactcccggagggcagagcctgcctctctggttatttttgtgtcctccattcacttacaggctgtgacaaaccctgtgcccacgctgcctccactgccgggagactcagggctgggggagacatgccctggtcaccactgcggaggctcagggctgggggagacatgccctggccaccagtggtgagccagcgagacaggaccccacgcgcgctgacccggggacgccatggaactcactcgcgattcctgcacgcgcgctgacccggggacgccatggaactcactcgcgattcctgctcacagcacgtttcctgctcgaaaaccaggagagcctccacgtgccgactagctctgtccacacatccattgcgcagctctgcagcggaaggaccttcagtaaagacgctggtttgtaacg

SEQ ID NO: 1321 - DNA, 2164 bp, Homo sapiens
cggttgcctccaacgggggcggcgcgggcggtgccggcggcggtgctgcgggcgacaaggacaccaaatcgggccccctgaagctgagcgacatcggcgtggaggacaagtcgagtttcaagccgtactccaaacccggctcggataagaaggagccgggaggcggcggtggaggcggtggcggtggcgggggcggcggcgggggtgtttcgtcggagaagtcgggattccgggtaccgagcgccacctgccagccattcacgcccaggacaggcagcccgagctccagcgcctcggcctgctcgccgggaggtatgctgtcctcggccgggggtgccccggagggcaaggacgacaagaaagacaccgacgtgggcggcggtggcaagggcaccgggggcgcctcggccgaagggggacccacggggctggcacacggccggattagctgcggcggcgggattaatgtggatgtgaaccagcatccggatgggggcccgggaggcaaggctctgggctcggactgcggcggttcatcgggctccagctccggctccggccccagcgcgcccacctcctcctcagtgttgggctctgggctggtggctcccgtgtcaccctacaagccgggccagacagtgttccctctgcctcccgcgggtatgacctacccaggcagcctggccggggcctacgccggctacccgccccagttcctgccacacggcgtggcacttgaccccaccaagccgggcagcctggtgggggcgcagctggcggcggccgcggccgggtctctgggctgcagtaagccggccggctccagccctttggccggagcgtctccgccgtccgtgatgacagccagtttgtgccgggacccttactgcctcagctaccactgcgctagccacctggcaggggcggcggccgccagcgcttcttgcgcacatgatccggctgctgcggctgcggcgctgaagtccggatacccgctggtgtaccccacgcacccgctgcacggtgtgcactcctcgctaacggccgccgcggctgctggcgccacaccgccctccctggccggccaccccctctacccctacggctttatgctccctaacgacccactcccccacatctgcaactgggtgtcggccaacgggccgtgcgacaagcgcttcgccacgtccgaagagctgctgagccacttgcggacccatacggcatttcccgggacagacaaactgctgtcgggctaccccagctcgtcgtctctggccagcgctgccgcggccgccatggcttgccacatgcacatccccacctcgggcgcaccgggcagccctgggacgctggcgctgcgcagcccccaccacgcgctgggactcagcagccgctaccacccctactccaagagcccgcttcccacgcctggcgcccccgtgccggtgcccgccgccaccggaccgtactactccccctacgccctctacggacagagactgaccaccgcctcggcgctggggtatcagtgagggcggccgggagggcgagcgagggagaggagggagagggggaggggaggagtccagggagaggcgggatcacggcccaggctgctgacacccgcgcgtggggaggactcgggccacgaaaggaaagaaatgtataccgtatctatctacccgacagcagcgaccgagacccggtgggacactccccttctccccactttcacctccccacccaaactttataaaagttgaaaaaatatcatttgactttttatagaaaaaaaaaggaaaaaataattgagaaagtgttcatctgaggactgcatcggtggacactggtatttatttatgttagctccaagcggaccggtggttcaaaagtgcattatttagtttgagctctgtaggtaaaaaggaggtgggaaaaattttaaaacttgagggtaaaaatgtggaaaacaaaccctcccatcccttgtagattataaataaaagcaaaaccgccacagaactagaggtcttctctttaatgttactttaaaattgctatgattgtattgtacgttatttaatgtctgattgaaacacaaatttacatgcatgtttgttacaaaaaaaatgaaaaaaaaagtcacaatttgtcagctctg

SEQ ID NO: 1322 - DNA, 2714 bp, Homo sapiens
acacgttctccaacccaaggaggccagacagagggacgtggtcactctctgaaaagttcaacttgagagacaaaatgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacaatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatgagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctgggtgttccaaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactaggttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgcatct

SEQ ID NO: 1323 - DNA, 3023 bp, Homo sapiens
acactccataagtctcggcactgctcatcagcccatgtgtcagcacgctcttgctgatgggagcagcggggagaaacgccatactgggaagtcactgctggtgtgggacaagttacaagatgcttctgggggaggaaaatgtgtatcatcaactcctcaggacagtgaagcctgctcagtctagacttacatgagagactactcaatgactctcacagaaaagagatcttcccaaggtgacatcttctcctcctaagccaataaggtcatcttactcacagtccacttccaggaactgaccccaaatggacagaatctacttatatcatggcacagctgtcaacttctcttgctaaagaagagaataacgctcacaaaattgccccagatggcggtgcaacatttttgggccaagtactacaactgaaaagcatgaacagagttttaccagcgggttacaggtttgtttatatgaaaattgcactccctgtttatttctaatagggaaaatatttctgatggtatatgattcctaaatgaaatgatgctaacaaatgttcacatattttgtgagggagaacacagcaaattgtaagatatgatctgcagatatcaaactcattttctttactggaaaacaggtctgaccgcatggcacgattatgttgggaaaaatgcagctatagttctcttcatttggaacacgaacgtatatcacaaagctaaccagatcacattcattcagtagcaaacacaaatcaactgtggctagcaaatgtgtgtacaaaatacattgacatcaataccagtttggtgctttcttgtgatcaaatccagggaaatagaaatcagccatctaaaacttaaccacttgcaaaagagcatttatgttaccagcagtttaaaggaaatgaatgttcattgaagagcagcctatgctgaactctcatttttacatgtattcaactatatatatgctggctcatcattttaaaactattatcagccaggtgcagtggctcacgcctgtaagcattttgagaggctgaggtgggtggatcatgaggtcaggagatcgagaccatcctggctaacacggtgaaaccccatctctactaaaaatacaaaaaattagctaggcatggtggcgggtgcctgtagtcccagctacttgggaggttgaggcaagagaatcacttgaacccaggaggcagaggttgcagtgagccgacatgcgccactgcactccagcctgggtgacagagtgagactccatctcaaaaacaaacaaacaaacaagcaaacaaaaaaattatattatcatttattaaatgtgattaggtagctctggatccttggtctgttattttttttaaggcataataagaccaggacttaaaaaaaaacaccctgtaaaatgtacgctttttaagaaataatagaagtcacttttattctaacatgctatctttattgaaatattttaaacatttattgcaaaaacaataaatgctttttatttttcaaacataaacaatacttaagtataaaagtaaaaactgaacattgcatataaccctggtccatcccatttcctgcagaaaaccactattaacagttttatgcttatacttctagatgtagttttatttcctgaaactttctcttttactaaatactgtatcttagagatgttttgatatcagtacatacagagataccttattgtttcacagtatttcatagaacagatgtaccataacttacttccaactgataaacatttagattgttctcaacgtttcacacataaaaacaaaactgcagcgattattctttgcacgcacatctctgcataatataaaaacatttctgaggatttctagaattgaattaacatgtcaaaggatctacatgttttatattttaatacattgtattcatcaaaacatttttttctgagtttctcattagattagataagctgtgttttgttttgtttgtcttagctcttgtttaacttctagaaaactagtgacatgctcttggagaagcccctcttacagaaggccaaagaagctgagaaagcacagaggaaataatcaaggctcacctgggaaagcaacacagcttcaccatcattctctcgtccctgagaaaataaatcaaaacaaacaagtatattgagcactgggtgttcaaaaccacatgaagaattgttttttgttaaattaaagccttaagtagtcttaaatgatgtagcaaaatatgcccattcaatgtggttacttacctcctcagatatgaaaggattttatatggcagtatttttatattctacgttcttacaagtttcacatattccattacttaagcgttcatatttctcacaaagacttacattcctcaggagtacaatgttttagaacaaagaatgcattcaataaatctttacagagttaatctttacagaggacaattctcctgtagacaggagtgaatacatataaaggacaaataacgaggcaaggcctttgtacctttcagccatctgcaaaatgaagaactgaattcaaattttggtaggcatggctttcagagaagtctgacagaagctatgcatgaatttctttttttctcttttacagttcccttcttacttaaaaaaaaaaaatcctgaagtggcttagtgatataaactatggagagaggtgtgggtggttcttttaagtgcacaataaccaacaggtctccctcctggaaaaattctcagatgctgaggaagatatttcctgtggccaaaagattttcttcactagtttttgtcaaaatgtcttttcgcagtttaagttctctgacgttgactgatgtgggcccacttgcaaaaggccttcccacatatctcatagagtttatctctggaaggaattcttcaatgccaagtgaggatgagctgcaggtcacagctttcctactgccactgaattcagagtgcttctcctcagtgtggctctctatgtatc

SEQ ID NO: 1324 - DNA, 2404 bp, Homo sapiens
gctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggagctgctggagcatggagtgtgtgaggaggtggagagagttcggcgctcagagaggtaccagaccatgaagggctccagcaccaccaggacctgagcaccccagtcctgcggtccgatgtagatgccctgcagcaggtggtggaggaagctgtggggcaggccctgcctggggccaccgtcacgctgaccggcggcttccgcaggtaagaaggcccgacgtgcccctctggcttggcttcagacccctccccagtgaagggacctgagtcggggaccctgaagcgggcccactcgttggaagggatgtggcctggggctggagtgagcaggccgtgtccctgagtcagagtcagactgacgccctcagggggaagttgcagggccatgacgtggacttcctcatcacccaccccaaggagggtcaggaggcggggctgctgcctagagtgatgtgccgcctgcaggaccagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagggaagcagcagtggcaagactcctaggtcacggaagtcctgcttctgttgcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaacatgcagt

SEQ ID NO: 1325 - DNA, 2224 bp, Homo sapiens
gagagagacttccttggggagaggaattcagctgcacgctggagtcagctggagttgcccaggccctgtgagcaagtggcaggcgtgcccagctgcattggggagagggctgttctcaaggccaaggtcatttttggagggagaactggacgcctgatcaaatctggcccacaatggactcagcagccaaggatgagatgcagccggcgttgtcccctggctcttccttcccaggacctgagtggccagagcaggagcgggcagagcagctggcccggggtgcagcgctcaagtgggcctcaggcatcttctaccggccggagcagctggccaggctaggccagtaccgcagccgcgaggtgcagcgtacctgctccctggaatcgcgcctcaagtcagtgatgcagtcatacctggaaggcgtgcagactgtgccggctgcagtgtcccacacacagactctgattgatggccaacagttcttggaggcatatgtgagccttcgggagctggagcagctgcgagaggatacgtgggcacccctggggggcctggagttgccagtcttccaggggctggaccttctgttcgaggcactgggccaggctgtggaagcagctgcaggggccgcagggaagctggcacgggaggacccagccctgttggtggctgctgtgcgtgtggcggaggtggagactggacgaacaacccccctgggccaggtcccccgggactggcgtcagcgctgtccgagggcactacaggagggcctggagcaggcccactttgggtcacctctgctgcctgcaccaggggccctaccagggtggctggaggctctgcgagtggccctgccagtcgagttggccacagctgaggcactagtagcgccttgctgcctgccacagtacaacgtggtccagctatgggcccacacgctgcatagtggtttgcgccgcagcctgcagaacctccttgcagggcctgagctagaagctgcggatgccttcgccttgctgcactgggcactgcatgtgtacctggggcaggaaatgatggggagcctggagttggggcctgaggctgatgtgtcccagctggagccccttctgaccttggagaacattgagcagctggaggcaacatttgtggccaacatccagatcctggaagagaacattcgtgtggccagcctggtcagtgagtcactgcaacagcgagtgcatggcatggcactgtcagaactgggcacattcttgaggagcttcagtgatgctctgatccgattctcccgagaccacttcagggggaaatcaatggcccctcattacgtgccctacctactggccgccctcaaccacaagtcagcactcagctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctggaaagtgtgtgtgaacggacggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttggtgatagcttcttgggcgggcagacgggcgagagtctcagtggctgggtgggagagagggctggcgcgagaccctaccccgacgtgctcagggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctcgtgcccgcgcccgcgctccgccggcctcctgcctgccctcggggtcctgcgcccgagccctgctgctcgcagaataaacctcggctgccgg

SEQ ID NO: 1326 - DNA, 2622 bp, Homo sapiens
gaaaacgaaagcactccgtgctggaagtaggaggagagtcaggactcccaggacagagagtgcacaaactacccagcacagccccctccgccccctctggaggctgaagagggattccagcccctgccacccacaaacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccggtgagtctggaaccctggggagacgaggaaaggctcagggttcagtttttggctcagcaaagccttagcctggctcctgtcactgctgccactgccagaactgccctgtctggtctgtctggtgctgatggtagaagagaagaacggggaaggggcaagagctgggtctgtctttctctgggagggtctgggaatacggagccccagaaaaagggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgacttaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgactgcagggggctcgaagtctggaacagcatcccgagctgctgggccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcgactgctgaccctgcagagctggctgctggacgcaccgtgctcgctgcccgcagaagcggcactgtgctggcgggctccgggtggggacccctgccagccactggtcccaccgctttcctgggagaatgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgctttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggggcgggacctggggcgggggacgggacttaaataaaggcagacgctgtttttctaccc

SEQ ID NO: 1327 - DNA, 2310 bp, Homo sapiens
ggcggtctacgcgaggaagatggctgcatcccagcagcaagcttcagcggcttcctcagctgctggtgtatcgggtcctagttcggctggcggcccgggtccccagcagcagccgcaaccgccagcacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattcagaacactaacatcgacaacgttggtgcccacagccgccaagcccgacgcagtgcagcctgacagcctcccctacccacagtacctggcggtcatcaaagcccagatttcctgtgccaaggacattcacaccgccctgctggactgtgccaacaaggtcacgggcaagacacccgcaccacctgctggccctgggggcactctgtgaagtgggggacagggagtggggcaggcagtggttggtgggtggtgtgcaaagggaatgaagagcgtcctgggcctaaacacagcagcctcctctcttcctgcctgagcaccgcagcgggagccagcagggggcagcagaggccaacagggagctcgcaggccgggcccctgcgtccctgccccttcttcctgctccccctcctagcctagggtagactttgaactgtgtgtgttgatgacttctctgttccacaggccctcccccattcttgcctgggtgtggagccctggctgtcccctctccctcagtccttcctgactgtctccagctgggaggtggtctctgtgtgccactcctctgtgtctctattacagttgtgtctctctcatcctgtctctttttcccttgtttctctgttcctgttaatgtgtttctccccatggtcctatttctctcactctgacctctctctcttagtcccctttagctgtcttctatccccagctcctaactgggactctgtgtctatgcagggggccagcacccctgggttatctggggctaagggaagggacttcatttccaggggccacagccaagcccagagtcccccagcggctcgcatgtcagcccagaccccagggtccttggcctaggagaggagcagtggaggggcccaggctctgagctccacaggtctgagcagggagcaactcaggcccccacccaagcctgcgtcagcggaacttgagtgaggggcgttgtgcaatttgtggcaaggctggcccagctggatgcctgggtcccagtatttttagccccaaaggagaagtgaaaaggccccagccggggtgaatcatcagtcctggggaagaacccaggcgcctgagccccagctccgggaagcaggcactggggagggggcttcaaggagggagtgccccctcagactccctgcttccctggaagcttcaggaagctcagcctcagccttcaggcctgagcaagtgcagggcggagctaccagcccaggctcagatgttggggtgtgaaagcctcaagtgactcagcctggttggagaactgccccacccagtatcttctgtgccatggttcccacattcgcactccatggcctcctgtcctggaccccacgtctgcaaggaaaccctaggaccatggatacctctgtgattcacgctgagcccaagtccccacactggaaaactgggaaatggccagctgtgtgtcccaggaaattcctccccttattcttccttgaagtgcccgagcatgtagggcaagaaggaaggctgaagcgctgtccctaggaggaatttctccttcaggggagcctcagttttgcccatttatctaattgaatcagttttttacccaatcccccgattttgtaggataatctcccttatctaaagtcaactgattatggactttaatcacatctacaaaacacttccatggcgacagctagatgagtgtttgaataactgggactgtagcccgtccaagttgacacataaaactgaccatcgggccgggggcggtggctcacgcctgtaatcccaacactttgggagcccgaggcgggcggatcacaaggtcaggagttcgagaccagcctggccaacacggtgaaaccccgactctactaaaaatacaaaaaattagccgggtgtggtggcacacacctgtagtcccagctactcgggaggctgaggcaggagaatcgtttgaacctgggaggcagaggttgcagtgagccaagatcacactattgcactccagcctgggcgacagggcaagactctgtctc

SEQ ID NO: 1328 - DNA, 2218 bp, Homo sapiens
ttatcaaagtggattcaattacaacagaagaattcccccaacacactgattctttcccattttgtgggaaggcccatgtcaaccagctcagagtcctccttgattattaaacgactaactctaaagttgatgcagcactcttggtcagtctctgctctgacactggatcctgctaagcttctggaagaatttccacgttggctggaaaaactctctgctcgtcatcaaggcagcatcatcatcgttattgattctatagatcaagttcagcaagttgaaaaacacatgaaatggctgatagatccactgccagtgaatgtaagagtaattgtttctgtgaatgtagaaacatgccctccagcatggaggttgtggcctacacttcatcttgatcccttaagtccaaaagatgcaaaatctattataattgcagaatgccactctgtagacattaaattgagtaaagagcagtgctgggagagcaggcaatttagataaaatccttcatcagtgtttccagtgtcaagatactctttcattatatagacttgttctgcactctatccgggagtccatggcaaatgatgtggataaagagctaatgaagcagatcctctgccttgtcaatgttagtcacaatggtgtgagtgaatcagaactgatggaactctatcctgagatgtcctggactttcttgacctcccttattcacagtttatacaaaatgtgtttgttgacttatggatgtggcttgcttaggtttcaacatctgcaggcttgggaaacagtgagattggagtacctggaaggccccactgttacttcttcatacaggcaaaagctaatcaactatttcaccttgcagctaagtcaggacagagtgacttggagaagtgcagatgaactcccgtggctttttcagcagcagggaagtaaacagaagctgcatgattgccttcttaatctctttgtgtctcaaaacctttataaaaggggacactttgctgagttgctgagttattggcagtttgttggcaaagacaaaagtgcaatggcaacagaatacttcgattcattgaagcagtatgagaaaaactgcgaaggcgaggacaacatgagttgcttagctgatctttatgaaaccttggggcgatttctcaaggatctaggccttctcagtcaggccatagtacctttgcagaggtctttagagattcgagaaacagctttagatcccgatcacccaagagtagcccagtccctccaccaactagcaagtgtatacgtgcagtggaagaagtttggcaatgcagaacaactgtataaacaggcgttggaaatctcagaaaatgcttatggtgcggaccatccatatactgctcgtgaacttgaagcacttgcaactttgtaccagaaacaaaataaatatgaacaagctgaacattttaggaaaaaatcctttaaaattcatcagaaagctataaagaaaaaaggcaacttgtacggatttgcccttttacgtagacgggctttacagttagaagagcttacattaggtaaggacacacctgataatgctcggaccctcaatgaactgggtgttctctactatcttcaaaataacctggagggaaacttgacaaagctgtacctttgtatgaattggctgttgaaattcgacagaaatcttttggcccaaagcaccctagtgtagctactgccttggtgaacttagccgttctttatagccaaatgaaaaaacacgttgaagctttgccattatatgaaagagcattaaagatttatgaagatagcctgggtcggatgcatcctcgagttggagaaacactgaaaaatttagctgtgcttagctatgaaggaggagattttgaaaaagctgctgaattatacaaaagggcaatggaaataaaagaagcagaaacatcactcttgggtggaaaagctccttcacgccattcatcaagtggagacacgtttagcttaaaaacagctcattctcctaatgttttccttcagcaaggacaaaggtaatagcagcagttagaattctttgcaaatgtaccttaagacaaaataattaaacatttggaacatttgaatttgaaactttaaaaaaatgttgtacgaaattttactacgtgtgatttaactgctatttgtatgaagttgtattggattacattaagttggaattgtg

SEQ ID NO: 1329 - DNA, 1957 bp, Homo sapiens
agcgatgcgggctccggggatgaggtcgcggccggcgggtcccgcgctgttgctgctgctgctcttcctcggagcggccgagtcggtgcgtcgggcccagcctccgcgccgctacaccccagactggccgagcctggattctcggccgctgccggcctggttcaacgaagtcaagttcggggtgttcatccactggggcgtgttctcggtgcccgcctggggcagcgagtggttctggtggcactggcagggcgaggggcggccgcagtaccagcgcttcttccacccggaggagtgggccgacctcttccaggccacgggcgccaagtatgtagttttgacgacaaagcatcacgaaggcttcacaaactggccgagtcctgtgtcttggaactggaactccaaagacgtggggcctcatcgggatttggttggtgaattgggaacagggctccggaagaggaacatccgctatggactataccactcactcttagagtggttccatccactctatctacttgataagaaaaatggcttcaaaacacagcattttgtcagtgcaaaaacaatgccagagctgtacgaccttgttaacagctataaacctgatctgatctggtctgatggggagtgggaatgtcctgatacttactggaactccacagattttctttcatggctctacaatgacagccctgtcaaagatgaggtggtagtaaatgaccgatggggtcagaactgttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggaactggttcagacagtaagtttgggaggcaactatcttctgaacattggaccaactaaagatggactgattgttcccatcttccaagaaaggcttcttgctgttgggaaatggctgagcatcaatggggaggctatctatgcctccaaaccatggcgggtgcaatgggaaaagaacacaacatctgtatggtatacctcaaagggatcggctgtttatgccatttttctgcactggccagaaaatggagtcttaaaccttgaatcccccataactacctcaactacaaagataacaatgctgggaattcaaggagatctgaagtggtccacagatccagataaaggtctcttcatctctctaccccagttgccaccctctgctgtccccgcagagtttgcttggactataaagctgacaggagtgaagtaatcatttgagtgcaagaagaaagaggcgctgctcactgttttcctgcttcagtttttctcttatagtaccatcactataatcaacgaacttctcttctccacccagagatggcttttccaacacattttaattaaaggaactgagtacattaccctgatgtctaaatggaccaaagatctgagatccattgtgattatatctgtatcaggtcagcagaagaaggaactgagcagttgaactctgagttcatcaattgtaatatttggaaattatctacaatggaatcttccctctgttctctgataacctacttgcttactcaatgcctttaagccaagtcaccctgttgcctatgggaggaggtggaaggatttggcaagctcaaccacatgctatttagttagcatcagttgtcaccaacagtctttctgcaaagggcaggagagctttgggggaaaggaaaaggcttaccaggctgctatggtcaactcttcagaaattttcagagcaatctaaaagcgccaaaattcgctatgtttacagtgatactattaagaaaatgaatgtgattctgctctgtctttttaagtatgatcaaataaaaaatttgtacatcac

SEQ ID NO: 1330 - DNA, 2264 bp, Homo sapiens
tttcaggctgaatgacaagactccgcgatgcttctcggcctgggctgcacaacggaatctaccagggaggttttaaaaacactggtacttgctggaggtggtggcgcctgtctgtaattgcagctgctccagaggctgaggcggaggattgcttgagcccaagagtttcggtttatttgctttttcagagtcttgctcttgcccaggctggagtgcagttccatgttctcggctcactgcctcagcctcccaagtagctgggattacaggtgcatacaaccaggcctggctgatcttcgtatttttagtagagatggggtttcaccatgatggtcaggctggtcaagatctcctgacctcaagtgatctgcccgcctcggcctcccaaagtgctgggattacagacatgaaccacaacacctgccgagcccaggtgttttgaatccagcacgggcaatggcaagaccctgtcccaacaaacaaaaaaacactggtgcctgaggcccaccccgagagattctgattgagttgatttggatttgaattatctttaaaattttggatgtgaattttttttttttttcttggaatggagtttcactcttgttccccaggctggagtgcaacgggacgatcttggctcaccgcaacctccgcctactgggttcaagccattctcctgcctcagctacttgggaggctgaggtcggaggatcgctggagcttaaccttgaggtcgaggttgcagtgagccgagattacatcactgcactccggcgtgggagacagagaccctgtattaacaaacaaaacacaaaccacaaagggcaggtctgaaactgccatttaaaaaaaaatttaataaacttaaaaaaatatatatccacagatgcaggtgaagaacctgttgtcttcctcaagcctctttttcacccatgggtggaaatggtgccctggacacccaggcccacgaggtctttgcgtggggtccctacacagggctttagcttacactgtgctgccctcctgtcccccgagttcccagtctgtcaaaatccaacctggtctcccaggcccagggcaaatgccacctcctccatgaagcctgccacatcctttgcacacccttgggcgctgaccttgttctcccagcgcacaggcacgggtacagtttgcccctgtagtagtaactcaggcacaaaacgaactcttgctgaggctcggccgcgcagagctgagggttgccgcttccaggttcaagtgcgttttgagtttcattcccagcttccttctttttctggtctttaatttcttctccggattaggtcccactcaatgctttccttctcaatttccaaaagagtatggtcagagccagcagcacaccaccttccccatgggtgggggggggccagcctgtggcgggggtgcgggtcccatcttttcgaaggaattgacccacagtgggcgggtccacctttgaccttgccccagggagcgcagacagaaaaaagatccttgcttagtttgaggggccgctggggtgctcggtttgtcttcagaggcctgtctgtaacaccaatgccaacccggtggcactgactggtcaccctgaaggccacggccagtgtcctaggaagggactcaatttctagctgtgccacctgagattctggggttaggctggttgtgcttctgaagttccactgtgctcaaagtgcttggtgaaagttagcgaaggtgattttacaaaaatagatgcataaaatgtctaggaaacacaaaaaatcctcattactcttctctccaaatattttttaagccccaactggaccctaggcaaaagtgagtggcactcctctgccaggactccaggcaagccccggcatcttcttgctgccgtcccagacaacagaagttaccagatgaacagacttggatgggccacgggggtggagagctggaaagcttggctgtgcctctcgatgatgattaagatttcaatatttacagcaaaaccacaaagcaaatgatagaataaagcaaaacaatggaaaatctgagttcactcgtgagagaggtacgtatgtgagctctgaggaaattacagagggaacgcatgcagcgggacagctctcccaatcgcagcgtgcaaagtagacatccatagtgtcttttgaaaaatgaaaaacacattactttgaacagccaagaaaaaaattgcaatttattaagattcaataaagcgttgtactttcgaaagc

SEQ ID NO: 1331 - DNA, 1986 bp, Homo sapiens
aatgaaatggaaaatagcaagtgttggtgatgatgtagataaactggaaccttacacgttgctggtgggaatataaaacagttcagcctccatggaataagcttctcagttcctcaaatgaattgccatatgacccagcaactccactcctaggagtataaataaaaaactggtatttaaacaaatgcctatacacacaggtatctgtatattcatagcagcaccattcacaaaagccaaaaggtagaaacagcccaaaacatccatcagtgaataagtggataaacaaattgtggactgtccttccaatgaaatattattcagctgtaaaaagaaacgaagttctgatacattctacaacatggatgagcctcaagcagaagctggagggtcaggagaaaagaacctagatactagaactagaaagcctctttactcattaaataatcccattgtatctggatattttccactaaatagagtatcaaaaataacatttttattatgcctacttcaaataaatcataccgcacacgtttctatttcttcctctttgccctcatttcagccatctttagtaagagtggctcatcagttgatgggaagaacgtttgtttcctgggtcaggtattgtttttaaaataccatgacccatttacagtataaataaagaactagactctgcacagacttaaaacctaggaacatgaatggacaacagcataaatacatacaattattatgtatcaattaaacatttttttttaatagaagacacaagggaggttttgccttgaccgaagttattcctggttcaaatgcctcctgaaaatgacttcctagtggaaaatacaatctctccagtcctctagcaaatggttctttcccttttgagaaagttactgtgtggttcagtaatttccaaatagtgttcaactaactatattagaattgccttgggagctgttatttttttaagtgtaggaatcagccacccccaactgtatatttctgattgagtgagctagagtgcagcctagatatctgtatgtctttaacactgtcagatcattatgaagtgtaatgtgtttgaaaactgctacagctgagcagttgtggttttttgtttgtacaagcaaaacaaagattgcgagtggtgtagtataccatggaggcttaaaaagaaagacaataataagaattgtattgtttttacaaagggatccactttatacatattggacattaatcgtcatccttgaatgtgtcattacagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtc

SEQ ID NO: 1332 - DNA, 3175 bp, Homo sapiens
aaacctcggagctccagaggagggtctaggggcagggagaagaagaacctctgtagagaagtcaggaggagcaggagtgacaaggaagaaaagggacccctgagatgagagccgggatgtggaagggaaagatagataatggatcgcagaagagcaaatggggcctcaggtgggtttcgagtttagaggtggtcctgaagcagctcagtgaagtagcaccacctccccgtgctgggccagccagtggtcagaaagtttgggacacagcagactggcgacccccaagctccactatgtccatgtcacctgctgcaatctctctagcagcccagtgcgctagccagcctccctggcgccgctctggtctccacctggcctctgtgccagacaaaggggcaccgggcgtcgcaggcagactcacttgagggacagaggagtctagcgggacagctgtagccggaagctgggagccagcgctagggagtggtgtagtgggttctcaccctggggctttgagttcctgctgtgtttgtgcttcattcttttgtgcccctcatcgctgctatgaaaaccttcgttctccagcaggtaaagtgacctcggctcgtgctgcctctccccaggtctctgccttgggccctgccctgggtgggtagctcccatcgaaccagctcctcacactgccagctcgtctcttcctttctcccctaccctctttcttcctaccttgcctcccccttctcaccggctcactggactttcctccccgtgtgttcccttctctcttctgtcagagagatacttgggggaatcttccaactcgggagaatggcctggggcttcttgctctacctttgatgagtttattccctgctgaccctgggttcccccaaattctacctcccagggtcagaagaaggtacggccaattctcctcctgccttttctggcccccagggagatgccaggcccctctgctcccagtctcaaggggccatgatggtggctgagcctggggggcctactccttcctctggccaagcagaacccctgcatggctggagcggggggactctcactcttgccttctgggctgtggacatgtgtgtattttgcctgatgctccctgtcacctccctccctgggtgctgtactcgcctgtcttctgctgggtgtgttgctccagagccctcagacgctctccctcacacaggcaggtctgggcttctcctgccactcagggaaggacactgccacatcctgtgggtttatatcatgttacctcttcatccagcctcaagaccctctgtgtagggggctgggaataacgggaactgtgtttaacatgacccaattttcaggctggtgacgagttcacgggtgtctcagcaaagttggacacaagctagagagagctctctcctcccagccaaaacctgggaattccccactgcagctcctcaggggccctggacagtagctgtgaccaggctggtgaaaggcccgtccctcccatccagggctttcaaagaagtgggtagaatcacggccatcaagtaaacgccactgcggatgacagaggcctagctgaggaggctagggccatgtcctcccagctggcagagtctggacagagcctctggtggcctctgccctgtcatagcctaagctgctgcagccactgtgagaggccacagaggggaaggggaccctgacgccgggcgctgccgcctgggggagcatggcacgattgctcttagtgttgaactttctgttttgtctcttgcccgtccggttttagttcctgaaattaaagaagtggtgagccacaagtacaagacaccaatggtgagtgtgccgctcaaccctgatgggccacggtgcgcagggctccctgggggaccttcggacaggaggaggggagggccctctgagcgcacaggggtgagtggggacctcgttttgttgccaaaggttcaactcaggctgaaacaggtcttgagccctgagagacagacacacacacacggatcccctctcccatggggacagcttccttgcttggagctcacgtttagcccagaggcccatgcccagtgttagggcaggagttgcccattggcagatccttcacatatggagatggaggagtctcagtatcgtgatccgcctggttttctctcctctaggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgcccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 1333 - DNA, 2003 bp, Homo sapiens
attccagcaattccctttctgtttgatgtccgtgaacatcacccacattgccatccaggccttgagagaggagtgtctctccaggtgagtccccaaacaccagctggttagagtgacccagcaaagccttgttcgtccccactctggcttaattttccccagctctactccacctgctggctcctggagggcctggacaaagtccccatgcaccggtctccccaggacatcccttctcccacccctggccttagatgtcaggctcctggggaatggtgggggcatcctgggtttgggctggctcccctggggaaatggggaaggaaggcgggagggaacctaggtctcagccttcatccaccgctgagcaggtcaccttgcctttttcctgcagagagtgtaatcggcagcagaaggtcatccccgtggtgaacagcttctatgccgccacattcctccacctcgcacatgtctggaggacacagcggaagaccatctcagactcgggctttgtcctcaaaggtgtgctctttcttctggggaggcctaggctgaatgcacagtgccccaggtccagagagcccaaggtggttgctagactggttttggctgcagttcttccccatccacactttctcaaattccagcttaccaaaatctccatcacccaccccctggagtctgctagttctcctttctctgccctgactgtcgcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttct

SEQ ID NO: 1334 - DNA, 2513 bp, Homo sapiens
aggatgtggactcagttctcactcccatttggtgtcgggtttctagcgaagccaatcggcgtcgctggggtccctgttccagaagtccccgcgaacccattgggattcagattctccccagacgccgaggatggggtcatggcgtcccaaaccctcctcctgctgctcttgggggccctggccctgaccgagacctgggcgggtgagtgcgggatccggagggaaatggcctctgcggggaggagctaggggcccgcgcactggggcgcaggacccggggagccgctcaaggaggagggtcggacgggtctcagcccctcctcgcccccaggtacccactccataaggtatttcagcaccgccgtgtcccggccgggtcgcggggagccccggtacatcgcagtgggctacgtggacgacacgcagttcgtgcggttcgacagcgacgcggcgactccgaggatgtagccgcaggcgccgtggttggagcaggagggaccggagtattgggaccggagcacaccgaacatcaggcccgcgcacagactgacaagagtgaacctgcccatgccgcgccgctactaccaccagagctaggccggtgaatgaccccggcctggggcgaaggtcacgacccctcctcatcccccacggacgccccgggtcccccccgcgagtctccggctccgagatccaccccgaggctgcgggacccgccagatcctcgacccgggagaggcccaggagcctttaccaggtttcattttccgtttaggccaaaatccccgcgggttggtcggggcgggggcggggctcggtgggcggggctgaccgcgggggcggggccagggtctaacaccctccagataatgtatggctgcgacttggggctggaagggcgcctcctccgcgggtatgaacagcacgccaacgatggcaaggattacatagcccggaactaggacctgcgctcctggaccgcggcggacatggcggctcagatcaccaagcgcaagtgggaggcagaagaatttgcagagcagatcagggcctacctggagggcacgtgcgtggagaggctcgcagacacctggagaacgggaaggagacgctgcagctcacgggtaccagggaacacaagacgtctccctgatcgcctgtagatctcctgggctggcttcccacaaagagagaaggaaaatgggaccaacactagaatgtcgtcctctctctggtcctgagggagaggaatcctcctgggtttccagatcctgtacaagagagtgactctgagggtctgccctgctctctgatacaattaagggatgaaatctctgaggaaatgaagggaagacaatccctggaatactgatgaggggttccctttgacactggcagcagccttgggccccgttacttttcctctcaggccttgctctctgctttacactcaatgtgtgtgggggtctgagtccagctcttctgagtccctcagcctccactcaggtcaggaccagaagtcactgttccctcctcagggactagaattttccacggataggagattatcccaggtacctgtgtccaggttggcgtctgggttctgtgctcccttccccaccccaggtgtcctgtccattctcaggatggccacatgcgtgctgctggagtgtctcatgagagatgcaaagtgcctgaattttctgactcttcctgttagacccccccccccaagacacatatgatccaccattccgtctctgactataaggccaccctgagatgctgggccctgggcttctaccctgtggagatcacactgacctggcagcaggatggagaggaccagactcaggacatggagcttgtagagaccaggcctgcaggggatggaaacttccagaagtgggcagctgtggtggtgccttctggagaggaacagagatacatgtgccatgtgcagcatgaggggttgcccaagcccctcaccctgagatggaagcagtcttctcagcccaccatccccatcgtgggtatcgttgctggcctggttctccttggagctgtagtcactggagctgtggtttctgctgtgatgtgcaggaagaactcagatagagtgagctactctgaagctgcaagcagcaaccatgcgcagggttctgatgtgtctctcacggcttgtaaagtgtgagacagctgccttctgtgggactgagaggcaagatttgttcacgccttccctttgtgacttcaaaaaccctgactctctttctgcaaaggcacctgaatgtgcctgtgttcctgtaggcataatatgaggaggtggggagaccaacccacccccatgtccaccatgaccctcttccctcatgctgacctgtgttccgtctccaataattaatcattcctgctccatagacgtgaggctgagatgtctccatctctgtctcaactttatgtgcactgagctgtaacttcttacttccttattaaaattagaatctgagtat

SEQ ID NO: 1335 - DNA, 2128 bp, Homo sapiens
acaattagtttcagttttgtttcttttccaggcacccagcaacggcggcctccaggcctcaggccccctcaccatcctagaggtcaagatcagctctggctagttctcacaggtctgacccaacaagtagcactgacatttttacgtttgctggatgtacacacggaagtggaggaggaggaggagaaggaggagggcagctccttagctcaagagcaagtggcccaaggcctcagaagactagaaggaagttcctggccattcagcatggtttcccacgggtcctcgccctccctcctggaggccctgagcagcgacttcctggcctgtaaaatctgcctggagcagctgcgggcacccaagacactgccctgcctgcatacctactgccaagactgcctggcacagctggcggatggcggccgcgtccgctgccccgagtgccgcgagacagtgcctgtgccgcccgagggtgtggcctccttcaagaccaacttcttcgtcaatgggctgctggacctggtgaaggcccgggcctgtggagacctgcgtgccgggaagccagcctgtgccctgtgtcccctggtgggtggcaccagcaccggggggccggccacggcccggtgcctggactgtgccgatgacttgtgccaggcctgtgccgacgggcaccgctgcacccgccagacccacacccaccgcgtggtggacctggtgggctacagggccgggtggtatgatgaggaggcccgggagcgccaagcggcccagtgtccccagcaccccggggaggcactgcgcttcctgtgccagccctgctcacagttgctgtgcagagagtgccgcctagacccccacctggaccacccctgcctgcctctggctgaagctgtgcgtgcccggaggccgggcctggagggactgctggccggtgtggacaataacctggtggagccggaggcagcgcggagggtggagaaggaggcgctagcccggctgcgggagcaggcggcccgggtggggactcaggtggaggaggcatgcttattgaggactgaatcctgcaaagctgagtgacagttgtcagagaagatgatggtccctgggcagacacccaggcagtagtagccacttggggctcctgtcttgcctcccagccctgtgtcctggctctggactcgcctgtgctagggagaccacgctctcagctgctgagcctcggagcttaccaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtagcggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgtt

SEQ ID NO: 1336 - DNA, 1565 bp, Homo sapiens
agtttacattgctgaggggaaccatacatcagagttacgttctgaaaaattggagactgactgtgagcatgtgcagcctccacagtggctccagactctgatgaatgcttgcagccaagcaagtgatttcagtgctcagagtgttgctatttcactagttatggacctggtgggactgacacagtctgtggccatggtcactggggaaaacatcaacagtgtagagcctgcacaacccttaagtccaaaccagggaagagtagctgtggttattagacctcccctcactcagggcaatctgaggtacatagctgagaagactgaatttttcaagcatgtagctttaacattgtgggaccagttgggagatgggacacctcagcatcaccagaagagtgtggaactattttatcaattacataacttagttccttcttctagcatctgtgaggatgttataagtcagcagttaacccataaagataagaaaataaggatggaagcacatgccaagtttgcagttctttggcatctaacgagagatctccatataaataaatcttcatcttttgtacgttcttttgacaggtcactgttcatcatgttagatagccttaacagtctcgatggttctactagctctgtgagacaagcctggctgaaccaagtcctacaaagacatgatattgcacgagttttggaaccattgctattgctcctgcttcatccaaaaactcagagggtttcagtacagcgtgtacaagcagaacgttattggaataagtctccctgttatccaggagaggagagtgacaagcatttcatgcaaatttttggatttggctctcgcattgccctctgaaaaccttcctcagcttcagatgtaccgatgggcctttattccagaagcctcagatgattcaggtttggaagtcagaaggcagggtatacatcaacgagaatttaaaccttacgtggtacgactagcaaaacttcttcggaaaagagcaaagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcctgaatcaagtttaaatattgttggctcatactgattatggtgcctaagagagctatatatatacacatgtaaagtccattg

SEQ ID NO: 1337 - DNA, 2677 bp, Homo sapiens
aatagtccttacatattctatatccatttacagtcccaaggagaatccaaatgcatttgatgccgcagcattcttccagtctgtggggaatttcctgggaatcttcgctggctcatttgcaatggggtctgcgtatgccatcatcacagcactgttgaccaaatttaccaagctgtgcgagttcccgatgctggaaaccggcctgtttttcctgctttcttggagtgccttcctgtctgccgaggctgccggcctaacagggatagttgctgttctcttctgtggagtcacacaagcacattatacctacaacaatctgtcttcggattccaaaataagaactaaacagttgtttgaatttatgaactttttggcggagaacgtcatcttctgttacatgggcctggcactgttcacgttccagaatcatatctttaatgctctttttatacttggagcctttctagcaatttttgttgccagagcctgcaacatatatcccctctccttcctcctgaatctaggccgaaaacagaagatcccctggaactttcagcacatgatgatgttttcaggtttgcgaggagcgatcgcatttgccttagctattcggaacacagaatctcagcccaaacaaatgatgtttaccactacgctgctcctcgtgttcttcactgtctgggtatttggaggaggaacaacccccatgttgacttggcttcagatcagagttggcgtggacctggatgaaaatctgaaggaggacccctcctcacaacaccaggaagcaaataacttggataaaaacatgacgaaagcagagagtgctcggctcttcagaatgtggtatagctttgaccacaagtatctgaaaccaattttaacccactctggtcctccgctgactacaacattacctgaatggtgtggtccgatttccaggctgcttaccagtcctcaagcctatggggaacagctaaaagaggatgatgtggaatgcattgtaaaccaggatgaactagccataaattaccaggagcaagcctcctcaccctgcagtcctcctgcaaggctaggtctggaccagaaagcttcaccccagacgccaggcaaggaaaacatttatgagggagacctcggcctgggaggctatgaactcaagcttgagcaaactttgggtcaatcccagttgaattaattggcatgaagagtacagatgtaatcacaagtaatgcaagactcactgaggaatacaagccaagctgatgaggcagtacaggggagaggctggaaaacatattaagagcataaattggagagaatcaaagccttgtcacatggatcctctggtgcctgaagaaatgagattttattatccctctctattatgcaaatgaatttagttttttgacagcagccattctgattactggattggctggggtggggatggaggtatcaggagtctagctgctggaggatgggacagctgtgctgggtcttcagggcatttctgctgcgaatgcggctctccaggcccttcacttctattctggattttattccctccattaaggagagtttaaaaataaaagaaagcttctgagagtaaacattttgctcctaagctgaagggaatgcacagctatttagtaagtgataagtttcttattttgaggacttgactcccatttgctctcagtgaccccagggcagagcccagagaagtgttccgtacccactgctgatggtttcccagagcccacactgagttgaagaacctattgttcttcttggcatccttcttatgctacttctcccatcgctcaaaggggttgcctatggctgggtgtgccctgccctaaatgcagcaccactttcaagcttagtaggaccattccaagaaaaccaggtttcttctccccataccacgttgtgcctgaagaacaagccttcccgtccttgcctgcatgtgagtcacttcttggctgtgcagcaggtccccccctccccgcgatatgctggagggtaggattctgcagcctgtgttgctctctacctggcagcagactgtgcaggagccccaacctgtcctccaattccagcattcacagctgatgagcagtgcaggagcagggcgagaggaacagagccaatgatgtgtgggttacactgaggagccaaggacagggcctcaggtctcccccttacaaggcgtggctcatggcctgcattccagagaccaacatgatagcttttaattcagctgcatgacctgtgccttttaagccataaagatacctcaagcctagcacctcttgaaatccagatgttcatattagactcgaaaaaataggctccaggcctaggtgcccaggctatgatgagtctgcttttgaaggaggtagggaatgacatcttccttggacccaaagcttaaaagtaatgtatgctttgctgaccactgtttgttaggccttaaacaacattcactgtggtggtatcaggcacactgctatgtgcatcaattatttttttgctttccaaacagaatctctggggcacaagttttacactcaagctaagtataactttgtcatttcaggtaaatatgacaagtggtggagcatgaagttttctaatttgacttaatcctaataaatttttgttacaaagt

SEQ ID NO: 1338 - DNA, 2375 bp, Homo sapiens
ggtgatggagtacattttgaaccaagtctgtgtaactctgaaaccagagctttttgataccacccaggcttgggactctctgtgacaagtctggtttaaactgctctctgctttattcccacttctctgaagcttcctcatccttcatacgactgaccctggagctgaaggccaggttttgcagtggtctgagtcactcagccctaaaccaggtgtgttccaatttcctctactatatgtgcctcaaccttctctcagctccagagaagacaggaccaccttccaaagaagaactctctgcagtgcctgagctcctgcagcatgggctgccccagataagcagcaggagccctgaaagccttgccttcctgtctgatcgccagtacatggagggagctgctcgccagagacagtactgcatcctgctcctcttctacttggcctacatccatgaagacaggtcagtgcacagaggccgggcgcggtggcttactcctgtaatcccagctctttgggaggccgagatgggcagatcacgaggtcaggagatcgagaccatcatggctaacaaggaccagggcgagcgccccccactggtggtcttcaaagcctccatctatctgcttgcaatctgccaggacaaagacaatacactacgtgagactatggtcagtgcaatcagaaaattcctagaaggcatcccagacctgcagctagtctatactcaccatccgctcctgctcaggttctttctgttgtatccagagctcatgagtaggtatgggcaccgtgtcctggaactttggttcttctgggaagagagcagctatgaggaactggatgatgtcacctctgctgggcagcccgcccttcctgccagcttagtagtcctgttctagttgctcagaagcatccccagcatcctgctcatcttgctggacctcatctattccagcccagtggacacagctcacaaggtactgattagcctgaggaccttcctgaggaggaatgaggatatccaagtgggcggtcttatccgaggccacttcctgctgatcctgcagcgtctgctagtggagcatggggcatccccatcaggagcctcggggaacctaccattgctgctgagcctcctctccctgatgcagctcaggaatgtgtcagagcaagaactggacagcgtggccatgaagctccttcaccaagtaagcaagctgtgtgggaagtgcagccccactgacgtggacatcctgcagccctccttcaacttcctgtattggagccttcatcagaccacacccagcagtcagaaaagagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcaggttcaccagacactctctgtggaaatggaccaagtattgaaggctctcagctttccaaagaaaaaggctgcactactctcagctgccatcttatgcttcctgcggacagccctgcgacaaagcttttcctctgccctggtagccctggtgccctcaggggcccagccactgccagccaccaaggacactgtcctagctccactgcgaatgtcgcaagtccggtccctggtcattgggctgcagaacctcctggtgcagaaggaccctctattgtcccaggcctgtgttggctgcctggaggccttgcttgactacctggatgcccggagcccagacattgctctccacgtggcctcccagccttggaatcggtttttgctgtttaccctcttggatgctggagagaattccttcctcagacctgagattttgaggctcatgaccctgtttatgcggtaccggagtagcagtgtcctctctcatgaagaggtgggtgatgttctgcaaggtgtggctttggctgacctgtctaccctctcgaacaccacactccaggccctgcatggcttcttccagcagctccagagcatgggacacctggctgaccacagcatggcccagaccctgcaggcctccttggagggccttccccctagcacctcctcaggccagccacccctgcaggacatgctctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcacat

SEQ ID NO: 1339 - DNA, 2040 bp, Homo sapiens
atcatcttgggacgcggggcaaaccagtgtggacctgatttcatgtgctgaattgttttgtgggggaagtgtcagaatggaggcatgaaggattctgtggcatccagaccttctcaggtcattcccaatatgccaagcaagagaccgaggccaggaaaattcatcaccctcgttgaagcagtgggatgtaacgactaagggcttatgcccttgagccagatggcccagccctttaccccagcccgctgccacttgggcgcatggctggcacattgcttaacctctccatgcttccattttctcatctgtaaaatgggagtgcaaactgcctcaggattattgagaaggttaagctagtgattatgtaacctgcttagaacaatgcctggcacactgtttagtgtatgataaatttattaatattaacatcatctttatttccaggcattattacttaagccgtggcatagcttttcccatttgaaacaggctagtgttttgctttgttttgttttgttctaatagtgagaaccgtttagaaagtctaaagtcctgtgaaaataccagtggggtcggttaactcgggttagcttggtgtgcttctctgacctggccctggctcgggagtacacgttttctgaatcttacaggacctgcctgatgtgcaagagctcatcactcaagtgcggtcagagaagtgctccctgcaggccgcagccatccttggtgagccccctgcctggcctttgtatccccagacttcccttcctgccactccccttctctgtcacaccccatactactgttttaaggttgaaagggttgtcttggttcatctgtaagatgttcctggcctttacttgtgccagctgggcatcagattgtgtagaagcatttcgagtgcactgttacactggcccttctccctgttactgtcctcatgcaactgtgctggcttcactgggccgacggcattggatctgggattgatctgtttatctccaccacttctcagcaggagacaggcctggcttccccacatgctggctccttttgcttttgggatgtaggggccacctgtgtgataggcctcatttgtgattagtgtgctattataaatccttgttcttactgaatccctgtgaaactttcagatgcaaacgacgctcatcaaacagagacctcctcctcccaagtcaaggacaataagcctctggttgaacggtttgagacattctgcctggacccttcccttgtcaccaagcaagccaaccttgtgcacttcccaccaggcttccagcccattccctgcaagcctttgttctttgacctggccctcaaccatgtggctttcccaccccttgaggacaagttggaacagaagaccaagagtggcctcactggatacatcaagggcatctttggattcaggagctaaccaggctcttcctcgggggcgggggagattctgactcttaatctgtattgtgagaaaatcccagcaagttccatgatattaaatccaggtctgcattggcccggggcaagagtttaacatcttcggccctgcattcctacatcttgtgtctgtatacgttcttaagcagcgtgtcaggagagcaccctgttgtcttctggtaaatgtgtgcagggtcatcctgtctcctgtacctcctgggaaaggggccgctgctgtctggtgccctgtgagctgtgattgattgcctttggtcagtaatgcgttcaggagtccacaccaggcacagatggggccttgaaacgctttgtcatgcttcttcagtaccatggatttgaaatgaactcatccttgctgtgagcatccaggagcccttgagaagtttatctatgactatgaaactggcaacgtcaccccagaattacggtcagccttattccccttcacctcccagtgaacgctaagaagtttcagacaagcagagagctctatttttagaagaaatatgttacactcagaaatgatgaaaccaaatcttatattaaaaggcaaagatgacggag

SEQ ID NO: 1340 - DNA, 2059 bp, Homo sapiens
gtttccagtatatacatcaaatcactgaggtaggacaaaagattgctacattcctattattttatggttattataagtgtaccaggactctaaaagaaacttgtttgtataatgctattctatccaaggtatgtagcccaggaaataaccaacttgatgcgtgttatgacccattttaagcctcccatgatcacagtttttaaaatacaattaaggactggtccttttctaggtgacacaagaaaggtaatagctagaacagaagaaagaggggtccccaaaaatgtaaccttaaaatttgacacttgtgccactattgatagtaagcagcatggatgaggatgtggttctctaaattggaaaaaaaagttacacagtaaaaaaaaataagtatatctgtcaagaatcatatttatgtgagatgtgtcaatactggtcttgcgttatttcggctacttgaaaataagttaaaaaagatagtgtttggttccaaaaaggaaaagtcagcctctcctgcatgagtgggagctgcaaccttttagaattgataatcacaaacccctcagacccaaagtggaataaagaaaaatatgtaacattaggcattgatggaaaaggactagatcctagtgtaagcatcctaataaaaggagaggttcaaaaacgttctccagaaccagtatttcagactttctatgatgaactaaatgtgccagtacctgagattccaggaaaaactaaaaatttgtttttgcaattagccaaacatgtagcccagtctctacaagtcgcctatgtcatgtttgtggaggaaccgtaacaggagatcaatggccatgggaagcccgagaattggttcctatagacccggttcctgatgaattcccagcccaaaagaaccaccctgacaaattttgggttctgaaagtcttattattggacagtattgcatagctagagaaggaaaaggatttactcatcctgtagggcagcttagttgtcttgggcaaaagctgtataatggtaccacaaaaacagttacatggtggagttccaattacacagaaaaaaatccattcagtaaatttccaaagttgcagactgtttgggcccacccagaattgcactgggactggacggcccccactgggttatactggatatgtggacacagagcttatgctaagctgcctgatcagtggacaggtagctgtgtaattggcaccattaagccatctttcttcttagtgcccataaaaacaggtaaacttctgggcttcccagtctgtgcttcctgtgaaaaatgaagcatagccataggtgattggaaagacgatgaatggccccctgaaaaaatcttacaatactatggacctgccacttgggcacaagatgtctcatggggatatcgaacccccatctacatgctcaaccgaatcatatggttacaagcagttttagaaattattactaataaaaccactcaagccttgactgttcttgcctggcaagagactctgatgagaaatgctatctatcaaaatagactagctcttgattacttgctagcagctgaaggaggagtttgtgaaaaatttgaccttactaattattgtctacacatagatgatcaggggcaagtagttgaggatatagttaaagatataacaaaactggcacatgcacctgtgcaagtgtggcacggactcaatctgggagccatgtttggaaattggttcccagcaataggtggatttaaaactcttataataagagtaataatagtaataggaacctgcttactgctcccttgtctgatacctgtaattctccaaatgataaaaaacttcgtcgcttaaccttagttcaccaaaatgcttcagcacaagcatactatataaatcactatcaatctattgcacgaaaatacataagtagcaaaaataagagtgagaactcccactgataaaaagtgagagtctcaaagaggggaaatgagggaagagagagaccctctcatattgttttatattgttttatactcagtacctcttttaag

SEQ ID NO: 1341 - DNA, 2817 bp, Homo sapiens
tatttctaggaaaacaaaattcccttctcatcagaatgctgtctactttaattaatatgaagtattattcaagatagaaacaacaaaatttctatgcttagcatgcattgaaaccttattattacaaaacagcatctgtttcttagagaattgatgatatccaggagtcagaaattcacgttacagcctcggtatttaactgtgaggtgattttgactaaaccattggacttctgaacttttcttggttaataatatatcaaaacagagtttaaaaatagcccctctcattatatgtatttagtcaacaattatggagtccttaaaaaatgcagatgtcaccttttcatgttggttactagagatcacatcttaactctctttaaggatgagttttacttacagctaactagaccaacaagagaaatgaatgtgaagttacacttactctttgccaacctaccactttatcgtattcttttaaagactttttttggctggaaaagtttatgtgagctcttgaggttagaaagcttaagtcatcttggtaggcaggatatttcttctgataacatatattcttttctgagaatgcattttgggaaatgtagattttcactgtaaatccttcattgtttgaagaactctgtgccagtattacatttcaggcaagactaattttagccaggttcattaaagtattccctgtgttctctccagtaatttcagctggttcctttttatgccctcttgacacagtcacattctacagtgtacagaaaataacctgctgtctgtagaagtggtgaatggtttcatgattcccttctttttagtgtgggtgagttttcttcactctttttctgttgcctgcatccttggccatcatgaatgttttgctttctctcttgcagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagccggcctgcaatcccgaaccaatggatacctgatccatgctcttatgggcttgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactcttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttattttttattttattttttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttaagcaccagtagatttgtatt

SEQ ID NO: 1342 - DNA, 2771 bp, Homo sapiens
acattctaggaccttccttggatgaggcttggatgagagatgggatggactagatgactggaatagcttaagagctagagagacaggcttcccaatagatctggtttggagagggagagggaagatggttaggtcagagctggggccagaaactgagactccaaactccccacttagtggctgttttccttgccccatcactgtgttcccgcccattttgtagagaggattgaaaatagaggcccagaaggagcaaggggattggctgaaggaatgtgagtcagtgacaggtaggggcacactcagatgcccctcagggcctggagccattgtggggggcagtccacatgtgcacacacacactcagagaaggagcacagatgagtggcggatgggcttggtgctatctccagatcatatatggacttaggagctgctgcccagcaagccagcttggagggagaggggcccagcccagccctgatccagttggaaagtgtgactcagccgtgctgttgctcaagttgcctggtgtttggcctgtcactggggcagcctgagccctgagccctgagccccagtgtaaacaatggctttataaggtctccagggaagggagtggggcgggagggagcaccaggttggagagggcggtcgggatccccaggacgatagccacagctggaagaagcttcagagagaggctgcctttgcatcatggtacagctcgggaaacaagcccagtctgggatagggatgaccctaggggcacgtggcacatcagcagcagacccagaaccctctcactcatcctaaattcttgtaaggtctcaaatgagatagagaataactgtcctgttctaaagagggggaaacagtcatagaaaagggccttatctagcacccacaactggttagggatacagtctggactaaaacagaggtgttcggtgttccgcctcccaggtttcttctctgaaggagtccaggtgagctgggggtaggcccagccctaccacagttctgagtttgtccataagggcacgagatgggaggtggtcttgggttctcaggtgtcttgagaataaggagcaattgttgccattatgccttccctgccataggaaactcattcagcaacattgaatgcttgctatgtcccaggtatggcagataggagggatcaaggcagaagaggtcttgctctgggggttgagggacaggggaaaaggagccagagagcagactccagcttcagagctctgggagctgtcagttgcttaataggcacaacccactcactccagagtggggaaaaggctttgccaacacccagaactgggggcctgggtcccatgcggcctagcctgcacttactaagccgtggggcttgaaacaaatggctcctctgctctgtgactcagtttccttatctgtgaagggcagctagcattctgaaggatggccagaagggtggtccccccgagcatggcatagatggtccattggtattggctgggatcctcatctgcctcctctgctctacccaaggcaggtgataagggttagagaacccctctgctgcccacacgttccctggcctccatctccagcagcagggttatccccaccccctgtcaaagaataggggtccctgggcctctcaacaggaagtaccagatcaggcagctagcagacaatcatcggtggaccacagggccactagagtgagacctatccatagataaagattggccagtgatgaagcccatctgggtgcaaaggccgagctgagaggcttctaccaactggagtgtgccagtgagggtgagcagaaggtggtctccagggagaacatgggcagggtttggagccagcacctccccagggttggaggaagcagacccaggacctgcctgactgggatggggctctcttctgccatctccgcctccacctgcctggctctgctcccccgccccgagagatgcctccaggcttgggtagatgaagccaggggcttcctgccttcctggaaggcttttccctgtctggagtttatgaaagaccagcaggcaatgcggcaataaaaaagaccttggggtagaggggcgccacgagaggcgggtctggcgctgacatccaaccccgtgccccctccctgcaggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgatcctgactcctctctgcgtctcctgggggtggggagggggtttgaaccgaaggcagctcctcaaggtctccaactccagcagggatcctcagaggttcttcttccgacctcccaccccacccgcccagtagcaaaccatggcagactcaccacctattctgagttccagggctgctgtagggcagggtgggcttcctcccagacttgccttaccctgggctgatctttgctcctggtatgcattaatggactccactgaatcctgaaaaaaaaattaaacttccttcttacttgc

SEQ ID NO: 1343 - DNA, 2962 bp, Homo sapiens
atcttcactttttccgttgctagcagtggaagggtcacagaccaaacactaaggcctgagcggtgacaatcgaggcgagatgatggtcaacagggaatgcctcgtgggagaaaaaagacaattttattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagtctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatctagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacgtctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaactt

SEQ ID NO: 1344 - DNA, 2374 bp, Homo sapiens
taaccgttgttggagacagctgcctgggcatgcagcccggctgcagctacagaagccctgccccagggctagctcagctaggcagaacatcgggccacctgacaactgctgtttgcagtagctccacaggccctcagcccagcccagctccctgtgcacgtgtgaggctgagacaggcaagagggcacctcactgtagggaccttggagctggcagagcatggtcttgggattcacatgcaaaatgcaacttctcacagctcctctcagcaccctgcagccccgttgatccaggtcacatccacagactgggctctgcctgctccagaagcccttggcccctaagtacaggctgcaacaggaccgaggatcccagcccacagttagaagcagcctgagctgctggaaagatgccccccaaaaatggaagattgagtttttatctcctcaagcaattctcaacgtggctcattccagataacctgtcctctgtgctccttgactcctgtgaatatagtcagggcagctctgcctggtgtgggccaagatttcagatctgcaaacagcactggtgccagaggaatgacctgcccactctcagcagagcccttttctttcactatacatgccgccctccatcctggcccacctgttagtctagtctagaatcaccagggtctcccgggaggaagctgcgcaggtctaacaccactctcgtggccagagcggctctggagctctgacccctctcatgggaagagttgtatgcgctggctgctctgtggctgaggagctgccgcctgtgtgtgaaggaaccctgggttgccccccactaattgcccgcaggctccttcacataggctgggggcacatctcttgtcctctaagagtgaactccactcctgaggcatccagaagctcctaagtctccaccagccgggtgaagccgtgtgtggtcaaaagcaagtcacaagagggtttcccctgtggctgtgaaatgcactgtgcactgtcaacagtggatcgctgagatgttccagggccaagccaggaggttcagagtgcacaggcatgcagtgagtgaagctagcagtactacagtagatacccaccttaccacctctggaaacccctccacctggcagcaggtgcctcatgtgagggagagctccagctgaaataggcgggttggcccagcgctttggacaccaacacgcccacaggctcaggcggatctgtgactgtagatctgccaatgaacaaagagcctacccatgagagctggccccagactcaccctcagtatccttaactgtaaaatgggaccagtaagggatgtgaatccagggccactggctctaaacccaggttttcactagaccaggcaagctgcccatctcctccggggtcccctgggctacccacatgccatgctgaccaggagcagcctcaggcacaccacagagcagtgagggccagtcttgccagtcctgatttcacatttttaagtccagagcacctacctccaaaaattgccacgacatttatttgaagtggaaatgtgtgtggattcaaacacatttggcttggaaacttggatgatagcccagagttgaagagcccacagctccctgcgttctggcctctggggtggtaccgctggtgtgtgttagagggtggattcctgggcggtggcccctggtgtgaaggggtaactcttctgtgtgggtggatagaggtcagtgccttcccagagaacctgcagccatcccctggggctgacatcaagagcctgggctatggctcaggcactgtgctagtcaaaggtatcatggaaaaagaaaatcaggagcttacactgtacttcgggggcttaatgcacaccacaaaacactattctgtttgctggctactgccttctctaaaagcacatagcacatccttctgcaggtgccagctctctgcccagttgtctgtcccccatcccatcttctgggcactgggctttcccacactggcgtacaagcagacacggggctcaacagacaccgacccaacacaaggcaagctgcagcacagagggaggtggcctgtaaggtggggcaggtcctgcagcccccgtggcatcccagttgctgagtgcttatcttctcttctccaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagttt

SEQ ID NO: 1345 - DNA, 2873 bp, Homo sapiens
ctgtggtcgtcgttactaatcacgggggaccccatctgtgcagcacttcatgtgtaaaagcatttccctgcccttattcagtgtccgtcatggaaaatgacttttacccttcaagtgtttttttgttttgttttgttttggttttgtttttttaattccttaaagcacctagcagaatactgtgaacacagtgcgtttcatttaaactgactttcctgtaggttgaaaaaataagtgagatacttagtgcccgtgaatactcaggaaaaactcaccaagacggtcatcaaaagttgataaaaaagttaagtgaactcaaaataactgtgttcttgtagaatgtttacaaagctgttagggaccctcagaatgggaatttgggggatgaattgtatgactaacttgtcactggaaaaccaaaaaaactcagaagaaagccgggtgtgttcagtattccccatattgcctttaaagcaaacacagcccaactgttgaaaccacggagcaactttggctagtaagagattcccaaagcccagcacttctgtgcacacgcacaggtgcgctcacacgccacacacacagatggaagttaacattttgataacgtggatgatggaggtttccattttttttcttggctaatacttgatatttttaaaagtgcgagttatctttcttcttgttgcctgcctgagttgaccttgagtgatggctaggaagtcagcatttcttcatgagtagtttccattttcttcatgttcgtcttaggaaaaaatcatttttaagcttacccaggagctgcatgtttaatttactatggcatctccctgaagctcaaaacctgcaaattgttttagctaaataccataattataggtttagcagtgaaaccaaggacttggtgggaatttttcatttgcttttgtttaaaagaactaaaaccagattgttcagggtaagaagaaacacaacaggaattttatttttactctcataaaaatgccagccatagtttgctgggggtaggagtctcggagacgagagggaaggaggagtcctgctgatttttctcccttttctaacccctttccatcccatctctccccttcctgtcccatctctccccttcctattccttttctccccttcccgttcacgggaatgccactttctcacagggcctcccccaccagaatcctcccatgttagtgagcacaggcggtgtagacggcctgcagcaggtggtgtggacggcctgcaggtacactcgttgcccagggtatctggtgtctctctggcttagctgtcgcgcctgtgctgcccatgactgaccaggcttcaccagttcacagcggatccatgctactttgccttctctgaagggaggaaaaagaacttgaattagaagttttccgtcagcgtacaggaggtcaggtcctcagcagtctccctcccaggaattggagcccggggtgcctgttgcccatgtctcctccgagtctgaacacaagcagtggctcaggccagctgatgctttcctcactgagctccctctctgcacatgaagcggaagatggggcgtgccatcctgaggtcgggctgctttccgccatccacccaagccaggtccctactgccccgcactgtgcaccttgcctggttaggacctctttgctctcccacctccagtctctccagacccttcgtccagcttcaattccacatcccccagcgagcctttctcaaacacctgggtgcacgattcgtagtttacaagtattgtggaatcgtgcctttcaacttgtattccttggagccctagagtttctgcggtgtcccaggagctgtcacagtggggagagagctgggtggaagggattctgaccccccactcaccgtccctgcctcaagagccccagtcaccccgagtatgtcacaggccaccttctctccatttctaggagagaaaagagtctaaactttcattccatggatgacaaaacagaggtcctcagaggtcagcctattctccaaagacacatatcaaactcatggcagcaccggacctagaaccttggtcttctaatcaccgccattgctctccccttcaagccttctctcctcctctgaacttggaggagacacagcaggggaaggaatccttggctgggaggaggactccaggctgtgggccaggctggatgaccctaggcaggtccctcccccgctggaccttgggaaatcttttggagacagacagaagctcccttaggtctcttccttccactctgggatgctatgaagaggagcctttagctgtctcctctaggcccttcagggccgtgctggctcatggagcaatcatgtgtggctctttaattaaaattacattttagaaaagcacttcctcaatcacaccagtccctttaagtgctcagcagccacatgtggctttagtttctgtgtcaacagcactgtggtagaggaacccacctgttaccagtacacctgccccagccccttctcagcacagaggtgtgctttagcgtccagaaggaactggccccagtaagtctgggataattgcctattcgctaaatgaaaatgagacacttcctgtccggggtaggcataaaagaaacagaaataaaagccaattaaataggaatgacaagatgatagtgcagattcaaaagaaataggtatgcacaagtgacttaaagcagagtcctcctctagcccaggacactcttcagtctggctgcagctggctagcttcttttttttttttttttaattctaagaaatagattgaaatgaaacgatggaaaagaagcaggacttctccctgtgggtgtctgtgatgtcct

SEQ ID NO: 1346 - DNA, 3231 bp, Homo sapiens
cactggacttcctcgttgacttcgttcagggcccagttcagcgctccctgaactgtctgaggagctggagttgctccctccgcaggcacgtttctgtctgcaggtttatcctgttcagtaggtcagggtttgttactgacaaccatgacctgctgtgagcccttctgcgagtgtggagctggggggcaagaagggcagccttagctgtgccaacgcttcgtcctgtcagggcatttgcacgccaaaggcaaagaagaaaaaatgtccaaatcattaaagaactacattactattaaggactttctgaagaccttttcccccgatgtcttccggttcttctgcctgcggagcagctaccgctcaggttttctgagacgtggtctgaacctctcccctcggtggaactgcagtgcatcggcccaggggacctgcgctcacgggcgcacgagcttgagaaagaagtgtcgccagcctcgtgctcgcctggcctcgtgcagcatctgcgtgtggtgtgcacttacgcgtgatgaaagcagcccagccgtgccgtgagaggaagagtcggggaggcgaatgggctggagaaactgtttccgcctggctccgtgttgctggaaacgggcagaggcggcggagatgaatcccgtgtgcgagcgcagagctctctccccggctcgtgcttgctcccctcgtggctgggggctgtggtcctttcaaagctgttccctgcagatcccttcccaggggcactttgccctcggaagccccgcctcccttctcgcagattgtggcaggattaggggcagcatcttgtatgactgtcctaattgtgtgcagttctttttgagctttgaatacgaagtttggtctgaaaagaggctttctcaagcctgggcagctctttcaggaacacattcccagtgggaattttgggtgggattcaggaggcaccgatctgccggtgagggatttctaggaacacaaggttagtcaggacgtggatccccacagtggacacgactgccccaccccgccgaggtcggaggtggccatgaggagctgggccgtcgcttgctgtctgagcttccatccacgaatggtgtgggagttcgggatcttcccagacattctttcttcacctttgggaagatggagggggacggtggtggcatcccttgcagtctgtgctgcgctgacactttggagaagcgtctcccatctgtagagcagaatcctctttggagaaatgcagctgtccttgaccttgaggcagaaggcgtctccatcctgggcatctgtctgcccctccccatctggatgcctcatcttgctgtgtcattaatgccatcgactacagtgacagcgccatgctccaagctcagcagctgctcctggggctgggctctttcctggaggacgcacgtgcctacatgaaggggcagctggcctgcggctccgtcagggaagcgatgctgtgggagaggtaagaggcccgcctagcacccggcgtggcacccctcctgtggcctgctgggtgctgctggtgggctcttgaaggggaagaggggcccccaggagacagggcgctggacaggaggtttggggtcagggactgcccagagaggccccaggagacagggtgctgggcaggaggtgcaggtgtggggtcaggggctccccagaggccacaggggactgggagctggacaggaggtgtggggtcaggggctccccagaggccacaggacactgggtgctggacaggaggtgtggggtcaggggctcccgagacatcccagggagacggcgctggcaggaagtgtgcctggggccctcgggctctgagccccctgctcagagtggctttggactcgggttccctgtgcgaggagcggagctgctcatccctcccagtcctgactgtgaggagccaaaatctataaaacacacaggcctgggcccacagcatcgcctccactccccacccacgggtgtcctgggcagcgctgcacattcatcccggcgtgcagagtcttccggatggtcttggtgataacccacccctgccacttcagcagggtaggcagccagtggccacgggaggctgagatccgggagccccgggctgggcctccccagcctctctttgtgagtggtcagccgtgccgtctctcccccaccgagtcttccttgccactcccctcaatatctattgatttttaaaaccatcatgaaaatgcccacgtgtgtcttgtattttaagtgtcacaggtgacctctgctctgggactttttcttggggtaacatgacagtttgcagttgatgttacataattttctgctactcaggaactcaagtctttgggaatatgacctagagaaagtccccagattagagcccccagcgtctctccctggggaaggactggtgtgggggccgcctggggagagtggagctccctctgctgtgactgttctctcctcttccctcaggctctccagcaccaagagggccgtgaaggcggccttggcagatgactttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagttggcaaactctcgtgcgcagaaccagagatgagtccatctcagcaacagaatgtcgccagctctgcacacacgtttatgttcaaagactctcagaatgtgcagaagtcacaggcacatacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaacc

SEQ ID NO: 1347 - DNA, 2356 bp, Homo sapiens
atccacagtaggcattttaataggacagataatactgaaggggtaagcaaaccagatggatttcaagaacatgttacagctactcacaaaacttacagatgtaatgatttggtagagttggcagtaggcttgagtcatggagatcacagcagcatgaagttagtagaagaagcagtacagctgcaatatcagaatgcttgtgtgcaacaaggcaactgtacaaaaccatttatgtttgacatttcaagaattttcacttgctgtctaccaggcttacctgaaacttcttcttgtgtttgtccaggatatatcactgttgtgtcagtatctaataatcctgtgatcaaggaattgcagaatcagcctgtgcgaatagttctcattgagggtgacctcacagagaattaccgccacctgggatttaataagtctgcaaatattaaaacagtattagatagcatgcggcttcaagaagacagctcagaagaactgtgggcaaatcacgtgttacaggtgttaatccagttcaaggtgaaccttgtcctggtacaaggaaatgtgtccgaacgcttaattgaaaaatgtataaacagtaagcggttggtaatcggctcagtgaatggcagtgtgatgcaggcttttgcagaggctgcaggagcagtacaggtggcctacattacacaagtgaatgaagattgtgtgggcgacggggtctgcgtgaccttctggagaagcagccctttggatgttgtagataggaacaacagaatcgcaatcttattaaaaacagaaggaattaatttggttacggccgtgctcactaacccagttactgcacagatgcaaatcaaagaagataggttctggacatgtgcctatcgtttgtattatgctctaaaagaggaaaaggtcttccttggaggtggtgcagttgaatttttgtgtcttagctgtcttcatattcttgcagagcaatctctgaaaaaagaaaaccatgcctgctcagggtggctgcataatacttcctcttggctggcttcatctctggcaatatacagaccaactgtgcttaaattcctggcaaatggatggcagagatacctttcaactctcctatataacactgccaattactcatcagaatttgaagccagcacatacattcaacatcatctgcaaaatgccacagactctggctctccttcatcttacatcttgaatgaatatagtaaactaaatagtagaatttttaattcagacatttcaaataaactggagcagattccgagagtttatgacgttgttacaccaaagattgaggcgtggcgccgagcattggatttagtattgttagtacttcagacagacagtgaaataattactggacatggacacacacagataaattcacaggaattaacgggctttctatttttgtagtgttactggctaagtctttggaaaataatttttcataatatgtcatgctaataataaatatattgatagccaagtcatggtgcctaaaatgccagctattgccaagaagaaaatagttgatgtctgtcaataactgtgcatggtctgagattttaccctacttataagctaacaagttagcctgttactgtttcgtgggatgctacagaatgcataagacacctgggtcagaaacaaaggacttatcgctcacagcaaaagctgtagccagagcttcatgttggttttattcagttcctcatttttctagttcccacaggaggaacacaaagggcccatgatgaaagcctgcacacagtgggttatgttgtaagcttgggttattaactgcttttatagtaagcaaaaaatcctggtctttgtccaaagggagttattaccccatacttgaagatagcttagtgtaaacacaagcctaggacatggactaggtaaagacaaagtccttgcattcttgacatacccagtaagtatgcagggacactcagagcccatagtggatagtctcttccaacagtctgctcctcagcctgagatgttcttggccaaacttgaattttcacatgagtatgccactctatcagctactctgattaacctgacagtcgggttgtttagtcagtaccaaatttgttcatttggtctcatatagcaattaatgcaggctattatcagacacagcagcaggatgaagccaacctgcagtattaacctcagtcccgtcccccaaggtcttgactcaatcaactctaagttccaagggaggaccaataggtctttttattaggcagccagaatgtagtgaaggacaatttattatactttatgacccaataaagggagctttgactgacgt

SEQ ID NO: 1348 - DNA, 2245 bp, Homo sapiens
agcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctctcctcaagctgcagtccaccggcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagagaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactat

SEQ ID NO: 1349 - DNA, 2774 bp, Homo sapiens
taaatgtgggaagcttcacaaaaaggggcgcaaactctgtgtttatgctttcaaaggagaaaccatcaaggatgcactgtgcaaggatggcagatttctttcctttctggagaatgatgattggaaactcattgaaaacaatgacaccattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaattttttttttttttttgagactgagtctcactctgtcgcctgggctggagtacagtggtgcgatctcagctcactgcaacttccacctcccaggttcaagcgattcttatgcctcagtctcctgagcagctgggattacaggcaaacgccaccacacccagctaaatttttttttttttttttttgtatttttagtagagacagggtttcaccatgttggtcaggcgggtctcgaactcctgacctcgtgatccacctgcctcggccttccaaagtgctgggattacaagtttgagccactgcacctggctaacttgccctattttaaagtcaagcaatgggaagaataacaagattatatagtaatcagtttcatgacactaaaagtcatatagtcatagggttttttcatctttcatatctttgcctaaattcatttgctacagtgcaggaaccaaaacttgttcatctcatgattccctacatctgacataaggaaagtaagtgctcagaaaaatgtgcaggtcaataagttgcaaaagttggggctgcaattaatgctaacataagagctaaatgcttgattagaaatgatctcaaaaccttttagaatttccaaaatcttcatattactgaaactgtcggaatatatgggtcttgaaattcagaagatgatagtcactcttcccatatttataggctattaaggcaagggatatcttaaacaccatattactttatttagatttctactactccaattattaatgttatgtatttctcattgttttacttcttcatggtattatgaagactatatagatgattcaaccaagcctgcaaatctccctcttgtggaattccactggacccaatctgttttccatttccattgcaatactactaaagccatacaatatcaagcaccctccctctaggtccagggactatcacagaagaagcaggcatgtaagattttaaggactggtttcgaggggtcgagtgtaggaaaacagcctgttgcattgtaagagtgatgtcatcttgaagagcagctggcatgatgactgctgtttgactcctgcataccaagatattctgcagcaatgtctttaaacagtgccggtagtacagataacccctcataaagatgcttatctaacctccccagtgttcaggtgtttcacaagaaagtctgagatatgactagctacacgttttgccaaaaatgcttgttatataaagggtacttttgggagggtgagtgccgccatttagtggctgctagaaacattgcttctgtttgtaagttcctattaaatgtttctttctgag

SEQ ID NO: 1350 - DNA, 2219 bp, Homo sapiens
tctctccacaaactgcccaggagtgagtagctgctttcggtccgccggacacaccggacagatagacgtgcggacggcccaccaccccagccctccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 1351 - DNA, 2052 bp, Homo sapiens
atccattgcatttgcagatatgcctcaggattattttattagtacaatttttttttctttttgagacagtctcactctgtcacccaggctggagtgcagtggtgcaatctcggcacactgcggcctccacctcccgggttcaagcgattgtcctgccttattccctggtgtatctgggattaccggtgtgcaccaccacacccggctaatattttgtgtttttagtggagatggggtttcgccatgttggccgggctggtctcgaactgctggtctcaagtgatccacctgcctcagcctcccaaagtggtgggattataggcatgagccaccgtgcccagcctagcgtcatgtatttatactgttatttccacctcctaaaagtcaacaaggacacttagctcaagaaggctgatgttgagagagaacgcttatcagaacagggatctctgaggaaaaagggagcttaaatgtgtgtccctggaatttcttctagcccttcctttccttggtgacatggccactgctatgggcgggaattagagaagagccctgaccagtggtgttgatgtctttgccaagtatactgtcaggtcagtgtcataaattgatgatatatatagagagacttcatttaatagaaaataatattttaaggaccaccttgctattttacttctctaataatgttttgaatattttgataaatacctttagcaacatagtggttctcatctcagccctctctgtccttgaaagaatgttatttataacagggtggtttctggactgcccttctggagtaaaacttgggcattctaaccatatgcttgctggaaaccataataatgtaaaaagtcgtcattgggttttcaattgcaattacattgatataattttgtatataaaacagtctgttactgggagcagcattgttcatgtaagaaagatgttcgcttcatataatacatggaaacaaagttatattttcaatgttagccattactgtgacactccaaaaaaggctggtgatggggagaaagaagagctttaaaaaaacctacagacaattcacttgcctctcgggcttttctgctttgcctgccttgaccgaattagagtatctgcatttctgcactaagctggttgaggtttgctaagtcaatggtaatgttttacagagcttggctgttagccagcatttgtggaaaacgaccaatgtctgtcatagctagtgctataatttattcagttggcatattgtttatggagacagtgagataaggggattaggatccagagagactattaaaatatgtgagtccatctgttgtgatctgaggtttcattagagaaaacctgtctgctagtacaacaaatggagacttagtaaggatgtttttatataaaggattataaatcagcagaggtaaatacattaatcttggccaaacaggtcatgtccttttgcgttttcctgatggcaggttctgccccctgccgcccgggcactgttggtcatagcgtgaccttggcatcagctgtgagccggtaaacatggaaatgtaggcccctcccaacctgagtcagacccttagcctggggtccaggaaactgttttaacaagcccctgggtgattttttttcacatgttcaagtttgagcgcctcgagggcctgtgaatggttgcatataaggtacagctggccatatgtcttaaatgacttcaaaggggtgtgagccaggcctcttcccacaccagacttcatgaaccatgcctggtattgtcatgtttttgtgagcagccgtgaatagggctgggggagagagatgttcagccaagaaagtctaaaatagaaagggaatgttcagttataacaaaacaaatttttgtaattagagtgctgggttgtgctcagcatcattggagttaaatgtggagcagtggcttacacttgtaatcccagcactttgagaaactgaggtgggcggatcccttgaggtcaggagttcgaggccaccctgggcaacatggtgaaactccatctctac

SEQ ID NO: 1352 - DNA, 2733 bp, Homo sapiens
ggtatgggctcattatatatgtttgttcagaccatcctttcctaccaaatgcagcccaaaatccatggcaaacaagtcttctggatcagactgttgttggttatctggtgtggagtaagtgcacttagcagtatccttcactgtacaatgtggctacacttggaaaggaattgaatgacaagatttaagtaaacactattggtgcagtataagaagcctttttgtctctttttttttttttttttttttttttttttgtaggagagattcttaggttcacaatcctaaactaaagaatttgaaatatggaattcagattgtacatagtgcctcagtaattgagctaggaacaaaaatgttgagcctgatcatactcacttcaaagaaatgagggatgagtaaatgccctttctgagaaccattatctagttaaagattatgatagaactgctaattttctgagcaaagaggtggggtttgactgtgagaaccattttgttgtgaccctctgagcagcacatttttagttttacagtaccactgctgtgtaacattaagtctttaagaaaatgggtttagaccttagcaataaatgtgtgagtaatccttttagactgtaaagtgatttttgttctctgagatcgtctctgagattcttccttgacttatgtttttatagtgctgacttgctcatcagttttgcacagtggcaattttgggactgatttagaacagaaactccattggaaccccgaggacaaagtaagaacttacagtctataaacttagttttatattaaagatggttattttgattgatcttgatatgtttttcatttcatcagtaacaatgaaagtcttctggtagaataatcagttctgtattaaaattattttcttgatatggtagggtttatgtagaaccttccatattctcctgtcacctgtgatctgtagatattgtcaaaatatgaagagcattgcgatggcagaagagttttctgagaaattgactcccctaaatatgggtatagtatataatatagccaaccgagatcatttatgttttgaatacttgttttctgaattgaaaagacatcttctcccactttttgttatctggaaattgattatggactctgcatttaggattcaatatagtggatatctgaatgtagatataacatctgggactctgagaatagaggaagaggaacatatactaaagaataaaatgagttcatctgttttcacaaaccacttggtggtgttttatataagaattagccccaaattgggcatgtttgtgaaaatgaatgaatgaaataatttactagattttcccaattgtaacccatatattatttaatatcgcaaacacagcacttactaagtttattctgagcattgttaaacttttcttagttgcatattatgaatcttatggctttgggtaaggcaatagtaatttcccgattgtagagtaaaaatgatcctgttctatcttagctatttaattggaaattttattcgctcccagtgaaacaaatagagtgtcatttaggaggatttcctaatgctggctctttaattctagagatattatatgcctggtaagtcaagggttgattttcagaagctccattattttataagaattgtgtgttttttatttgaaacatagtatatagatcgtttaaatgaaatttcacaaaactattctttttttcccatcactcagggttatgtgcttcacatgatcactactgcagcagaatggtctatgtcattttccttctttggttttttcctgacttacattcgtgattttcaggtaagaaggcacagtattagatttattcagtcagacttccttctcttagtccaggaaggtagactaagagaactttccataggcaactctcccgcctttttgaaaattaactgtttgtgatttggtatcataaacaagtgatgtaacttttcaggtgaattgtttctgtgtttaaagaagtagtgtattgctagcaagatttagccttgaaaatggggctataaaataaatttcagaaattcttacatagaatttgttatcgattctgtgtacttttacataggtcattctcaacatttagttttactgattcttagtagaaaccaaagaaaaacagggaactttatgaattgagaagcttggtttttccagattttaattggtacaaagaggatacctttgacagtaaaacagctgtctcactaccattagaattgatttacattcataatcacaaggtagcctatagaacatattgaaggagtgatctctctttaaggagcaaacttctatatataattttcttttctgttccagaaaatttctttacgggtggaagccaatttacatggattaaccctctatgacactgcaccttgccctattaacaatgaacgaacacggctactttccagagatatttgatgaaaggataaaatatttctgtaatgattatgattctcagggattggggaaaggttcacagaagttgcttattcttctctgaaattttcaaccacttaatcaaggctgacagtaacactgatgaatgctgataatcaggaaacatgaaagaagccatttgatagattattctaaaggatatcatcaagaagactattaaaaacacctatgcctatacttttttatctcagaaaataaagtcaaaagactatgat

SEQ ID NO: 1353 - DNA, 2008 bp, Homo sapiens
aagaaaagttcagcaccatcagagagaaacaagacagagagaattcatagaatggctttagggcctttcctccaggcggtaagaggatctgcgtgtgtccttcgcaggggtccaaagggagagaacctaggcctagggtttcggggataccgacacccagaaacagattttctctcaaagaagtttctgccgccatccctatcttatcagcaggaggccccggcgccatcgtctccgtctttatgattttattatggggaggtgggaaacgccaccctggattcttccaggcctcccctattcagcttgggggttccccctcattcttccctcaaagcctcagtccctgaggtcctcctcagcaccccccgcttctggcggcctgtcccccgtgaagtgtaaaggcacggccgaacccaccggccttgccgtgaaggcgggagggcccgaacccgccagggccacggcgatggctccgaggggcccagaaaggggaagggcaggccggggaccggggcagaatgacctggccggggaagaaaggaaaaaaggaggtgaggagatgcaccgcaccgcagggctgcacagagaagggaagatgatgaaggaggaggaggagggcggtggcccgggtgcggccccctactcctcccgcccccgggtccccgggccggcgggggcggacggactcggcccattcccaggtctgggctggcggggggttgggggatctccctccacgctactaggagacagagaacgagggtatcgggagcgggggggggctgtctcccgcctgaacccggagaccccgacgccgtcgtcgcctcttcctcaggagggaggacggcagctgtgggtaaagcccgaaggaggaatgcctgaaggtaaggggaagcccggggcagacccgctgcccgctccggaccccactctccaccttccggtaaccgcgtctcttaccggtaatggtggtgaactgttgaattaaccccttcagcgccgaggacgccgcggagcccccgtgggcagccatcttaccgccgccgccgccgccgaacaacaacacagacacacacggactgccctcccccacttcgccgtgcggtgtgcgcaggcgcattgaccgcccctcgagccccgcccctcccgtccccagcggtctgcgcaggcgcattttccgaccgggcccgcgcgctcccagctctcgggttggctgctcggttgctgcctgctcagtgcatcctttttgccattgctggtgccttcctctccgggctccaaggctagcctcgcaggcgcggtgtcgattcctagattccgaaggaagcttcggtctcggcagatagttcttcgcatttcagcttcgcaagctttattgacagagccaactgccgatgacagcatttttctgttttgcggttgtaccgcactctattaggtttcctgcaggtcccatcaaaatgcaaaccctacctcctcgctttgaagcgactctccccgtactcgccccccagcctctaaactaatggcttagctaaccgattgcgacgagtgaaataccagaacccttcatgccaaagaaagcacttagcgcggggttgccacccagtaggttttcataaacgattgtttagtctgctttccttaaataaattggccatcacgtctcccgttagggtcttaatgagaccccaagaggcgtcatttgtataaaaagaaactctgtatatgcagtagaggaaagaaaacatatagaaaggagactggaaaagtgtgctcaaaacgctggtaacggttacctccagagaagagaacgatcgggacgatggtcaaagcggaccttacttcgagtttcttatttatctttttatttttaaacaaacattattggccgggcgcggtggctcatgactgtaatcccagcactttggaaggccgaggtgggagaatcgcttgaggcaaggagttcgagaccagactgggaaatatatcaagaatccatctc

SEQ ID NO: 1354 - DNA, 2226 bp, Homo sapiens
agacacacccaggcagcccaccctgcccaggacctggggatgcggggcgggagagcgcggccggcgtgggagagctttatggggctgccccctcgatcgtctgcgaagtggggcgcggggcagtccctggaccggctctgctgtgctccgggcagtcgggggcttgcgggcgctccggggaggatgcgggcaccaccggctggacggtcgcagcctgcagggggccctggggacagcctgcctcatccccccggcgggctcgggccaggtggcagcgcctgggctcgccgcgcggaggcggcggcttctcgggctaggggcggcggcaggggcggccccgggatcacatgggcggaggcaggtccgggagccccgggcgggctctccccagagtcgggtagacggcagcgggagcggtggcgtctcctcgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcggccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgccagggtctaagtagggtcgaacacagaagtgggaaggagaggggtgggccaggggctaatggtgtcactgtgtaaagtttttgacatactagctctataaatatatgaatatgg

SEQ ID NO: 1355 - DNA, 3125 bp, Homo sapiens
aatcgcatttgcagtaataattctccttggttgagtgccaggttctggtgaactgtttggatacatggactctcctcattaaccccatgaggtttgatctccttattctctattccccatttttcagatgagaaaactgaggtgcagggagattagagcccattgccaaggttttagagtgagtcagtagctcagctgcatttgcacctggaacccgcgctctcgcccaccctgctctagccctggcctgtggctgggacctccagcataaaccggatgctctgcccagctctgggcccatttctgctgtttctgctcagttcaaccctgatggcttcctttatgggtgacactccatgtcacccaggcgaactgtcagcctttggagtggcacccagtagggtctttacttccagtttcttgttcacagtcttcactccttcatacccctcactccctgggtaacatcgggccaccagtaatgctggttcctagctctgcaacaccatgcacggtgtagtagctaagagcagagctttcgggtgtgaagtacctgagtacagttcctgccttcccctgtgtgtgcctggaacagagtaaacactcaggaagcgttacccactgctgccattcccagagatgcaaaaggtgaggtctccgttttgccatctatacaatagagataataaaggctatcccactcttaatgtgtgccagtttctgtcctaggcattttgtagatgtgtgagcttatttagtgctttcttattattatttttggagatggtctcactgtgtggctcaggctgcagtgcagcctctgcctcccaggcttaagcaatcctcccacctcagcctttcaagtagctgagaccacaggcgtgtaccacccacccatggctaattttttattttttattttttattgtttgtttgtttgttttgagacagaatctcactctgtcacccaggctggagtgcagtggcatgatcttggcgcactgcaacctctgcctcccgggttcaagtgattctcctgcctcagcctcccgagtagctgggattacaggtgcctgccaccacgtctggctaatttttgtatttttagtagagacgaggtttcaccatgttggccaggctggtctcgagctcctaacctcaggtgatccacctgcctcagcctcccaaagtgctgggattacaggcctgagccactgcgcccagccagcctgttgtttttgtttttgttttgagacaagagtctcactctatcgctcaggctggagtgcagtggcatgatcttggctcactgtagcctccaccttccagattcaagcaattctcctgcctcagcctcccgagtagctgggattacagacatacaccacaacgcccggctaatgttggtttgtttgtttgtttgtgacggagttttgctcttgttgcccaggctggagtgcagtggcacaatctcagctcactgcaacctccatctcccgggttcaagcgattctcctgcttcagcctccccagtagctgggattacaggtgcctgccaccatgccgggctaattttttatatttttagtagagatggggtttcactgtgttggccaggctggtcttgaactcctgacctcaggtgatccaccccaccttggcctcccaaagtgctgggattacaggtgagagccaccgtgcttagcccttttaaaaatgtttaaaaattattatttagtcctttcaatgaccctaaggtaggaactgttatctccattttgcaggtgagaacaccaaggcccagggaagatatatcacatttgaacccagattcagatttgaatccaggtggcctggctgctgagtgcatggtttgagtcactccctgtcccccagcttcctctgttccatcactctgggttattttcctccttgaagttatcagggattgatactatcctgtgtttcatttgcttgtttagcacctgtctgctctcacctagaatgttagctctctaagggcagggactgtatcctgccacattggcccacgtctggagagcctgtggcacatggtggatacaccatggatttgttgaatgaaggcgccccctgcaagccaggccctcaccctggcttctggctgtgggcccaggggtgtcctgggagcacaaccctagctgaattcctgcctgccctcccctccaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccact

SEQ ID NO: 1356 - DNA, 2904 bp, Homo sapiens
taatgcgtgcgtgctacttgggaggctgaggtaggaggattccttgagcccaggagttttgaggttacagtgagctgtgattgagccactgcattctagcctgggtgacagtgaaaccctgtctctaaaaagtaaataaataaaagtaaatagtaactaaagtaaaactctagaaacatttacagttactacagaggaactttaaaacagtttaagcaataaatacaagaggactaaaaaacacaaaagtttttacaatttctaacagactgcatcaattggcaaattgattccatttatgattgttaaaataggtgaataagactagatgacaagataacaaaaaaggaatacgttatttatttgtttatttcagacggagttttgctcttgttgcccaggctggagtgcagtggcatgatctgggctcactgcaacctctgtctccctagttcaggcggttctcctgcctcagcctcccgggtggctgagattgccggcatgcgccaccacgcccagctagttttttgcatttttagtggagacggagtttcaccatgttggccgggctggtctcgaactcctgacctcgggtgattgacccgcctcaacctcccaaagtgctgggattacaggtgtgagccactgcactgggccaagaataagatttttaaaaacattttcgcatctggaggctccagggggcttccctgagaaacggcagcctctgcggtcagagaggctgcaattcagagcgttcccacaaacagcaccatgtgctcatgcttacctgcttgggtgtgtgagtcacctggagatggggtgcagaaacattgacatacctgagctatctttcttcctctgccctttgcaggtgtttgatatacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacatgtttcccaatcatccctgcctatcccactttctggaatgaaggcctccagtggccccccctccaaaccttcttcccttcccttgacagaccaatgtcctaccttctctctacagcagacataaacgtgacccaaaaaagcttcaattttgccaagaagttctccctgcccctgtatttcgtctcggctgctgatggtaccaatgttgtgaaggtgtggttgactgcagaggtagctagcaagctcttcaatgatgcaattcgattagctgtgtcttacaaacagaactcccaggacttcatggatgaaatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgttttctttccaaagctcacctcggggacaattccttgggcttctcctgaggtaatgattacccccccacccacagctgagtctgtgaggccccatcctttccctacgttttctcccatcttttttcctcttcaatctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatctgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacat

SEQ ID NO: 1357 - DNA, 3642 bp, Homo sapiens
ctaatcactgtttagttcagaaggttctaagacatgaaaggattctgggaaaggtgcttccttggagactttacagggcctaaagctcattgtgataactgcacgatgctgacaagacaatgcctcccttccctgactgtaaggttgtccctactggtttattcactttggaggcgcctggctccgtattcctcaggtactgctggatgaggctgtctggaagacaaaagtcgccataccctgagataagcagtcatgttgatatctggattctaaaaatccacaactagactggagaaatgttctgtatcctggattcaagtcctagcccacgaactggcccttaagaatttagctcataaatatttgattgaaggaatgaatttaataagtgctaccttctgcactaagtatttattcagagaatacaaagatgaatgagatacagttgctaccctccaggggccaacagcccagctccaaaggctcacctaccttggtgaacacccaccttggtgaaggcatctagggtggactcctccgacatctcatccttcccaggtggatagtgagctgacttcacatttatcactttgtacctaaagtgtcctcctcctatttggttgatggtggtagctccccccacccacccacactccaaacctcaagtcctcttggaggcctgtgttttcttttcctcaactcccacagccaggtccaaatgactatgcctgtctagtggctttcagagttgactcattcttgccattgcatgcccatggtttcatccctgaaacagggcctcacttccttggcatctccccactgctcctctctttccccaccaggctgttctctgcccttacaccaggtgcttcaaaacccttagtggctcctcattacttacaaatgaagtccatacactttagcaaggctttcaaggcctccacaatccgatgccagccaacttttccattcttattccactctaagcctcctccccacagcagcttgggatccaaccccaaaacaccactggccttctttcagacacatatctccccagtaccctacctctaggcatttgtcatgctgtcacctgggcctggaacatgttctagctgacaggccagcttctccaggaagccctccctaatctgcaaattagaacattctctgggttgtcgtgggattctgcttgtcccctctaaaataaaacaaccttgtgttgtagttacacacatgcaatgtcttatctccctgccccatcaggctgcaagcttcttgagggcaggaacctggtcttgaaccccagtgttctatcactgtgtgctcagtgggagcaaagaatcaacagctgttattatccttcagatttatgcttcttggggagccatgccctggggcacactttaccttctttgtcccaggctgcttctctataaatattaacctttctttcctagtctacactctcagagagtagtagaaagagagtagggtgtagtagtagagagattgcttatctctctctgtggcgatggctatgcttcacctcgccttctagttcatggtacgcatccctgcctctcacactggcccattgcttcacacccaagggcataaataaaagccactctctaaactttgccatgccacaaagacctgggcccaatctgtgaacctgatttggctctggcgtggggatttggaaaagcttcccatgcgattctgacatgcaccttcattaggtacatttggctgcaacttttttaaaaaatgaggagtccagagtcttctacagtcccttgagcagggatttgcacacagaagacactcaatatcttgttattgaataaagtagataccaatgtagccctctggccaacctagagagagcttgtaaggcatttccccttcagttccagatgcaacttcaatgatctatttgccaatggggcagtagatctggaggagtttatcggtctagggaagagccagggcctagttttaataatgaggccagtagcacctgctggacagggctgggcggcataccagtgaagggaaggggctcccatggacctacctgccagcctacaggtggggccactactcaccaccgatgggagaaacagcataaggaagagataatgaggtagtttgtggtatcagagctaagcctatgggcttctagttggcctaatctttcaaacacagtttcacactgattcttaacattttgttcaacttttactcagagggcaggctgagccagggagcaaaaaggcaaaggactcctactcacatacccacttagcaaaaccaaagcaccttgggctttgaacccacccttcttagaaggcaggtttgggggttgaggccccttgagaagctcacttcaccctctccccatgccatcccattcctacccatcccaagatgcttctcttgtatttctttcagcacatccagccatctccctgggagcgtttcatatctgactctttatacttccagtgatgttttggcatccctaatagactggctcccaaggcagtctttaatcaggagtcttcccctaatctagctcctcaagaacccaagggaagaggcacaaagagaagtatgaataggaagatagaagggtaacccagtcagagagggagtggcagatgacactgctgaaaaggagtttccagagagttgcacaccatgagccacgctgtctgtccctgaccacaacctccactggccaccacctcctgggcttcccctccctccacccacagaaaccattgctcaatctcaactggactcttgcaggcctatctctccctccaaacagagatgtcctggacacagagctgcagacctctaaccactcctggaacataaaaaaacccacggtggttctacagcatttacacctccagtttccctcagacagaatccagaagagaagaacctcgctgatctctgagcggagcatgtctccaagctcaggccagccccagaactccaatggcctcaactggagtggaaatccctcaaaggcacaaacccagttcctaccatctccctcagtgcctggcaatgtttgtggttggttgagtgagttaacaggagaccatcttttggccttttttctacctctgttttctcttactatacttgcctacatctcatcttctggtcaacaccaggtactcaccccatgagcttcttgtgaacttgtctggggcccaccggcctaaacatcatcttttttgtttggaattaagctttgttgaacttttcacaggtttcatttatgcaaatgcctgtgatgggacaaaaaggtctgcaaacatggaaacctggtctaaagatgtccaaagtaaactgtctgtggagtcgaatgacatttgagccctggacctaaactccaaatccaagctctttcccactgtgaccttgggcctctcaaggctcagtttcctcacctataaactgtagagaagccaataacagactcatccacactatgaggctgtgcataaggtcatgtatgtaaaactacttgctttgttgatcattctgtcccagataagtatgaattattatgcatcatttcattaaacaagaaagcttcactgtgtt

SEQ ID NO: 1358 - DNA, 2486 bp, Homo sapiens
tgcaccaggaagccaaaggggggaaaaatcatgctatctgtactagaaaatttaacctgtattactgttatctaatatgctttagtggtcttcagactattcactaattaagcatgttctttaataccaccaaataattttcattgttatgcacaacaactgcaaagagattgagtcccaagatctacaaaggattgtgagagttggtggttgagatttgtcacaatcagaatgggactcaactggtacccacagtcttacatttactcaaatttaatccagttcaaaattttactactgcatgcttttattcaaatgaaccacgcccagctaatttttgtatttttagtagagacggggtttcaccatgttggccaggatagtctcgatctcttgacctcaggtgatctgcccacctcggcctcccaaagtgctgggattacaggcataagccactgcacgtggcctttttttttttttttttaagacagaattctcactgtgttgcccaggccagagtgcagtggcacagtcatagctcactgcagcctccagctcttgggctcaagtagtcctcctgcctcagcctcacaagtagctgggattacaggtgtgagctaccacaaccagctagtttctgtattgtggatgagccatagcaacagcgaggggtttctgacatcagtcagctgccgtggtttaatgcatttgagccatatctagacagtgcttcagtgtggctgacacagcagcatggtcttgacaagttttcttcatcctaccacaaaatcccagttggtaatagagactttactcctacctatcaaaaccacaaaatgccccattaggggggacatgttgtacatgttaggatcattcaaataaccaagattataaggtgaggaaagatgcccctaactgattcttttgtctctcatcttgttggttccagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacct

SEQ ID NO: 1359 - DNA, 1658 bp, Homo sapiens
aagcatcatccaacaaccacatcccttctctacagaagtctctgagaggaaagttcttcaccatggactggacctggagggtcttctgcttgctggctgtagctccaggtgctcactcccaggtgcagttggtgcagtctggggctgaggtgaggaagcctggggcctcagtgcgggtatcctgcaaggcatttggattcaccttcaacacttaccaaatacactgggtgagacaggcccctggacaggggcttgagtggatgggagtggtgagccctggtggtggcagcgcaacctacgcacagaggttccagggcagagtcaccataaccagggacacgtccacgagcacggtttacatggacctggacagtctgagatccgacgactcggccgtttattactgtgcgcgagttgtgagcgagctttctttctccggcggtggcctgaccctgctggatcggatcaaggtccccaataaccactactcctacggtatggacgtctggggccaagggaccacggttaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatgagtgcgacggccggcaagcccccgctccccgggctctcgcggtcgcacgaggatgcttggcacgtaccccgtctacatacttcccaggcacccagcatggaaataaagcacccaccactgccctggg

SEQ ID NO: 1360 - DNA, 2394 bp, Homo sapiens
aaaggcttggaggaggtctagtaaggcgaacggactgcttccggccagaggtcccgggcggaggaggaagctgtggctgccggcggtgggacgccccggccgctcagcccccgggcactgctgtggggcgttcaggtaacaggggcggggctgtgctgagcgtgagggatctaggccccgcctcacctttcagagccacgtcgggcgctgggaagcctacaataccaccctctcctcagcacgacgttcaaggcctgacctcagcctgtctcagtctttccctctcattcaggatcgggttcatacgtagtgccgcatcaagtagcgccttcatcactccagtgatctgccctcaatccgtctctcccactggcccacgaatagtgatggtagtgagttcctggagtgactcaagctgagctgaatgaccgtatggagagcttccgtaaatcaaatagggattggattggattgtcctttctctccagtgtcacaagttgtccacatttgtacaagttcccgcacaaccctcactgtattccagtctgcctacttctctgcatctaccgccatcaccaaccttctagccaccatcatctcctgcctggactgatgtagttctccccacatcccctctgcaatccattctccacgaagcagtcagattgatcattttgcactctttccacacttggggcaaagcaagccgcgaggaggaaccagacagtcctgttagttgtggccagccctcattccctggaaatggcaaacaaggggaacaaaaagcgtcggcagttctctctggaggagaaaatgaaagttgtgggagctgtagactcaggcaagaggaaaggtgatgtggcaaaagaatttggtatcactccctctactttatctacattcttaaaggatcgcaccaaatttgaagaaaaggtgcgggaggcatccgtgggaccccagcggaaaaggatgaggagcgctctttatgatgacattgataaggctgtttttgcttggtttcaagaaatccatgccaaaaacattcttgtgactggttctgtcattcggaaaaaagcactaaacttggccaacatgcttggctatgacaattttcaagcaagtgtgggctggctgaacagatttagagatcgccacggaattgctttgaaagcagtctgtagagaagatagtgacaggttaatgaatggtctaggaatagataagattaatgagtggcatgcaggggaaattataaaactgattgctgactacagcccagatgatatctttaatgctgatgagacaggagtgtttttccagttgcttccccagcacacacttgctgctaaaggagaccactgtagagggggcaagaaagcaaagcagcggttgacagcactcttttgttgcaatgcctcggggactgaaaaaatgagaccattgattgttggtaggtcagccagcccacactgcctcaagaacattcattccctcccttgtgattaccgagccaaccagtgggcttggatgacaagggatctgtttaatgagtggctgatgcaagtggatgccaggatgaagagggcggaacgccggatcctcttgctcatagacaactgctctgctcataacatgcttccacacttggaaaggattcaggttgggtatctgccctccaactgtactgctgtcctgcagccactgaatcttggcataattcacaccatgaaagtactgtaccggagccaccttctaaaacagatcctcctcaagctcaacagcagtgaggatcagaagaggtggacatcaagcaggccatcgacatgattgctgcagcgtggtggtcagtcaagccatccacagtggtgaaatgttggcagaaggcaggcatcgtccctatggaatttgcagaatgtgacacagaatcagcagccagtgaaccagacattgccattgaaaagttgtggcacacagtggctattgccacctgtgtcccaaatgaagtaaatttccaggactttgttactgcagatgatgatctcattatctctcaggacacagacatcatccaggacatggtggctggcgaaaataccagtgaagcaggaagtgaagatgaaggggaggtatctttaccagagcaaccaaaagtcaccatcacagaagccatatcaagtgtacagaaacttagacagttcctttccacttgtgtagacattcctgatgccatttttggacaattaaatggcatagatgaatatttaatgaaaagagtgacacaaacccttattgattccaaaattacagatttcctccaaacaaaataatgcaggaatttatttcagaaaatgtagtttacaagaataaagatttctttagataggttgttgagcc

SEQ ID NO: 1361 - DNA, 1591 bp, Homo sapiens
tataccacaccccacaaatgttgcttatgtttccttggtcattctgtccatcctcctgtctgtccaaagccaaggacactgctctactctaaattttttgtcccgaagcccccaaatactgcaaccctgacccaatgcacgaagccaccccaaaatacagcagaggacaccaggactttcattttccctcagtatggcccatcctttgggtatgccaactccatgtccaccaagcactgcatgtaggacagggcacagtttggaggccttggtccagccactgccccagacccaccttggctctctcctcactaacacccgagaagcccagacttcccagtgtttagcaacagattaaactctaagccaacaacaacagaacagggtggagtgagtggaaagcaaatgaaatgttaaaaaaaaaaaaaaaagcaatacttgcattctcattagtaggaacatgtgagatgaagcatgttatgttattaggcattctcttgattcggtaaacacaagctgaataaatttataaatatcagcattaagcgagatttaacggggagctgtttatcttctgcctgtcaggcaggcggcaacactctccatgtatcactcgccagccgtgcagtcctcactctcttgcccaggtaagctggggaagagcctgctgccgcccagctctggttgtggaagggctggcaccaaggagctgcgagcttacctcaactcatctcacctcaccatgccggctgcgaggcggcccgtgcagtccgtgcgcaggaggtcacactcccatgctgcatcccagcccctccagaagcagagcatgacctgggtgactttgaggatgctatttaacctctctaagctaaagctcctcgactgcagcatcaacagatcagtgccgacctgttaaggccgtcgagagcatcaaatgctactgttcagcaggtgcctgacacatagtaggtccacaagcaaatgattttcctgcttgcatcatttctagcacagagctggaggaaatggcgaggtgcaggtggccgctgggccctgctgttctacatgggagcaagacagctgctaggtgaaggggaatgaccaggcagccacagggaggacatgtggcctcaggaagcctgggtgtgtatcctggttctgctaggaacacgtgtggggctttgtgtgggtgactctctggctccccaagcctccctttcctactgttatatccttaaagtgcctctgaggccaaagcctttgtggcaattgtcaaatgagtccatatgcagtgagtaccgtgttgagggaggacaaggtcaccaagagctgagaatgtttctccgactgatgagacctagatattgggtacatggaggtccccggtccctttgtgattcctgcagcctgttgcctccttgcctggaccccgcctcagctcagaaagccaattccctagattccaaaggccttcccagaccaattagcatgtcctgcagctgtcagctccctgtgcctagcctggacctcagctcatgtctagcacccagtctcccaaccccacacatattcacaaataaaagaaaataac

SEQ ID NO: 1362 - DNA, 1842 bp, Homo sapiens
agttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggcataagtgacccttcttcagtttaagaaccatgtacagataaatcgtgtgcacttacaaacataggtaattattagtatgacaaacatgcgcttattagaaaattctgttcttgagttaagaagggagagattattgtgggccctgatacttgaggaatgtttccgagaagagggacccacttaaattggtcaggatagaacaaattggtcaggataggagagcaagacaacttgcccgcctgcttgcccaattatgagccttcccaacaagcaacctaaaattaatacttcttataggacccatttaaattaccatcttagccctgggatttgcctaagggtaggataagacaaatcattaggttgctcttggaagtgggcagtggtggtttgaagaaaagtgtgtaattgaataatctgttctagtagcatggatgaacccagtctgcttgaaacaagtaaaaggagtttgatgagaaatgcagttagaaagttgggaagaggccaatttggggaacagaataagccaaatctgcatatttaacaattcaaagtacaggtgttacttcaatgccacctaaaggctgaaagagtaggatagcacaattaaatggagtggggaatatgatttcctttatattcctagacaaaggaaagtgttaaggaaataccatgcagccgttggaatgattatgtatggataggtttattgacacaaaaggacattaattattttatatttggtgaaacagagaatgtgacatcatgtatggaaaattagattccatttttaaaacatctgtaaatgtacacaattcctatgcaatttcaatatgaatttctaaacacagtctggaataaaatatataccttgttaaaaaatgcttagagacaggcgttggggagatacaaacattaataagacaaattaaaaaattaatatgctt

SEQ ID NO: 1363 - DNA, 2245 bp, Homo sapiens
atatgatatgggacaaaatacagcacttaaagagaggtgttgctcaggccagccactataatccacccatcagccagaacattttatttcttctaaatggcacttgagcaacattggtttctttgaaaagaatgaacttgagaatgcaactcccaggaccagaaaagaatgaaactgggccagtgcttgcatggtcctgctgctgctcactgcacgttgcttcaaattcttacatttgctctcatttctacatggcaggtacttggttctctctctctttctccctctttctctgtgtgtgtttataatttttttttttttttttacagagaattaaaactaaactaaaaattttttttttcctttttttgaggtaaggtctcactcttctgcccagactggagtgagtggcacgatcatggctcactacagccttgacttcctgggctcaagcagtcctcccacctcatcctccccagtagctgggaccataggtccacaccattgtgcctggctttttttttttttttggtagtaacccgggtctcactatgttgcccaggctggtcttgaactcctagttcaagcagtcctctcaccttggcctcccaaagtgctgagattacaggcatgagccacccagccctgcactgaaagttttttaaaattaaactgaaggctgagcctactcaagatcatgtacctagtcactgggaaggtgactggttcagtgtatgcattttgaggatcaaagcatcagcacagagtacccaataggctgtttaaaaaaataaaaataaataaaaaaaaaccaataggacagggctttctaaaaacccaacaaccagatatagggaacattcagaaataaatatctgcccccaaactgccagcctctcagactttcaaatggaatgaggatatgcaggttaagtttctcctctcttatcattcatcttccaatcttcagttgagtgtaggttatgggagaatctgggaggatgttggttgggtcttctggaaggagaagctttggactcagctggtacaaaaggtaatgatggtacagactgagacatggcctactatggccgggaatcaccctctgcccgcgaaaagtctcctgtgttcatcctgtgctgcccgctgtggacaccaggtcccttccgagcagccagcagagcagacgcgactcacccttcctgcttctgggagcctgtgaagagtctcatcacagccctttttactcttcttttccttaactatggtttacagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccatcacagtccaggatgaagaggagtacagggtcctgtgagctgtttgaccactgttctaagaaagactatgtgtgcccaaaagcacataagcatctatgttgggagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtaagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttttaattttaggctcagaggcccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattccatcc

SEQ ID NO: 1364 - DNA, 2695 bp, Homo sapiens
agcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccggtcagtattggtccttggtgtagggaggtggctgaatcaaatcaggcctcactgtcatttgtgtggctttatttgcagccattgtttccctgtgtgatgagaaatgggctaaatgggcccctctaagtccatcatctgttgctctctctctgggcagatatttttttttgttatctggctgggagcaagatgacctcactgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggcctcacctccaaaagcagccccagcccagccccgctgagggaagggctgtcaccaatgagcctgaggaggaggagctggctaccctatctgaggaggagattgctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggtaggtaagcggggagggttggctaaaggcataaagtggcttgtaagctgtatcctcctggaggtcttgactaatgtctcctcttcctcaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtaggtggaagagccagcctctcttaaaattgatactcttgccatgcagcttttggagtgggtgagagaagacctaacatctctccagtgttactttggtcatgggactcctaagtttctgatataaagtccttggtagtcgttcacaagtccggaattatctgtacatcttcattgttcttcatgccagaaaccagaacctggcacacaaaactaactggtaaacagatatttgaagaaacactgtgatcacctagtctccataatgctagcagatagtgggcagggaaaatacaggaaagccatttcctctttgacacaaaatgaaaaagtaagtacattgctaaacttctggatcagcctagcatccttagagagcttaaagaatctttgaccctacaaattatttggggtttcacagggaaagctacagctaatttcctaaaatcagcagatattagctcagtgttaagctcgttctttctaaaacacatcagagattggggttggagaggtcatctgtatagtctatggtagagtctgtatccaatcagtagatgattctggaactctttttttacaggtcagtcccttgttccaaaaattggaaaatgaccagattgaaagtttaaggcagcgctttggagggggccaggtgagaaagctaaaggctgtgccctcgctccacaacagccacagcatcacttccctaatttccctaagtagtcctcacccatcactctttccatcttttggccctgccgcttcctcacttacagtttttctttcctgtcttaactagaagagaccttcgacttaaaggtaaccactttccctctgagatgctgtataaaactggaggttaggggatatttatggttgctggtgataactttgttgttctccaggcaaaaacgtccccgaagccagcagttgtagagactgttacaacagccaagccacagcagatacaagcgctgatggatgaagtgacaaaacaagtatgaagcttaagccctgtgggagactggacaagctgaatcctaaatagatctttttcttgcctcactgttacctccccacccccctttatcttagggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctct

SEQ ID NO: 1365 - DNA, 2609 bp, Homo sapiens
gacactgagccccagaaacgaaatacagaggagtcatcctcacctgttaggaaagaatcttcaagagggagacatagggaaaaggaagacataaaaatcactaaggaaagaactccagaaagtgaagaagaaaatgtagaatgggaaactaatagagatgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccacgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcggggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaacc

SEQ ID NO: 1366 - DNA, 2899 bp, Homo sapiens
agatgttctcaccactcaacagaggaggatactgcagggtccgcgggcgccagagctttatttatgtgtgctccgtattggagggctgcgtgtgacccagcagtgacaggaccgtgggcgactggctggcgaggaggtgcgctgcctgcatccttgcgcctaacagaatgcgaaggacgggctcacatgctcagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacactgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccaggacattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgagacgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttatttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccactttggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggc

SEQ ID NO: 1367 - DNA, 2274 bp, Homo sapiens
gggtggagacttcggagactgcagttgcagttctaaggacataaggaattggctatggataattcatatgctttcaatcaacgaagcacatgtaatggaattccatctgagaagaaaaacagcttccttgtatcagaagatcatggacaaaaaatcttaagtgtactacagaattttagagaacaaaatgtcttttatgatttcaaaataattatgaaagatgaaataatcccgtgtcatcgttgtgtgttagcagcatgcagtgactttttcagggctatgtttgaagtaaacatgaaagaaagagatgatggaagtgttaccattactaatttgtcctccaaggcagtaaaagcatttctcgattatgcctatactggaaaaacaaaaataacagatgataatgtggaaatgttcttccagttgtcatcatttcttcaagtttccttcctatccaaagcttgcagtgactttttaataaaaagtattaatcttgtcaattgtttacagttattatctatatcagatagctatggctccaccagtttgtttgatcatgcattacactttgtacaacatcacttttctttattatttaaatccagtgatttcttagagatgaattttggagtactacagaaatgtctggaatcagatgaattaaatgttcctgaagaagaaatggtactgaaagttgtccttagttggactaaacataacttagaatcaaggcaaaagtatctgcctcatttgattgaaaaagtgagattacatcagttatctgaggagacacttcaggactgtctgttcaatgaagagagtttactcaaaagcacaaactgttttgacataatcatggatgcaattaagtgtgtgcaaggttctggtggactcttccctgatgctcgaccatccacaactgagaaatacatattcattcacaaaactgaggaaaatggagaaaatcaatatacattttgctataacattaaatctgattcatggaaaatactgccgcaatcacacctgattgatttgccaggatctagtctttcgagttacggagagaaaatattcttgacaggtggttgcaaagggaaatgttgtcgaacggttcgactgcatattgccgagtcatatcatgatgccactgatcaaacctggtgctactgtccagtgaaaaatgatttcttcttggtatcaactatgaaaacaccaagaaccatgcatacatcagttatggctctcgatagattatttgtcataggtggaaaaactagaggatcccgggacattaaaagtctcttagatgttgaatcttacaatcctctttccaaagaatggatatctgttagcccattacccagaggcatatactatccagaagcaagcacatgccaaaatgtaatttatgttcttggatcagaggtagagattacagatgcttttaacccatcacttgattgcttttttaaatacaatgctacaactgatcagtggtctgaactagtagcagagtttgggcaattttttcatgcaacattaattaaagctgtaccagtaaactgtacactgtatatatgtgacctttccacctataaggtttatagtttttgtccagacacttgtgtttggaaaggcgaaggatcttttgagtgtgcaggctttaatgcaggtgcaattggaattgaagataaaatttatatattaggtggtgattatgcaccagatgaaatcacagatgaagtgcaggtctaccacagcaacaggtctgaatgggaagaagtttcaccaatgcctagagccttaacagaattttactgccaggtgattcagtttaataaatacagagacccatggttttctaatctatgtgcttgaacattctaaaacgagtccagttctagtaacctaaagtaaatttgttaaccaaaatgataggtaaaaagatctatacatcttaatgaaataaaacattcctgcttttagttattatgtatgtacaccatatatgaataaacagtttccaaaaacttaaaatacaaaatatattttaccaaaaattatactgaatataatttaaccttggggaatccagaatacttagtattttcacatgaaactacaaatcatagactctgacactttgatttttaaagtactctgtccataaaagatttgtactgtttagatgggagaaacctctagagagagtaaaaatgaattacactgtatcttatatgaagtaaaaaataaatcagaggtgagaatatt

SEQ ID NO: 1368 - DNA, 2216 bp, Homo sapiens
ctggactctcgggcagagctttgtgagagaaacaaggctggcttcaagtgatctgcaaccagagtaattgggatttgacaaggactgtgaaaggctgactctccctgttctctttcatgctggcaccgggcagagtgtgggaactactgcctcaatacgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccctgcctgatgctatatgcagagtcccagggaccaggtgtgtttcctctcaccaagaagaaagtacacactgatgagaaactgagaaccaagacaggcatccctgggtggcctttcctgctgacactccacgagctgacccagcagaattctctgtgtaggaagcatcggactttgtccattgaatatgtagcggctgccagagatcacacatcaatgcaaattccagagcctgtctgctatagctcagtgactgtgttgtgattcatagtacattaaaaagagagagagagagaaagaatcccacagggcactattaaaatacttctctccttccctgactcatgacactcttcctgacagcagaatgactgtgtgaccttgaacttcacatttcccacattggcccttggattgttcggattaaccccttccactcctcactggctggttcactgtgttctgactagtccataaaaataaagatggaaggagatcaaacacagaatcataatcataatgcggccccctcccccagagcttacctcgaatgtgaaatccctacttcttataatgcagagttaaggagctgagcccccatgattttgtagctgtacttttgtatgtgtatatttttatagctgcagattgtccacacagtatacttttggaagtttgggtggatgactctgaattcttgcacacctttcctaaaaatttctcccaagagagacttgtttgggccttttgtggtgtcagtggaatggataggtaacttgggtgggcaacttggggagctgaccattctcttttggtaaatgttgacggctcaagaggatgaatatgaagctttccaagataagcagattaaaaggaacatgtgttaccgaggtaggtcactgtcatttttgttttaagagttggggggagtatctatagtaaacttgaataaaggggacaaagctagaacttattcattcattcattcacttatggagttgttactgattttgcggaggtcaggttcataccaatggacactaatacaatcagtgttcccaaggctgtgcaggggtggggggacatgctgtcaggatggtctgagcatctgggtgagaaccagagaaacaggacttcttccttctgtaccatgagctgtgtccctttactatgcaagcacatgaccccagagacagctggttcactggcagatccccatgatggacttactaagggaaaggtgagatgaacactgcccccaaggagggggtgaaatatgatctaacttatgcaagagcctataattagtcccagtctcgactctacatttgtttgtgcagcattcattcagcaaagacttttggggtttgtgcaaggcacagttttaagcacataatgtaattctaaaagatgaataaactagagaggttc

SEQ ID NO: 1369 - DNA, 2073 bp, Homo sapiens
gtcattcacagagcttgattaaccacagacttaaatttcaggaggaagtaagctatgaaaaatctgtaacctctgcctgtcatatgcttagtttgttaaagaaaactagagaaggagcttgttattctttaaatagaaaagctccaaaaagccctaaaatgttttatctgaataagttctctcagtaggtatcttaagaataatagattatagtcaggggttaggggccagctcacaagactgatgcaagttctttaagttgtgattgtgtctgatgaagaggaatgcatacttacatatttgtgtaaggaagatttccttattgtcatttccttccatcgcttggtccataaaagcaaagaggaaggaagggaggtctgtggtcatacacactgtcacccatgctaagagaaaaggtagttgagagctctgcctgcccacgtgcccatctgctgggtcatccttgtcctatcaggagagaaagagcacttcctttcctcagtgggactgggaggaggcagcagcctcaggcagctggaaggtgtgcccctgggcctcacacagctctggggaggtggcacagggcttcctctttcatagagctaattaggttcttatctgtgctaccagatgagcccagctgccagctccttacttcatctcaaccaatccaacaggctattcaaaccaacactgatattattctagcaatatgtttatgtattttggacaaaagtttaaagtaatttagtcctccatctgtcaccttcaggctaaagtcctttattttcttggtgcattgaccatggggctccatctaggctctgaaaggatattccctcaaggccctgagctagagaccacagggtaactctacatgctgttctcctaataagattttggtaacatctgattgtttgctaaaatcccattcaaagctccttctacctgggcagagcctgccaagttgagttcagcttcagttggatgagtatgtcaaagtccctggccattcgaatagccatttacctaaggcaagagcaaatgctggctaaagcatctaatcaccatttatttatgttggtgatgttgggatttgagagcacagagtggaaggtagaaacagggtagtgtctgtaactaccgtcagatctacttcttcactttcatttttaacatacaaggtccttaaaaaaaccttggattttttttttgttgcgggggcggggtagagatgaggtttcgctatattgaccaggctggtcttgaactcctggcctcaagtgatccttctgcctcagtcccccaaagaaaacctagcagttgaaaaatgatcaattcatataaagagaaactgaaaaaagacttttgccttgtccccagcaggctgaggaattaccaaggaggcaggaggtggagcaaaacacaccaagcctggtgccaatcattgacaatattatggttagtacttactgagggctgactatggttgaaactgcctttgcaaaattatgactgagacggtgaaagagatctaacttagccaacgctagctatcttgcttctaacctccaagctgtccttgttcattcctgggcataggctgaactaactttgggagaaatttagtttatagtttgaaacaaagatgataacagccctttgccaaagcagacctccttcttgtctggggactagatggcctttgtaggactaacatgagccacaagattagaaattatggataggagtcatgcagctggagtctccaagattctgaccctccctaaactgctcccaagatcaatgcttgagatattttgcagaccctgcatgtgatggatcagctgacaccatccagatcggtaaactggttcatctgatcttgtgccctccacccaggaactgactcagcgcaagaagacagcttcgactccttgtgatttcatccctaaccaatcagcactcctggctcactggcttcccccaacccaccaaattgtccttaaaaactctgctctccaaacgctgggggagactgatttgagtaataataaaaccctggtctcctgc

SEQ ID NO: 1370 - DNA, 2458 bp, Homo sapiens
gagacagggtgggcgggggcaaaggctaggcgctagggcggcggcgccagcgtagagcggcggtttggaggaaagatgagacgattccagcaagattatggaagagcatagctacatacaaaaggagctagatttacaaaatggtagcttagaggaagactctgtggtgcattctgttgagaacgattcccaaaacatgatggagagcctcagcccaaagaaatactcttccagtctgagatttaaagccaatggagactattctggctcctatttaaccctctcacaacctgtgcctgcaaagagaagcccttctcctttgggaaccagtgtcagaagcagcccctccttagccaaaatccagggaagcaagcagttctctcatgatggaactgacaaaaatattcctatgaaacctccaactcctttactcaacactacatcctccctcagtggatatccacttggaagagcagactttgatcattatactggccgggacagtgaaagggccttgaggctctcagagaagcctccctattccaaatatagctcaaggcataaatcgcatgacaatgtctactctcttggagggctggaaggtcggaaggcatctggctcgctcctggccatgtggaatggaagttccctgagtgatgctggcccgcctcctatcagcagatcgggagccgcaagcatgccttcaagcccaaagcaagccaggaaaatgagcattcaggacagcctggcgcttcaacccaagttaactagacacaaggagcttgcatctgaaaacatcaatttgagaactaggaagtactccagcagcagcctgagtcacatgggagcctacagccgatcacttcccaggttgtacagagccacagagaaccagctgacacctctcagcttgcctccaagaaactctctgggcaattccaaacgaacaaaacttggggaaaaggatctacctcatagcgtaatagacaatgacaattaccttaatttttcttctttgagctcaggggctttaccctataaaacctctgcttctgaaggcaatccttatgtaagttctaccctcagtgtccctgccagtccacgagtggctcggaagatgcttctggcctccacctcctcctgtgcctctgatgactttgatcaggcttcatatgtggggacaaacccgagtcattcacttcttgctggagagtcagacagagtttttgcgaccaggaggaacttctcttgtggatctgtggaatttgatgaggcagatttggaaagcctcagacaggcctcaggaaccccccagcctgcccttcgggaacggaaaagcagtattagctccatttcaggacgtgatgacctgatggattatcaccggcggcagagggaggaaagactcagggagcaggaaatggagcgattggagagacagcgtctggagaccatcctcagtctctgtgctgaatacacaaagcctgacagtcgcttatctactgggaccaccgtggaagatgtgcagaaaatcaacaaggagcttgagaagctgcagctctctgatgaggagtctgtgtttgaggaagccctcatgagccctgacacaagatacaggtgccaccggaaagactccctccctgatgcagacttggcaagctgtgggagtctcagtcagagcagtgccagcttctttacccccaggagcaccaggaatgatgaactactcagtgacctcacccggactcctccaccaccatcctccacctttccgaaagcttccagcgagtcctcttatctaagtatcctaccaaagaccccagagggtataagtgaagaacagagatctcaggagttggctgcaatggaagaaacccggatagtcattctgaacaacctcgaggaacttaagcaaaaaatcaaagacataaatgatcagatggatgagtctttcagagagttggatatggaatgtgctcttttggatggagaacagaaatctgaaacaactgaacttatgaaggagaaggagattttggatcatctaaaccggaaaatagctgaactggaaaagaacattgttggtgaaaagaccaaggagaaggtaaagcttgatgctgaaagggaaaaactagagaggcttcaggagctttactccgagcagaagacccagctggacaattgtcctgagtccatgagggaacagttacaacaacaactgaagagggatgctgacctgttggatgttgaaagcaaacactttgaagacctggagttccagcagcttgaacatgagagccgtctagatgaagaaaaggagaacttgactcaacagctcctgcgtgaagttgctgaatatcaacggaacatcgtttctagaaaggaaaaaatttctgcattgaaaaagcaagccaatcacattgttcagcaggctcagagagagcaagatcattttgtg

SEQ ID NO: 1371 - DNA, 2043 bp, Homo sapiens
atatttactaaataataatgtatcttaaaagttggtatttaggggtttgggtcatacaggggtctccatttatcgtacaattaagatttgtgaatctcatcacatgtaagttttaccccaaaagaagcaaaattgtgtttaaaaataaactctaattaatatgcaatgttgaggtgtggaaggggaaatgtactgacatctgtaatttgctctgaaatgtacccaagagataaggcatgatagatagaattagtctttataaataaatatgtgggccgggcatagtggctcatacctgtggtcccagcactttgggaggccaaggcaggcagatcatgtgaggccaggggttggagaccagcctgggcaacatggcaaggccccatctctactgaaaatacaaaaattggccggacatagtggtgtgctcctgtagtcccggctacatgaaaggctgaggcaggagaatcgcttgagcccagtggtggaggttgcggggagctgagatcacaccactgcactccagcctgggtgacagagctagatcctgtctcaaaataagtatctgataaagttcatataatacagtgtcaatgactgaatccaggtggtggccttaaaggtgttcaccgtacaattctgtcaactttgctgtgtacttggaattttacagaatgaaatcttagggaagagtggtattaaaagtatagaaactgaattacttggaatactactcaataggtattcagtaaatacatttagtgaataaataagcacctcattccttcttcaggctagaaactaaggcatcaccatgtgtgcaggtgaccctcatggtgctggtacccagaaaagtcacagtcatcaaggcttctttgccatccttactgtgacctggtagcgttaatgctccatggtcgcccaagacaagataagacagcctcccatggctccccacagagtggagaggggatgcaggcacaggccagagccacgcgtcatactctgcagagctgattccccaacccagcgtccatggccagagtgggggacaccccacgccctctacctgatcaaatttcctctgcttcttttccaggttggacacgagttgccgctggttgtccaaatcaacaaccaggtcgtccagctcctgctgaagcctgttcttggtcttttccagtttatcataagcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgagtggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcagcttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgat

SEQ ID NO: 1372 - DNA, 1942 bp, Homo sapiens
gaaaagtgcgggaccctcatcaaactcagcaacaataataagacggctgagcgccggcggcccctggatgaattcaacaatggggttgtcatgaccaatcgcccccttcgggacaatgagatgtttgagatccgtatcgacaagcttgttgataagtggtcaggctccattgagattggggtcaccacccacaaccccaacagtttggagtacccagccaccatgaccaacctccagtcaggcaccatcatgatgagcggctgtggaatcctgaccaatggcaagggcacccgccgggagtactgcgaattcagtctggatgagttgcaggagggtgaccacattggcctcacaaggaagtccaactctgccctacacttcttcattaatggtatcgatcagggagtggcaacccccttgacgcccccagtggtgtatggtgtggtggacttgtacgggatggcagtgaaggtgaccatcgtccacaataacaaccacagtgaccgtctccgccgaaacaacgccatcctgcgggcgctgtcccccgagggtgctctccgccgtgctgcccctgccgcccaggcagaacctgagcgcctgctcttccaccccaactgtgggcagaaggcagccatcacccacgagggacgcactgccctgaggccccatgccaccgatgacttcaatcacggcgtggtgctgagcagcagagccctgcgggatggagaggtgttccagggacctggatgatgactgggaatggggtgatgcacaatgggacgaccatcctggatgaatacgggcacaatctggaccgcctcaaggggacacggtgggcgtggtacggcgggaggacgggactctccacttctttgtcaatgggatgactcagggccctgctgcctggaacgtgcccccgggcgtctatgctgtcgtcgatctctatggccaggcggcccaggccaccattgtggacgacgtggaggtggctccagttcctgaaccactccctgaggggaacaaccaggtgtctccaagctctccgtcctcaggggccgggggctctgacctgcgcttccatcagctgcacggcagtaacgcagtcatcactaacgggggccgcaccgccctccgccacaactgtcgcagcgagtttaatgacgccatcgtcatctccaaccgggccctgcgggatggagagctgtttgaaattgtcattcagaagatggtggaccgctggtcaggctccattgaggctggagtgactgctattcggcctgaagacctggaattccccaacaccatgacagacattgactatgacacatggatgctgagtggtacagccatcatgcaagacggtaacacgatgcgcaacaattatgggtgtgacctggatgcgctgggcacaggtgcacgcattggcatgatgcgaactgccaagggcgacctgcactacttcatcaacggccaggaccaaggcgctgcctgctcgggcctgcctccgggtaaagaggtgtatgcggtagtcgatctctatggccagtgtgtccaagtgtccatcaccaatgccaccggccccatggacaacagcctggcgaccagcaacactgccaccgagaagtccttcccactgcactccccagtggctggcgtggctcaccgattccacagtacttgcggcaagaacgtcactctagaggaggatggcacgagggcagtgcgtgccgctggctatgctcatggccttgtcttcagtaccaaggagctgagggctgaggaagtctttgaggtgaaagtggaagagctagatgagaagtgggcaggttccctgcggctggggctgaccatcagattatatcttcaacaccacaccccccaccccatcgtgggtgagggtatcccctgtgtgtcccaggccaataaaatctacctgccactg

SEQ ID NO: 1373 - DNA, 2581 bp, Homo sapiens
aggcggaccgccctgcaccctccaagcctgcacctcttagtccagcaccaggaagagtggctctaggagggagaggagcccagggactgacccaagatgccgttgactccagagccgccctctgggcgcgtggaggggccccccgcatgggaagcagccccatggccctcactgccctgtgggccctgcatccccatcatgctggtcctggccaccctggctgcgctcttcatcctcaccaccgctgtgttggctgaacgcctgttccgccgtgctctccgcccagaccccagccaccgtgcacccaccctggtgtggcgcccaggaggagagctgtggattgagcccatgggcaccgcccgagagcgctctgaggactggtatggctccgcggtccccctgctgacagatcgggcccctgagcctcccacccaggtgggcactttggaggcccgagcaacagccccacctgccccctcagccccaaattctgctcccagcaacttgggcccccagaccgtactggaggtcccagcccggagcaccttctgggggccccagccctgggaggggaggccccccgccacaggcctggtgagctgggctgaacccgagcagaggccagaggccagcgtccagtttgggagcccccaggccaggaggcagcggccagggagcccggatcctgagtggggcctccagccacgggtcaccttggagcagatctcagctttctgggagcgtgaaggccggaccagtgtggggttctgaatccccagggttccccagagatccccgaggcaggcctcgcctcagtgggaccggggaccccaggatccagcattaggattgagactgccccagcgaagatgcccttcccaggctccttccacctggagtccccctccccgggtctgggtggtggccaggctatgtggactaggggaagcccagcagtgcctctgctcagctacctgggctgtggctcagagacctgggggtggagccaatgccaggccagaagccttcaagatcgcatccagatgaagaacccaaggtactagatagtcaggaaatggcatcgaccagccacctccaccttctttcagtgtttaccgaagccaccaataccaaagagaacgggtcctgcggtgctgaacagcctcggtgtggcgatgacagctggcaggagatgacaggaatccagtttcccagagccacaaatcctgttctccttggccactcacccactgtgaggtcctctaggaaaatacacaaagagaggaccagaccaggcagaggaacattttgtttcatatgaactgtggctttgacccccaaactgcaaggaggaacttgctgggccaagctgcagcggcgctgtcttgctggagtgggggcctagagtcagagaaaacccacaggctcctctgcccattctcctccatctgcacacgtctcagcctcggaccctcaccactccatggtgaggaaggccatggccaggggaaactgagtttcatccaatgtggagaggagcgttgtcctagagcagggcaactcccaaactgtgacctctgatcatcgtcccttccagcttgctggagtgtccagagagacagatttgccacaagctaggcttacttataatgctccaccctacagaaatgggaccccaagtacccaatcttccctttaggggaggcaggcaggtgggtgagcagcagatgtagtttccatttccctgggggtttaattttccaaactttgccttttttttttttttttttttttttttgagacagaatctcaactctgtcacccagactggagtgcagtggcacaatctcaactcactacagcctcgaactcctaggctcaagcgatcctcccacctcaacctctagaatagctgggactgcaggtgcataccaccacgcccagctaatttttgtattttttttgtagagacacggtctcaccatactgcctgggcaggtttccaactcctgggctcaagtgatccagcagccttagcctcccaaaatgctgggattacaggtatgagcactgcacccggccacttttttttgtttttgaaacagggtctcactctgttgcccaggctggactacagtggcacaatctcagctcactgcggccttgaactcctgggcttaagtgatcctcccacctcagtctccctagtaggtggaactacaggcatgtaccaccacacctggctattttttttttttagagacagggtcttgctatgttgcccaggctggtctttaattcctgggctcgagagagccactcatccccatctctcagagtgttgggattacagccatgagccaccatgcccggccaaacttcagccttgaatattagtgattttgccatattagtttaccatctgtacaattatttgctttatatttttctttaaattggctcattattcacttaatgaaattattgcaacaggaatcttttgtatcacttctgtaaatggaaaaccagtctcatttgccatcaatagaaggtaaaacatgaaaataaatacaatgtaaac

SEQ ID NO: 1374 - DNA, 2208 bp, Homo sapiens
tcaatttccagtgccccaaggtctctgcactgccgcccctcctcacaggagacggacacctcagcctagatcccttggtgctctccacgctgttcaggctgaattgaagagccctcttacccgccaggtgccaagaactatgaacaggcagggcaatagaaagacaactaaagaaggatccaacgatttgaaattccagaacttcagtctgccaaaaaacaggtcatggcctcgcatcaatagtgccacaggccagtaccagaggatgaacaagcctcttctagactgggaaagaaactttgctgcagtcctggatggagcaaaaggccacagtgatgatgactatgatgaccctgagcttcggatggaagagacatggcagtcgattaaaattttaccagcccggcctataaaggaatctgaatatgcagatacacactatttcaaggttgcaatggacactccccttccgttagacaccaggacctctatctccattggacagccgacctggaacacacagacgaggttggaaagagtggacaaacccatttccaaggacgtcagaagccaaaacattaaaggagatgcatccgtaagaaagaacaagattcctttaccacctcctcggcctctcataacacttccgaagaagtaccaacccttgccccctgagccggagagcagcaggccacctttatctcagagacacacctttccagaagtccagagaatgcccagtcagataagcttaagggacttaagtgaggtccttgaagcagaaaaagttcctcataaccagaggaagcctgaatcaactcatctgttagaaaaccaaaatactcaagagattccacttgccattagcagttcttcattcacgacaagcaaccacagtgtgcaaaacagagatcatagaggaggcatgcagccctgttctcctcagagatgccagcctccagccagctgcagccctcacgaaaatatactgccctataaatacacaagctggagaccacctttccccaaaaggtctgatagaaaggatgtccagcacaatgaatggtacattggagaatacagccgccaggcagtggaagaggcattcatgaaggagaacaaggatggtagtttcttggtccgagattgttccacaaaatccaaggaagagccctatgttttggctgtgttttatgagaacaaagtctacaatgtaaaaatccgcttcctggagaggaatcagcagtttgccctggggacaggactcagaggagatgagaagtttgattcagtagaagacatcatcgaacactacaagaattttcccattatactaattgatgggaaagataaaactggggtccacaggaaacagtgtcacctcactcagccactccctctcaccagacacctcttgcctctgtagcctggtctttgtgttatctttggtttactggattcagcgcttccattgttttcattgatttcaaaagtttattttctgtgccttcaagggacaacttttttaactttggagaaaagaaaaacactctataacagagagtggaaaatcactcacggttttgaaagttcaaaccacagagaaaatatttataacatgcaaaaaataaaaacattctagtaactggccactggaaaataaacaaaaataaaaactagggttttaaaagtatcttctaaaaaacaacaacaaaaaatactataaacatagccattatgctcatgatacaggcgagcagcaaagggcaccagaagctgttgcttaaatgtttgcagccagtgcaagacaagtctatgggaaattcccaaatctgtgctctttacaggacactgcgctgcctttatgtcagttgttgggccttacctatctacaatgtgtggatgatttcttacactaaagatgctgggctgggtgcggtgcctcatgcctgtaatcccagcactgtgggaggctgaggtggacagatcacgaggtcaggagatcaagaccatcctggctaacatggtgaaaccccatgtctactaaaaatacaaaaaatcagccgggcgtggtggtgggtgcctgtagtcccagctactcgggaggctgaggcaggagaatggtgtgaacctgggaggcggagcttgcagtgagccgagattgcaccactgcaccgcagcctgggcaacagagccagactcggtctc

SEQ ID NO: 1375 - DNA, 2567 bp, Homo sapiens
ccgaagatcagattctataaacaaaaactctttgttaaattaaccatgacacaaattattctattgtcttccccgaatcccacaaccccctccaacatttaaaattcatctttagatagcagattatcccttaaagtaccattttactctctgaaaaagtcctagaaatactaccctctgtcaatgcagcagaccgctaccttgcaaggaaaagatggtctacttacataattatccttagttatgtttacaacattgaagcaggcaatatctgactttcattcctgagtgaaatccagaccacagcccagggaggaccaagccatggcattctgttgctccccgctgaacgtcccacaccatagggtctggctttggctggaagaagggcaacctcacccagtcctccagaaggtgcacacacccaagtggatgctactgccattaaggggcatttccttcaactcccacgtggaaaagggggcaaagtggaccctagtccactgtcactcacacacatgtacagatcccagggtccacacagatacagatcccagggtccacatctatcacatatatgaacattatcacacagacccctgcagacacatctgtgaggcatacgcattcccaaacacacagacagactcatgataaatttgttcctacccagccatgacttctaaatgcttggggaaacaaagacatagtagaaaggagtgtgcaattatcatttcccatgatgccgttacttaagaactctttgtgtccgtccttctaatggcaccaatgcctcccatcaagccttaaacctcacctaaattatgtcattgggctttttcatccataaatgagcataccaggtgccaagggaatcaatatgccctttcacatgccttagaccagtgtccaaagaaagataaaatgttattctataaaagcttgctcccagcatttctattcctttacattttgtgccatatacaactatggttttttaatgatcttatttctgacagctgtttttcttcagaacatcaacagcttctttcctaaattagttttagtatgagttccatttctaattagctcaaattaaagtcctagagagcagcgaggtaatatttaaaccctcaggctaaatttcggagtaggtgcagaatgttgactctaaatgagtttttcctgtgacataacacgcatgaaaccaggatttctttcatgtgtgaaatgtcttaaatcagacttaccctttgtgattctcttttagctttaaatgtcatttaagaagaaaaaagaaaagaaaattaagcatgacattccccaatatcctctgctcactgtgttataatccctatcactccacaagtgaattggagagagtgaagacacaatgaacagaaacttccctgatgcttcacagaggaagtgttctccgggaccacacagcctccaccatgtccatctacgaagggctgtggcaagccatatacacaaagatgcctgtttcctgtcttcttggttaaaaacaaaaacaaaacactggaaggaaccccaaagccaagctgccatgggttgcagagtgccagcccttaagtagtgttgttcatgggtaaacaggagacggataagggcaatttcaagaaataacaaactcaaggcatgaatgtggttatccaaacatcaagggactccttcatttgcatttggataattgtgcagttatatgatttgttacatggagaccagatggaagtaagagagctcatcctcaacttcctgtacctctggaagtctttacacacatgctggaaagatagaggagagttcattagcatcaaaccaccatggatttcataatcaattcctaatatctgaatagatgcagaaaagtcacaggcatctagaagtgtggcccaagttctgttcttcaatcggcccaccaattatccctatgtatctcgattttgttatctaaaagatcacatgatggaggatgtaagcaagtaatacagccaagacccagtttacagtgtctagtacctaacagactcttgacacgtttcacttgcccttgagtcagtctttccatgtcactgaatattcttccacaacacgattttaatggatatagtcgtccattgtttaaatgtaccattattgacctatgtaaaaatgttcttttacctcaaatttttatatgtaaaacaaaaacatgtttgaggaataaacccacgctgtagtataaattaaactggatgtaggccaggcatggtgagtcacacctatagtcccagcactttgggaaaccaagacaggaggatggcttgaagccaggagctcaagagcagcctgggcaatacagcaagacctcatctctacaaaaaaataagaaaacttagctggccatggtggcgtgcacctgtagtcccagcttcttgggaggctgaggtgggaggatccactgagcccaggagtttaaggctgcagtgagcttggataacgactgcactccagcctggatgacagaacaagaacctgtttcaaaaaaaaaaaaaaaaaaaaag

SEQ ID NO: 1376 - DNA, 1879 bp, Homo sapiens
cttaaaatatagccagatccaaattgtggtgacatcttcaaagtattgtgttaaaaggaggaatgaatcatatgttccctttttgtctaattgtaacacttttattcagtctcttcaactaagagtctttgctgggatggaagatttgggccgtgtggtgcctcagggaagttctggttacagagaaaatggcgagtctctcagagaagaagcaagaccaagtctggccctgtccttggtcatctcaaagccatgccgaagcattcagttattcttggtgtgcattggaaggcatccagctatccccataccagcagccagtcaccagatgtgaatgtggaagcagaagaccacctcctgttggttcttctcctcttccttctttttctctttagaacggccaccattgaagacctagcttcccattttccagacgttttctctgaaattctctgctggcctgccaagccatatggattcattctgccactgaggagtccttcagtgaggtccctcttcctaaaggacagagtggggagtaggaggggaacagagaggacatcctctctggctctccagtgctcttagtgtctacaggctcctaggcagccctgggccttggtttgattacctcccctgggggatgctggtcagacccagaggttgtcaggaggtcagctaccaggaagatccatgatctgggcattggcagtgcctgccaccacagccaggaagatgcctctgacctgggtgcatctccatcactccttagcagcagcctgcataactggcaagaatcttggatgatacaagagccaagaagggacatttgagttgtgtcgcttagataggaaagggatccagggaaaatcaacagtaagtgaggatgagcagcgtctcttggttttcattgaggatagagtaagagattgagtttagattgcaacagaaggaattagtttagataccaggaagaacttcctagcctgaagatttgtcatagtgtctgctttctagatatctgggaaagatttgataatagttgtttgtgaatagaaaggaggatatgatgtttttattggccattttgcgggactcttcgacttcttgctgctgtctcttgagatacattccaattccatcctggcgagatccaagtgcttacgtactgtctccttagctgccttagagtaaacgatcatcagttcaatggaccaaaatcaccttcagccatgtggtttcttcatcatcatggatttcttttggttgacaaacattctggctctcagatgcaaaaagtcacactgggaaatgaactgtaagtggtgaaattagttttggtatttaatttaaaactacatttatagtttttctcttctcttctatgttgcaatgaatgtaaagtatttgggatccagtgcttataaacctttccttcctttgtgcacagaatgtaactagcaagcccattagcacccagataattctatcatgttagtttcccatcctggaaaatctttgtacagtgggaagttccccgatgtgtttttctttcttaggtgaagggttggctatatcactttattgaattttgcattccttagacttttaaaatatactaatgtattctagtcttactctaaagacctttgatgttaaaggaatccttcatttatttcatattccctatctcatagggccacaattattttaatacagagatgattttcaaaatattttaacaactggtacaggacagatgccagccactcagaagggatgcctgctgtaaacaagcagtatgtatggttgtaccaatgcctattggctgaacattatgctactttcagatattaaaatggtgttcctttgaatcgtg

SEQ ID NO: 1377 - DNA, 2362 bp, Homo sapiens
accaggtgccccatggggtgcggatggttcggcacagctgcctgagctcagaggacacggcctactccctgctcgccaccttacatgggtctcttccagaactaaatctcgttgagcgagcgttgggggctgtttgtattcttccccctgatggatgggtcgcctaaaactgcagcctggctcctggcgggtgccctcagcctccccactcccggtggcgctgtgcgttctggtgccctgcctgagccggagccctcacagtgctctctggcacccacgcgacgctcctccatgcaaactctttccacgcgagaagcgccatgtgcacgtgctccagcaggtacgcgctccctgcaggacatctgtgcacccgcctcaccacagcctccctggcccactgctgctctgtgagcccggctgggcccaggcctcgtctcccctacccctccgagctcggtgctgcctgtcccctcctgctctgccttggcctgtcgcccctgcgccagtgcaggacaccgccacgcctctggccccgactcctgccagggctgccacggctgccacaccccagctgcattcctgagccctccccaccaacagggacctcagccctcagggacagaacctcacgagcacagggacctgccagcccctgcagggagtgcgcagcctcagggactcacttgctgtctcctgtctctttcctagagctgcccttcattttctcaaaggtgaaattcctcagcacagggtctagtcttgggggtggggagcactgggccactttgggtcgggggtgggcggctctgagggctcagcctggggccagcctcccagtcctccccaccttgtgagaagccctgagccatcgcggcactgaatgctgatggtcccactctgggtgctgcaggtgccctgtgttactgggtgacagggccagaggccgtccaccccgcctcctgccatacaagctgcaaaggacacctgcttccaccttggaaatattagtgcagttatctggactatgtcccgacatttggctcataggaatgagcccagcggcgtctagttaagcctggcaggctaagtgcttatttatctccactctctcctgaaacgccactgaaacaccagagagtgaagtgcagagaacgggagagggggcagtggcagctgagcacgtctccaggctttgaaaagcagggaagggtgggcaggagaccccatgggccggcaaccaggaggacagccagcagggagcagctgggctgcaccatggggccacagaaagacacagtgggcagacatgggcagctcctggagggctgcagggggaatgtaccacggggcctcagaaagacacagcgggcaaacatgggcagcccctgggggtgctggggggatgtgggggcaaccagcagaagacagtgggtggctctgggcagaagggaggcgccttcctggggtcagcagtggggcccagctgccagcctcacatccccccaacccccaaggccaggagagacaatagagggggtgggggtcctctgccagagaacaaaggggcccagtggagcaaagccacatatgctgatactggggctctcctaaagtcacaggctcctgccctcagcagcccctgccactgccttcaccaggcccagctcacacacggcttggcaccgtgcacagagggatcaacggccaggggacccgacacattggaggctgcgctcccatgacaaaggcagggcctgcacagcaaagaagggcagagctccgaggaaagaggatgcagtgagtgcagggccctggagtgggccgggactttgcattatggaaaaagagccattgctgtgaagaagaaacattccaggaacgagtggctctcggatgttaccatctagagaagagacaagcccacagtggattgggaggcccttgaagaatcccctcccacagcactgacagacagagctggaagataggaaggatcaggaagtcagaggcgtagtctaggaaatctagcccctgataggagtttcagaaaaagaaaagtgtcccgggacccaaaggctttgcatttccaggttaaaaagtccaccagaaagtccgcccaagaatggaaattacccaaaccacaatgcatcgctgtgaaatttcacaattcctgaattaaacaaaggccctgaaagcttccagagcaaacagatcacataaacagctcaccagactggggctgggcatggtagctcatgcctgtgatcccagcactatgggaggccaaggcaggaggatcacttgaggcccagagttcgaggtcagcctgggcaacatagcaagaccacatctctaaaaaaac

SEQ ID NO: 1378 - DNA, 2423 bp, Homo sapiens
agagacttttgcctgtatacatggattactgttacttagcaggggcgaccggttggccaaagccttggtgtgcccttggcacaattctgccaagacccttaccctctcctctcctcagggctcccttaacccctctccccacatctggaaaaccctggatacattttctgttccatctttagttttctgcctctggatgcgtaaagcttcaacctgctggcttttagagggagaggacttgttaaaaaaaaaaaaaaagtggggtgtggggagagcagtgttgtgatctgggggccagccatgtggtaaaaaggagtagaggtcaaggggctgcttctgttccctcagtttagggtcctgggaggctgacgggtttgggcagcttttgggaactaggcagaagagagtcctgtatgggaggccggagtcaaggcagaagcccagtgcagccctctctaagccagcagggaagggtccccggggctgagagcccggacggaggaaaggactggtagaagagccaagacacggctagcgtggcaccccctccccaggaccacattctccagggtgagaagagcagccagccctctgcctcctgtcctcagtgacagccttctgctctctcatgcccacagaggagccaatccggctactgcgggaggtggtgctgttgacggatgaccggaacctgcgtgtgaaggcgctcacaaggaatgttcctgtacgggacatcccagccttcctcacgtgggcccaggtgggctgagggagccacactggggcccccccccccgtggaaccgttcctgaaaggccaccaggcgcccagtgtagcacggaagatgcccacgtgcctgagccaccaatccacccagacaataaaccatcctcttccaacccacgccacggccatgctgtgggggacctgctcctcacagagcccctcccaaggatcgggcggaagctgctgggaccctcctgggctgccaggatttagcagggaggtggctggctacagcaacagcagctgggcaagccagataggccgcccatgctctcagcctttctccctcccccgtctcattccaaggctgagggagggccttctcgcctggggacgcagccactttctccagtggagacagggcaggggttcagagtttccgtcagatgcagtgaaatcacagttccctttcatcttcagaacctctgtcgtgaatgtgttcaagaggctttggttaagtcaggaagaagtgcccagggtgtgtgtccccagtctccctgaggcctggactcgcccatgaacccaagtcggcttctagacagcatgtccctaacagcagccctgggcccccacctcttctaccatccaccccagacttaccacacacccttcctgctgctcctcttcctgcccttatcaacctgggtccctcacacttcgccagttgcgtccccgtggacagtcatgagtctagaggaaaggggcatctggtctcaggcccgtgctctcgggtggcctccacctgctccctttctcctcactggcctttctttccgtctagcttcctcttcaggaaatgtcctgactctcctcagctcccccttcacccctccttgcccgcctaccctccctccagaatagcccctcacccttcttccccttctagttgatccttttcacctccctgatccccttcatttcttcaccgcggttcctcgtcataggggttctcactctgaactttccctctctactacccatggcaggaacctagtacaggtctcccacccagggccttccaccctcggctcctgtgctgggagaaacttccaggcgtggacagcccagcctgaggcattccagtgctggggcaccgtcgcctaacctggtttctagctttgccctcactccccggaaaaactgacactgacacaggggccctttccttgcccctttagctggtacctcagtggggaggcttccttaccaagaatgagttcctgaaacccagggccagagacaaggacaacttaggggaagacggggttttcggtggagccaggggcaaatcttaatgggaccagtgggggataccccagagcccatggcctgactgcacagcctgcctggaggatgggtgcgcagctctgccctccctgaggcccaggactatgccagaagcgatggggtaccgtgtaggggagccaaggccagtagtttgggggtaggagtcccctagagtctcagaagactgggctctttggagtacagggtccccggcctctcctttaagattctctccccagctggaaggccgatgactgggtggtcgggagggagacccagctctcctttctgtcccgtttgcagcactggttttgtttccttaataaatttttagttatgaaacatacctg

SEQ ID NO: 1379 - DNA, 2729 bp, Homo sapiens
ctctacctgcctcagcctcccaaagtgctgagattacaggcgtgagccccggggcccggcctggagggatattcttgaagcgccttgagcagggaggcagcgtttgtctttatctgaccttggcttctttgggtcactctgtttctctttccgtgaataaaaagccagtgagcacacactgtgtcccaggcactcttctacgctctggggacatcaccatgaacaactagtcagagtccccacctccaggggccttccgttctggtggtgggtttggttccatggttgaatgcacccagctgcttatctgttcaataggcatctgctttattttaagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaattaaggagactcaccagagaataacagaggagctacaaaagtatggtgtcgacataccggaagacgaaaatgaaaaaatgttcttcctgatagataaggttaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcgttgcagaaggtcagagagaaggagctggaagaagaaaagaagaagaaatcctgggattttggggctttccagtccagctcggcaacagactcttccatggaggagatctttcagcacctgatggcctgtcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacgctctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcggggatgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgagtgtgtgcgtcctgtcggagccctgtctcctctctctgtaataaactcatttctagc

SEQ ID NO: 1380 - DNA, 1932 bp, Homo sapiens
tttaagccattttgggattgtgttcacagaacagctgaccagtttctgaagcgttccttagaaatgagggagcgagttctaggaccagatcaccctgactgtgctcagtctttgaataatctggcagctctatgcaatgaaaagaaacagtatgataaagcagaagaactttatgaaagagctttagatattcggagacgtgcattagctcctgatcacccttctttggcatatacggtgaagcatcttgccatcttgtataagaaaatggggaaacttgacaaagctgtacctttgtatgaattggctgttgaaattcgacagaaatcttttggcccaaagcaccctagtgtagctactgccttggtgaacttagctgttctttatagccaaatgaaaaaacacgttgaagctttgccattatatgaaagagcattaaagatttatgaagatagcctgggtcggatgcatcctcgagttggagaaacactgaaaaatttagctgtgcttaggtaagaatttttttcactttccttatacagcctcttttattcgaagtagctttgtcttagaatagcacaaaatatgtattactgaatgttttttcttagagtggggaggggttgttttttgctgactgacttcaagaagtactgaagtagtatccagaaatgaaatgaagcctgcatgatctattttgcagaggagcatatgtatgcatcatggcaaacagtgaaggatggtttatactacatctggctctgggagtaatatgggtaatttgctgtccccagagtgaagttgccattaagtatatgttgacttttgcttgctcatttgtatttttctcaggatgcagagaatacctaactttgcttagcaatttcactgcctctattacaacatggttttaatgatatccatatgagacacaaaaatactgatactggtagaaaggagaagagtttgggtgttgttttactggtctgcttgagtgaatacactggaaaaagaggggaaatgggcaaatatttacagcttctttttctgtatcccataaggtcattttgaattggtaagaggttatattctcattttaagagtttttgttttctctctcaaagctatgaaggaggagattttgaaaaagctgctgaattatacaaaagggcaatggaattaaaagaagcagaaacatcactcttgggtggaaaagctccttcacgccattcatcaagtggagacacgtttagcttaaaaacagctcattctcctaatgttttccttcagcaaggacaaaggtaatagcagcagttagaattctttgcaaatgtaccttaagacaaaataattaaacatttggaacatttgaatttgaaactttaaaaaatgttgtacgaaattttactacgtgtgatttaactgctatttgtatgaagttgtattggattacattaagttggaattgtgattatgtctgttttagttgtttaaaagaattttcctattatatggtatccaaggatgtagacacattagaattataagaagacatgaggagcaaatcatgaagagcggattggtctttgttcaacaagagctggcagagtagttaagacaaggagttcaaaaattccatgaatcttggccaggcatggtggctcatgcctgtaatcccaccactttgggagggtgatgcaggaggatcacttgaggccaggagttggagaccagcctggccaacatggtgaaaccctgtctctactaaaaatacaaaaaaaaattagctggacctggtggcgcatgcctgtaatcctagctactcaggaggctgaggcatgagaatcgcttgaactcagcaagtggaggttgctatgagctgagattgtgccagttcattccaccctgggcaacagggtgagactctgtctc

SEQ ID NO: 1381 - DNA, 2045 bp, Homo sapiens
ctgttctgatatggagctacaaggggcccaagaggacctgggcatttccctctctagtccccggaggaaccatgaaaccaggccaggaagcaaggctaagggcaggagcagcatctgtctccaggcgtctgtttggatggctggaggaaagctgaggctcagagcaagtgaacatctaacccagggccaccaacaagagctcagggattggaatctgggagaagatgcttcccttctcttctccaagagtccttttggggctggcaagttgatacaagctccagctcatgtcttcagacaatgctgggtccaaggaaatgcatggatctcctgcattacaaagtttgactccaagagaagcccagaagtggcttccagcccctcctacctaactgtgccccgccgttcaccacttcctgtcttcctgcgacccagtgacagatgtgtctgtgggggctgctacttgggaaagtccaccaggaggagagcatgccaatctctcctctcagatcctctgggggttactttccccacccaaactaggccttgatgtcaaggcctagttacagggatgtcaaactaggaggttgatgtcggtgtggtgtggaagatgttggggagaagctgcaggtgccttcttaccagctcttcctgaaaacttgtctctccccctccttgttagtctgttttataactcacactccagccggggggaagtaaaggagcttatcccgttcacagatcctgtaacccatggtggttattacctcatagctggtgcagtgttctttgagcctagcagtttggtttagactcaagtgtctattctttgcagtctttctggggttggtagcagagaaagagaagagaacaggtaattcgatcactcaggttattcgtgtgtaaaagttgaagccctaccacaaacgtatgagtggatgttatagtgtaataacctggacattgccaagacagcttcctcagggcttttgtttcctcaagcctacctgaaggctctcttctcagtcacgggggatggaattgtttcatccctggcttgctctgggcctcagtttccctattccaggatagtttccctattccctattctgcatcataaaaaaaaaaaaatacactcctgatagaagtcggttgatgcttttggcctgcagcctccttaaggttaatagtccacataatttcctcaggggccctggctggcctgttgtgggtgtacccatcaagtatcttgatttgctataataggagccaccttggcttcctgtggagataagccctgcccctcgttcccactttaagcttgaaaagtcccttatccaactttggaatgggaactagaaagactaagcagtgtctctcaggggttccttctggggtcactcagaagaggagaaccaagcagtcttggcggagagacacctgaagttggtcactcggcacattaccaggggctcagcaatgaccagcctgcaaccatcctgcctttccccacgggtctgggctccagccatggagggtggactggagactcctttgcctttcaacactgtctggcctgtctcgggtccggcacgtcttttctctactgattttgtggctgtggttaacttagctaacctttcagtgaaataatgtctagtggcattcctttacattttccatgtgctgttttttccataactccattttcttcagggctgagtttgggtcttcatttttccacccacaggcctagttaagcttggtcttgtgctccaacttacctgccccagacttcttggatggacattgtcaatctggtcatattgagagtgaaactgccacctagtggtcactggaggtgtgcctgccttttcatgagctctcttgctgctggttaccggaaacaacagttgatggttttcttctaagctaactcagaagctgtgatgtgaatcagaccaaacaatttatctgcttcaaatccatattgtaaagaggtttaatataaagacatattttcaaatcaaaataaataatgaagc

SEQ ID NO: 1382 - DNA, 2353 bp, Homo sapiens
gatgcccccctaccaccggcgagtcggcatggtccaggagctgctgcggatggtgcgccagggccggcgggaggaggcggggacgctgctgcagcacctgcgccaggacctgggcatggagtcgacctcgctagacgacgttctgtatcgctacgccagcttccggaacctggtggaccccatcacacacgacctcatcatcagcctggcacgctacatccactgtcccaagccgcctcaaggctgtcctggccggaagccccccagacaacacagtggacctgtcgggaatcccactgacctcccgagacctggagcgggtgaccagctacctacagcgctgtggggagcaggtagacagcgtggagctgggcttcacaggcctcacggacgacatggtcctgcagctgctgccagcactcagcaccctgccccgcctcaccacactggcactcaatggcaaccggttgacccgggccgtgctgcgcgacctcactgacatccttaaggatcccagcaagttccccaatgtcacgtggattgacctgggcaacaacgtggacatcttctccttgccccagcccttcctgctcagcctgcgcaagcgctccccaaagcagggccacctacccaccatcctggagctgggtgagggcccaggcagtggggaggaggtccgggaagggacagtaggccaggaggaccctggagggggccctgtggcacctgccgaagaccaccatgagggaaaggagactgtagctgcagctcagacgtgacatggaagtgaagggcctcaccagggagtccttgttgggtagaatgggcaaggcaggcaggggagggcgcttctcctatcaggtgggttaaggatattgccaaaaattggcctgggccacccacctacagaaaggcaaaccatagcatctggggaaggggatttgtgttaaaacttcccgttggtcctctgcatctgccccctatcccattatctgccatttggttctcaagtcatcccaggccccagagaaccctctcagctcagctcatggccttccccaaagacttgtggaaatgggcacatggctggaggtactgtaagcctgagccattgtgaacaccaagagctttcccccagaaaaagaatacagtagggcccctacatgtactgcattacatttttcatttaggggaacgagctccaaccagaggaatgtgtccccactcaaggaaggtgggaatctttagcaaaattcctgtaactcctggttgcccgagaccccagttccatctatgctaggggtggactgaacgtggcctacctccttatggagacccagccctatttctgaggcccaccttgattctaggcatctgcccataggaccagctatcgctatatcctttgacagagcagcctacgatgccatgtggtagtgctcaggacagacatggtgcccatgcatacaggcataaagtcctgttcagaaatcccctatccaccttccctacccactgctggctgaaaaactaccagacttctatgtgggctctgatgtccttagcatgcagggtaagtgacaaacctggcttccttcttgtcacttgccagtatgacttcactgacctagacaggccgtaagaactctttccccataactcttaagtaatccaccaacacattccagaaaaccgactgcagaaggtgggctttaaaaccttaaaaacctaggacaatgaaggagtccaatcccttggcagatccaacaagatggctggggagagggagaaacaaactggaggctcccaaaggaacctaacttagcaaaggttctcatcttataccctccccttacccaaatactgtcctactgaaagggccctaccagttaagggatctcttctaaataacaggcaacccctagatccaagtagttcagtccaggaagactgggagccaatcactcttgaaccttgtgggcaaacagtatgggggaggaccctcttgacaggccttggtaggcaagattccaacacaggaagacagcaagatggggcctagagtatggggccctacatgctgttaaggttgtggttaggaatggtgcaatgctgcaggagctggaacaaagctacaccaaggaacagagcacagagcagcaggggccgaaattgaggaggccttaaatgctttgagcttttgccttcagtctaaagctgtagaatagggggttaagagcttaggctgaccacagggaagtttacaagctagagcgaatatctggactgctaatatctgacaacagtaggcgaaatttactttttcttcaaatacacattttcaagaattgac

SEQ ID NO: 1383 - DNA, 1625 bp, Homo sapiens
gagagcgcgcccggcaccggcggctccccaggcccgcggccggctggcggcgcggagctgtcactgcggcaaacggcgaacgcgccggccccctcccccgccgcccgcaagcctggtgcagtcggcccatgagtatttcatgaagtgccgcagccggattcatggctcactggcgcaggaggggagagaggctgagtcctgtcaagcgccagcgccccacccgtcacggagcgcacgccgcgggggccaggctggggagggaagggtgtccagccctctcttttgggtggtgagatgctgaggcctgagggtttctagggcgcctagcacaggacccagctacggaggcaataaaaacttggtggagtctaagtcctgggaagggaaaaaaaggacggagggggcggggcctacagacaaccccgcccatcacaaagaccccgccttccagaacgctgacgtcacaatttggccccgcccctcattgtcagtcccgcggagcctgaggaggcgcctgtcgctggcagctgagcggcggaacccttcgctggcgggagcgcggttcggggccgcagaggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagagaatgaaacaagaaaccagc

SEQ ID NO: 1384 - DNA, 2116 bp, Homo sapiens
agagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgagatggcctaccaggtggtggagaagggcgcggccctgggcacgctggagtcggagctgcagcagaggcaaagcaggctggcagccctggaggcccgcgtggcgcagctgcgagaggcgcgggcgcagcaggcccagcaggtggaggagtggcgggcgcagaatgcggtgcagcgggcagcctacgaggcgctgcgcgcgcacgtcgggctccgggaggcggcactgcgcaggctccaggaagaggcgcgcgacctgctggagaggctcgtgcagcgcaaggcgcgcgccgcggccgagcgcaacctgcgcaacgagcgccgggagcgggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcaggtctgcctcagccacctccctgacgctgtcccactgtgtggatgtggtgaaggggcttctggattttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtcgactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggagccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctcctcactttttctcccaaagtagaaaaaaatgatatctg

SEQ ID NO: 1385 - DNA, 2517 bp, Homo sapiens
cacttgtcttcagaaaataaaagatttgttccacccgggtgtgtggacatggatgcgctcatcctgtgttctcagacagatttcagtcattagatgatgtttttaagtcctgagtggattaaagccagacttctgttggctccgttgcgacctctaagggagagagaaatctgggctccctggaatcacgtcccctgcaagagagtcccttggtccattctcgggccagaaaaaaatctccccatcactccagtgcgagtggttggccttgctctggtccggcactgtgtgcgtcgggaagtcggcctggagttggggttgcagggacgccacggctggtggcgagcgcagcaggagtgcctggagagctcgcggccagcggggagctgagcgcaaaggcggaggagggaagcagcctctgaggcttccccgcctgggagaagagtttttggaagtaggcgagacggggaaggagttctgagcctcagtccgcacagcctcctttccgtccctttccgggtgcaatctccgggccagcgggtgcgtgtcccgctgcagatccgctggctcagggatgaggcgcagggcaggttctgggttacgtccccacaccgcggggaacccaggtgcgagcggggcgcagctggcctgccaacatcctttcttagctttgcatccttcgctccaaatgctggctctgcccttggaaactcgctggttgccagcagcattcttcagagtccgccgggcttccttcaggcgtttggaggaacacgcctttgatctttgggtctgggcaggctgcgcgggcccaccctccttccagttcaccgaaagattaaccacctccaaggactatttaagagcccctctcagggccgaacggggagaaagggtgggaaaaggaggagagagcatccctttagaatgccccagagtgacgagaacagacttctcaaaaaacagtgtcaggcggtcttttgtacccagcactcagtgtagtgcctgacacctcaataaatgttgaatcatgaatgaatcattaactctttgaggctacaagatagataagatagagagtaatggggcaaagtgacaatgggctgttgtggttaaattgaacttgaacttgaacctcttaccttgaagtctgggcgcacatttgagaaaagaataaagcaagtaggtatgatgggactgggtgaaatcaggtggtggtggattgtttgcagcactcacgaaatatgctctctccttttccagtaaaatatattactagatgttaatttacatggcccgtagactagaatcattagtttaaaatgtgctttgataatgaaaatggtttgagacactaagcagattacatgaccttattttaaaattaatccagttggtgatgaggaagtaatgtattgcttttcacagatgtaggtgagacactggtatagtggaaagagcttttgactgagttcttggacaagatactagacctttcaggaccttggttcttccatctctttaaaatgagtataataatgactacttttgtgagataatgtgtaattggacaatgcctggaacataatagacactagttaatattgggttcaagcgattcttctgcctcagtctcccaagtagctgggattataggcatccactaccatgcccagctcatttttgtatttttagtagaaacgcggtttcaccatgttggccaggctggtctcgaactcctgacctcaggtgatccacccgctcggcctcccaaagtgctgggattacaggtttgagccactgcacctagtctttttttttttcttaacaatcatacttatcctccctaaaagaaaaactctccctttctgtacagtcacaacacttctgacaccaaatgtgtggagttttcccacatacaaatggattctccaattctctatggacaccaactgggtgtcctacaattcaattctgatgctaactccttgctaatttgctataacagctcacaaacacttatttacagttactagtttattataaaggatatcacaaaggacacagatgaactagtttattatttacagttactagtttattacaaagaatagcttattataaaggatattgcaacagatacagatgaatagccagatgaagaagtatatagagcaaggttttaaagggtcctgagcatgagatcttctgttcccatggaggcagagtgtcccaccctcccagtaagcggatgtgttcaccaacccaaaagcactctgagccttgttgtttaggggttttgtggagatcccattacatagtcatgattgattaaacaattggccataagggattgaactcaaatttccagccccttttccctccctggaggtgaagtggggctgaaaatgctgaccctctaatcacaaggctggttcctcaggcaaccagttgctataccttagctgtctatggaccatgcagtgattccagccaccagccatctcattagcatgc

SEQ ID NO: 1386 - DNA, 1934 bp, Homo sapiens
aatactagccgccaggagcgttgcttctcaacctaggattcccgagggtctgtgccactctcatctggccaggagcgccctagcttgagatccacgagccgagagtagggcccacttccacccctacccctttttcccggggaaagggaaaagggaccataggcccgggtggggtagaagctgggggtcatcacctgtttaaagacgctgccatgtcttaccttgatgtaagacgacgtgtcggggactgtctgaaacatcgtgggtagctaagggtcgggaacgcccaagaaccagcctgggagggagaagcctcggttacccgcgagtggagcgagggagagacggtgggatggtgatgaagtggggatgcagatggagagactgtaggggtttgggaagctcagatccgcctagtccggcgagggagggtccgagtggttgggtgttgagcactctccctacgcctcagtcccgtccccgggcttcaggccaggggacggtgagaactgagagccacctcacaccattgggtctcctccctacagtccttttactctcccctgcccgaaatcagactgccgcctcccccagggcctgggcagtttcgaactggggatgcccgcagcttgttctggaaaccagggtgttctagttcttggtgcgtgttgaggagagaacgcgaccaggacagaggaggatatggccaactccctttgtcacctggagccttcaattcaccggaagaaaattgctgaaattggcaacagctgccatgaaacaggagcaagagagaggcagctgggggcagggaggactcattaaagccaacttacccctcaaaagggagaatggggtggggagggggttcttgccccacagttatgctccctcgccagcctataccaagctgcttccctgggccatagatttgcaatgcagagcctgggtagaaagagactctcgtgtggaggttacagcagcaagagattggaatccaagaagggcactccagtaggagagcaggagaagatatctgggcagtgcccctctgaatcatccatgcactccatcattctgagcaagacaattaggacttagcttccttctttggcaaatgagagggctacattatatcatcatgaaatactttcaaatttgaacatgctatacttctgtaagattatttagcccggggaaaggatatgaacataaggcaaattaatgttctaggattaggaactttgggttccagtcttggttgtgctcctgatgacgggcactatgggctgaattttatcacttccaaattcacaagttgaagccctaagctccaatacttcagaatgtgacgctgatgggatacagggccttagaaagggtgaacaaggtaaaatgagatcatagggtgggccattatccactatgactggtgtccttataagaagaggagattaggtcacagacatgtgcgattacagaggaaagcccgtgtgagcacacagtgcaaaagcagccaccgactagccaagaagggagacctcagaagacatcaacttgctgataacttgatcatggactttcagcctccagaacttcgaggaaatcaatttctgatgctccagccacgaaatctatggtactctgtatggcagctctagtaaaccaatacaactgtggaataatattttgccatgatttggtttctccaagtaagtaaaagggaataaacaatggtgactcgtttcactcaaccctcctagaacctactctgatgatcagtatctattatgaacccacaatgtgttttgttttgtttgttttgctttgccatgtgtggctttgtgtataaagcaaagcagtgctcctgtctttatggttcttttcactccacataaaatccaaaaccaccctgaaaaaaaaaaaaaaaaaag

SEQ ID NO: 1387 - DNA, 2010 bp, Homo sapiens
gatctgcacgggcgcagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtgggaaaacggctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggtccgtgaaagtacggggctgcatggacaggggcccacaagggttgagagtgtggagggcccggccagggccgaattggggcctttcccattcccccacccacatgaacacacaccttaccaggctgaaccagtgcagagaaagtggcagagcctgtcaggcaatggctggctcacgtgtgtgggaggagtggcgggctacgtggtgggcagaaggccctcttggaggcctggccagcttaggggaaccctcatcaggggtgagatgcaagtactatccagacctgcattccaccccatgcactcagtctcccatgtctcctctttgtctcctctttcctccacccccatcccccaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaat

SEQ ID NO: 1388 - DNA, 2274 bp, Homo sapiens
tctccacaaactgcccaggagtgagtagctgctttcggtccgccggacacaccggacagatagacgtgcggacggcccaccaccccagccctccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 1389 - DNA, 2162 bp, Homo sapiens
ttctgaaattgtcatttggattccagtttctggcatatgaagaaaactcagtcaccggggtcttatctggttgtctcaacaactctgtgaaataagagtttttattcccatttcacagatgaggaaactgaggtctagagaactggagcacaagatcacatggaaagctgtgtggaaattttgtgccctgactctgattcccctcttccttctgcaatgtcatgctgccccctggcctctcctctgacagaacaggggcctgcctctcaaaatacacccccactgcccagatctccagggatggccagggcagtttttctgaaatggagagagaagtcgaagcagccagatggcttcagcctcagccccccacccggcctggtttacctcttccctagggtcttcaagctatcaactacagcaagaggacttggggttcttttcccaacaggaagaattccctgcaagtaaagagggcctgaccctgggccaatcatgccacctgtccctgggtttgggtccccacatctgagtctgggacaggggaacatcttgtgcagaagaacttaggggtttttgcacagagcccggcccacaggaagtccacaagaaagcttggcttagatgatcaggagcaacattcttatgtcaactacgaagtgtagttgtcagtaacaaaacagcaccagaagccagtacagatgggagcctaatgtttgctcccaaggtgggctgctgttttctgttcagggcctcatattgcagaaagttattgagtaactgctcagagaaggggctggagaatgagggacttagcatctccctgtgggagggaatgaggtccccatcctgaaaatagcctggcacagccaactaagctttcaaatgtcttcggggtcaatgttttatcttaaaatttgattcaaatgttagaaaccgcttcctaatacctctgtggttgttttaatacacacatgtttaaaccgactttatcctccactgccccccagcactccatctaaaaattaatgcttctggaagttgtcctacttggttggtgactttccgtacaccctggaactcccctggggatgcctgtgcccacttggtgaaacctagaatcaaatggtagctaaagatgagaagtcggttttggccagagcttagggtgcgtgaaggagcacagtaggagatacatctagaaaggcagattgaaggcagattgtagcagggtttagaatgctgtgttagtctgttctcatgctgctaatgaagacatatctgagactgggtaatttatacaggaaagagttttcatggactcacagttcccatggctggggagccctcacaatcatggcgggaggcagaggaatggcaaaggcacatcttacatggcagcaggcaaggcaagaagagagcatgtgcaggagaactgccttttataaaaccatcagatctcgtgagacttactcactatcatgagaatggtatgggaaaaacccacccccacgattcaattacctccctctaggtcctcttatgtcacatgaagattattataattcaaggtgagatttgggtgggaacacagagccaaaccatattgaatgccaactccagagcaggacctttcataccacacacagtagggagctactgaaagttcctgagcaggtgagtgacttgaacagaacactgacattttccttggctatttgtttcctcagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgtccccagagcctgccattcacgtttgccaaggaagatggccgacactctctgagtgtgttcactgttggctgcattggacaatcacatacaaaccctggcatgtccttccagaaaaaccagcttatcatctatcaagctccaaccccttatacagctcctctggtggaatccatgactcatatgtttaacctacaataattcagctatacacattcctgtagaacaaatgagagaaataatttaaatggcaaggactttgcctctggtctcc

SEQ ID NO: 1390 - DNA, 2390 bp, Homo sapiens
aatgtatgaattatttactaatccaaaaagtaagtgaggagtcagctttcttcctgacggttttcctttcacttttcctcttattttctttttctttctttgtgacagcgtctctcactcttatctcccaggctggagtgcagtggcacgatcatagctcactgcagcctggccctcttgggctcaagcgatttccccaccttagcctctcaagttgctgggaccacagtcctgtgccaccaggcctggctaattttttatttttcatttgtagagacagggtttccctatgttgcccaggctggctttgaacgcctaagctcaagcagtcctccccctgagtggtaggatgacaggtgtgaaccgccactcaaggcccccacttttccttttttttttttttgttcggtttttttttacatttggttcctcagagaatataaatactgtttacatacgtaatatagaacaaagaaaatttgtacttaaaaaagcaacgctatggtaatagtgtatgtgtaccaattagtgccagattcatttgttttttcatggaatagaaagtgttcttacatttttatcagtgctgctaatgtggggtgggtgggatttagtttctcagaagaaaagaccgataagaaaagggagataaaaccagtataatctcttgtgtgcttttcaccttcgaggtacatttctggcccgacaaaaactactgctcttctggtttctaacaatatggaggtccttagaattgacttaaagtgtttgaatttattcaaatacagattctgtatttagtggaattttgtaccacaacaagtaagattatagtattggagggaagaaagtctggtataaaagtgtactttactgtccatacatgaggaagtgacataatttatgttttcaaaatctggagtaattctttgtgaaaaagattttgtaagggtatgggaagttgctgtttgctgcttccctgtgttctcacagcaatctgctaataagtgtaactcagctattagaagtagtaaggacagcgttgtagactgattaggggaaaagccagtgtgagttaaaaaaattactttttaacattttttaaaaagaacttatttttaagcaaagtttatatggtaaactaaactaagctagttaacatgagtccctaggcattctgttctaatgtataggtaagaatgactttagtttgtaattagtgtggtcaaaagaatgtaaagaaatgttttaaaatactctgatactgcttaaatttttattttcctaggtagtttagtattctctcattacctgttttggtttaaaaaaaatctttcggtaatgcaaagataaacttttggctatgcgttatctgagttacgtattctgaatcatttgaattcaaatgtagtaggtattaactattaaatatgctccatatatgtgaagtatttttcccttctaagtgcttatagtgactgtgtgttggctgtcttttatgagagccttcctagcagtttagattactgctgattatttctttggaatgaatattctttaaagctcataagataatgcttttaccaatacaaacactttgtgtgacctgccagatttaaggaccatagtacagctatggatactgaaccaaacccgggaacatcttctgtgtcaacaacaaccagcagcaccaccaccaccaccatcaccacttcctcctctcgaatgcagcagccacagatctctgtctacagtggttcagaccgacatgctgtacaggtatttcagctgtagtgatgggtagtctaagacttaagatgtcatattactttttgcttaagctggatttatgtattgtttcatattctcaaatgtacagttagaattactaatgtttcaatcaactgtctcaatccattttgtgtggctatagcagaataccaagactgtgtaattgtaaagaaaagaaacttatttcttacatttctggaagctgggaagtctaatatgaaggagctggcatctcacgagggccgtcttattgcctcattccgtggtggaagactagagagcaagataccaaatttgcagcctcaagcccttttaaaatttcctttagtcggccgggcgcggtggctcacgcctgtaatcccagcactttgggaggccgaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtgaacccggaaggcggagcttgcagtgagcggagatcgcgccacagcactcccgcctgagcgacagaactagactccgtctc

SEQ ID NO: 1391 - DNA, 2289 bp, Homo sapiens
tgtattgcatttaatgtgggatataggtgcgttttgctgaagtaagagaacccaagaccaactaagattttaagatggctctgaaggtacttgtctagtacattaggttgcaattttcctctttatttgcctgtttcgaattttctagtcttcctctgcttttctccaatctcagtttttccatcaaataacattctgattgtctctgcatgtctttcagtacccaagtatatgtgtattttatcatgtctagaatgaggattttcacatttcatcatctctaaaattgtgatgcatcttacaaattgatggaatatcttattagaagcatttttatcttagcatttcataagataatgctgcagcttacggtggacagtgtcttagatctgatgggatgtaagatatctgcatttgaagatatgaacttcttggagctggctaggtgcctttttctttcttcccatctacctttggcttcggtttcttcttaataatatttgtttcatctttctagtttaaaaatcattctgctctctttgcccctttttctcctttcttctgcctgccttcctgttcccctttttcatctcctgtatcctcctttggtctcttaaagtctgaccacgttcccagggccttcactgatcagagctctttttttaaaggccttacagcctgatggtggtgccacccgacaaggtgaatcccgagcactacatcttctctccctttgggatcttgcacgtacatcctgtggaaggtagcgagacgatgacactgggtacctggcaccatcactgtgttctctggcagcagctccagttcattccattctttaagtattgcctcttacgcaagtcctttacctgttggaagaagaatgtgagattacaggggctgcatcgactccagaaattcctagagaatcatctgctcttggctgtgccccactttggagctgggctactccatattagcaggcttctgcaggagctacactctgtgtcctggctaccccaggaactggatcggtgctatgagctgctggacctgcagacggctctagccgaggagaagcataaggctctacggctgctccatcgttgcctaaacctctgcacatccattcttcgactggttcacgaggacacataccacatgcaacagtgcctacaggagcgagtacaaaactgtgacaggatcaggacaggccaaggctccatataccttcagagggtacagcacaagcaactggagcagaagctgaagcaagcagaggcctggtggctgcagctgggaaagtttgcccgcctggttgactacatgatttgtcagagcctcatttctgtcttggaagagcagataacctcttttgtggccaacatccttcaagccccaaggcagaaaccctttctctcatcacagctggtctttgatgatcatggtcaactgtctcatgtgccctgtgttgaaaatatgatccagactctaactggaggcctacagtctgtcaagacctctgccttgcaggtattctgaattgggcagagagctggctgtgggaattcccagttcctatcctctgagtaatcagaagctcacaacctggtttgaatccctcattgctttcccatttctgccccttctccatatcctggcatgaaggtagtgcagtctgcagacctgaagacctcctcggattccctgtattctgaaggtatttagggagacctaggcagggggtaggaaggctgaaggagggaaagggcacaagtactaatggcatgggaagaaggcaggaggtccaggctatagagtcaggcactgggtgtggatggagcagctctaacctgggtactgcacatatgtgttgtgggtagaaaggtcagggaatgtttttgctcacaaattcacgtggttatgtgtatgtgcgtgcaatgagagggtgtatgaaagagtgtgagtacattgtccttccaaacctgattcatcccaaactctgtgaggtttttctccagtgccataattgcatttcatttactactgaattttattgctaagtaaatttgtacttgtttgaagagctctgcttgctcaacacttgctttatgtcatatagctctttttcatttcatatggattaattcattgtattgaaatattttatggttaccaattattattggttatcagtcttcacacttattaaccatcagcgtggaaacacatcttcacatttcccttatttaggatactaatgctgtcacaaataaaatcattaaatgc

SEQ ID NO: 1392 - DNA, 2468 bp, Homo sapiens
ttaagtaagcttcgtctgacctctccacatccttggttcctctccagttgtgtcgggctgtttgccacacaaatgagtgccagcctcgcccttaccacagcccctttgctcctgtttattctcctccacacctggcctatcctgactcggagagtgcagctccctgccctcctgccatactcccccagccatcttcccagtcccagctggcatcagctccccctgagacactgcccgatggcatcagcctttattcctcccctcctcctctgaatctatctctgataatttaacaactaatcactaagttttattagtttgctgttttatttgcattagttgtttccctgagtttctcacacactccttgcaagcagagtccaggagttctttggcatctcccacagcatctagcacagcactgagcaccaagtcaactcaatcaaagaataatgaatgattgatggagtatttccatcctgagattgtgcacctgctgcctgcctgccctgtatttggatgctcttgggagactgtatagattggatcgatggtcttcatttgggggttgcttatggcttggattgtggacctgtagagccatcgttacacctgcagggaaatatggctagagtgtggtctgagtctggcaggattatccaggcatgctgtgagctttgaagggtggcacttgatggagaggaagggtgaaaggaacactcagaggcaagagtgggtacatgccaatacccagggccctttgtcctttcctgggccctgaaggtagaagagccatccagctatcctgggagtacctttaaactggtcccctggatgggagaacttgagattctctgggagggctctgggcctgctttgatgtctctgtgcctttcctccaggctgaggatgtcaccttcctctaccacccctgtgcccatccctggctgaagctccagcttgccctcctggcctatgcttgtatggctaacccttccctcacccctgacttcagcctcacgcaggatcgggtatgtagctgatgaaaggcgcttgcctggccctggcagaaggctatggccccgtgtgcagggaatggaaaattcaagggtttcctcttgcttgtccccaccttcctcgtagctctaacagttacctcctctcgtagcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggtgagagacgctgggcccaggcttgttggccctcgggttctctgagaggggcagcagggtgattgctctctctcctctccttaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctggtgaggagttccctccctaccctacccgaggcccccgccccacctcgcgtcgcccgccgccccccgtagcttccctgccctcccgcccttgactgctcggcgcccggcccacagctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtag

SEQ ID NO: 1393 - DNA, 2095 bp, Homo sapiens
gatcagggagtatcggctgcgggtgcgcaaggcgtccaggagtgacctggggctgtggagagcgacccgtggccttgtgtttcaggtacggaggttccggactggacgggcgtcaggaagtcacagacttgtcctctgatgtggccccgcccgccgccgcactaatctcttcggcgtcgtacccgtcggcccagctcgacccgccgcagccccggccccgaccgtggacactgggggtccccgagggcgctgcgacctcctcccggagtttaccacctaggatgacttcagtgactagatcagagatcatagatgaaaaaggaccagtgatgtctaagactcatgatcatcaattggaatcaagtctcagtcctgtggaagtgtttgctaaaacatctgcctccctggagatgaatcaaggcgtttcagaggaaagaattcaccttggctctagccctaaaaaagggggaaattgtgatctcagccaccaggaaagacttcagtcgaagtcccttcatttgtctcctcaagaacaatctgccagttatcaagacaggaggcaatcctggcggcgagcaagtatgaaagaaacgaaccggcggaagtcgctgcatcccattcaccagggcatcacagagctcagccggtctatcagtgtcgatttagcagaaagcaaacggcttggctgtctcctgctttccagttcccagttctctattcagaaacttgaacctttcctaagggacactaagggcttcagtcttgaaagttttagagccaaagcatcttctctttctgaagaattgaaacattttgcagacggactggaaactgatggaactctacaaaaatgttttgaagattcaaatggaaaagcatcagatttttctttggaagcatctgtggctgagatgaaggaatacataacaaagttttctttagaacgtcagacttgggatcagctcttgcttcactaccagcaggaggctaaagagatattgtccagaggatcaactgaggccaaaattactgaggtcaaagtggaacctatgacatatcttgggtcttctcagaatgaagttcttaatacaaaacctgactaccagaaaatattacagaaccagagcaaagtctttgactgtatggagttggtgatggatgaactgcaaggatcagtgaaacagctgcaggcctttatggatgaaagtacccagtgcttccagaaggtgtcagtacagctcggaaagagaagcatgcaacaattagatccctcaccagctcgaaaactgttgaagcttcagctacagaacccacctgccatacatggatctggatctggatcttgtcagtgactttatgagagtttctgccacaaggtgcccaagaggagaggaatgggaagagtgccccagcacgtggtgactgcgtgatttctgctcgttgcctttgaagataactggcaggactgactgtagaacactttgacttttttcaaaaagtgatggaatttgtacatccaaatgaatattgtatagacaattttcccaggaatgtgcaaaatgcttgaaagttcaaacttcttttttgaaatgatcttcagatccagtggcccattcttttatctttatcctgtgaaggtgtttttcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaagaaaatg

SEQ ID NO: 1394 - DNA, 2099 bp, Homo sapiens
agttccctgccctgccccgggcccagggcgccgcggtctgaactctgctcggctggaggactcgtctccgagctccgtcagaaatggggaacttgcagtcggagccatccgcgggcgggggctcccgaaaagtgcagccctcggaccgcgcccccgactcccgccggacgtccctggtggagcccgagatgacctcccaggccatgcgcctgactcgtgggctgggtgtctggttccctggcagcgccacacccccgggactcatggtaccccgggagccccaggcctcaccctcgaccctgcccctcaccttagaacggccctctccagtgatgccccctcctgaagaggcggccgcggtctctgcaccacccccggcccccgcggggactctgctgcccggcccgtctaaatggcaaaagcccgcgggcactccagttccccggatccgccgcctgctggaggcgagccatcgcggccagggcgaccctccgagcctccgcccgctgaagccgccgccgccgccccggcaactatccgtgaaggacactgtcccgagggccccatcccaatttccgccgcccctggagacttggaagccgccaccaccattaccttctgaacggcagccggcggaccgcagaatcactcctgctctggccacacccgcctcacccccgacagaaagccaggctgggccccgcaaccagggccagacggccggcagggctcgcggaggggcgcctccccatgcgggcgaaggcgaaatggcccagcctgcggattccgagtccggtctgagcctgctgtgtaaaatcaccttcaagtcgaggccctctttggcccctccggcagcctcgagttccttagcagccaaagcttcgctggggggcggcggaggcggcggcctctttgctgcctcaggtgccatctcttacgccgaggtcctgaagcaagggcccctgcctcctggagccgctcgccccttgggagaggtttctcgaggggcacaggaagccgagggaggtgatggagacggcgaagggtgctctggtcctccctcggcgcctgcgtcccaagcccgggccctaccgccgccaccctacaccaccttcccaggctcgaagcccaaattcgactgggttagcgctcccgacggccctgaacgccacttccgcttcaacggggctggcggaggcatcggggcgccgcgacggcgtgcggccgcactctctgggccttggggctcccctccgccaccaccagagcagatacactcagctcccgggccccggaggcccgcacctgccctgctggcgccgcctacgttcatcttcccagcacccaccaatggcgagcccatgcgcccggggcctccaggcctgcaggagttaccaccgctgccaccgcccacaccgccgcccacactgcagccaccagcgctccagccaacgccgctgccggtggctcccccgctcaccccgggtctgggccacaaggagtcagccctggctcccaccgcagcccctgctctgcccccagccttagccgccgaccaggccccggccccatccccggctccagctcccaccgtggctgagccctcgccgcctgtgtccgcgcccgcacccgcggctgcgcccatcaagacccgcacgcgcaggaacaagggttcccgtgcagcccggggcgcgacccgtaaggatggcttgcatggagatggtcctcgcgaacgagctacagctaccgtgcctgacagcagtggtggagggggtggtggcagcggggcctctcagactggggcagctaacacccgcgctgcgcgccactggctgcccttccaggtgcttaactcctgtccctgcaagtgttactgccaccaccagccacgccatcgccgcctgccacgcaacgtctctgcctggctgagcacatccaccaaccacctgggcgagccaccctgggttgccaccatcaagctgtccggctctctggtggccaagctggagcactacgacttgcaggccacccattccaactgagtgtagtcggctcaacaccctccaccttcccctccatgccaataaaataaccaatcc

SEQ ID NO: 1395 - DNA, 2664 bp, Homo sapiens
gtagaatccagccagtcagagagcaaatccttggcttcttccagcaacacctgaagagaaagaaacaaaaatccagcagcgggccacacacttcacatgagaacatctcgtgcagctggtgtgagcccatcagtgccctgaattcaaaggtgctgaccttgacctgtgaagagccaccgtctcctagggagactgtgatgcttacacaactggctcggcagggacaaatacaagactctacaaatgggcaggtctcacatgaactcagaggagcaaagccaaggggactgtgggtgcagaggcaaaaagaggtgggagggccgaggtgggcctggtgagcatgtgcagcctacctgggccgtgcagggcagggttatgggcagaggctgggcaggagcacacagtgtgtcacctacagcacaaccccttggtgcattcaggaaaagattcatgacggacacagccagaggttaggagagataggcagggcactggtcccagaggtctcaaaagccccatctccctgacgccattgactgaagatgccatccccacttgacacaccatggaatgggagtaaaaaccaccaatcccagcaaaacatggcacctatgtgaaccaggtcctgaccacacacactctaggcatgagacacgccccaactgcactcatgtcagaaaagagaaatgtctaccctccgccatcttggagggacctagagtctcaatgcactgacgtggacccaggacagggcgtggcaccaagcagatggtctgtggcctactatgggaaggggaggcaaagaaccaaggctggagagaaaaagtgtaggaaaatggcctggcagacagcgaggacacagggtggacaaagccacaacacagacagagaaggggcacagggcccacgtgggccaggttcctgatgcaatccctgcctacagctcctgaatcaaacagatgtgttaaatgtattgcaggcctgcaagtggcaaggcacgtctgcaggaatgagcacaccctccccaccgcggcagggcatccagtgggcagacaagcaccaaaagcagggtgtgcgctctggggagcaaaggctgccaagtctgctgcccgaaaagcaaacactgggcctgccccaagtacagggaaacgcgcatcctggccctcaggatcaccaaggtcacgacccagcaagaaccgacatcctaatcgaggtcaccaaacacccaagaacatgagcaactgtgaatgggagtcagcagaaacgacaaacagatggacgcttcagatggaggagttatcagatacataataaaatccagtaaatattacaggcttaaagacataaggacggactcccagatgacaggcaatagcaagcagggacaggccagcaaagcggcccagctggatctgaagatagaagcaaacggaacctgcagagatgaaatctattaacaggcgaaacagtcttatccatcctactgagtgactgtttcacttcctgtctgaaggagaatttgtgaacaggaagacagaactgaagaagtcatccaaaatgaaacagagacaagaaggaaaattttatgaaagacaggttaggagacacggagaaggatgagatgaaatgatgagactcacatctaattggcaacccagaggagaggagagagggaatcgagtaaaggtgatacttgaagacacatctgagaatttctcaaaacccatgcaacaatccagccccgggaagcacacaaaatatccaataggataagtaaaaacaaatctcttacaatgtctttgtgaaatagcagaaaactgaaaagagagaatacttttataatgcgcctgatagaaaagacatatttaccgatcaaagaaaagtaatttgaagggcagccgatgttttcaacaacagccaacaatggaagccagaagacggcaaccaccttgaacaaacagggaaatatacacacttcaagatagacaaaagctgcttcccaccaatacttctaagataatgtttctaaaacttgcctgatgatagggctggaatactcaatgttgctggtcaagcatacagatcaacaatcaaaatgcataaatacaaaatgataagagacttctgctttccagtttcacataagtcaggagcttggaagttgccactctacctaacaacaggtctctgtagcagatctaagatctttgtggacctaagatcgctgctgtggatcccaatggctctgacttctgcgtgcaactgcagaagctgcagggacaccccgcggtggacctacctggcgtgccccatgtgagatgcgtcatagacggttggcccacagcaataccacgtcacctttttcccatcttgaggtatgaacacttcctttgttaggaatgaaggaatgacgatcacaagaaatgcaagaaacactgcacaggattaccaaaaacagcaacaaacatcacagtgtggtttgtgtttagtgtaaacaattcaacagagaccattttgttttactgtgaaaagtcacagtctcagtgggagcccagtgagatgtacggcacctcccaccaactgagccctgggtgggtggggcctcttcctccctggggttctactcatctatggagggagacgataaagggaatcaatgatttt

SEQ ID NO: 1396 - DNA, 2042 bp, Homo sapiens
agactgctgtgctagcaatcagcgagactccgtgggcataggaccctccgagccagggatcagtgtctttcaatgatgtgactgtggacttcactcaggaggagtggcagcacctggatcatgctcagaagactctatatatggatgtgatgttggaaaactattgccacctcatctctgtggggtgtcacatgaccaaacctgatgtgatcctcaagttggaacgaggagaagagccatggacatcatttgcaggtcatacctgcttggaagaaaactggagagctgaagactttttagtgaaattcaaggaacaccaagagaagtattctagatcagttgtaagcatcaaccacaaaaaactggtgaaggagaagagtaaaatatatgaaaagacatttactctaggcaaaaaccctgtgaattcaaaaaatctacctcctgaatatgatactcatggaaggattttgaaaaatgtttcagaattaatcatcagtaatctaaatcctgcaagaaagagacttagtgagtataatggatatgggaaatcactcctgagtactaaacaagagactactcatcctgaagtcaaatcccataatcaaagtgccagagctttcagtcataatgaagttcttatgcagtatcagaaaacggaaactccagcacagtcatttggatataatgactgtgagaaatcattccttcaaaggggaggcctgattacacatagtagaccttacaaaggagaaaacccatctgtatataataaaaaaagaagagcaaccaatattgaaaaaaaacatacatgcaatgaatgtgggaaatctttctgcaggaaatcagtattgattctgcatcagggaattcactcagaagaaaaaccctatcaatgtcatcaatgtggaaatgcatttagaaggaaatcatatctcattgatcatcagaggactcacacaggagagaaaccctttgtttgcaatgaatgtggtaagtccttccgcctcaagacagccctcactgatcatcagagaacacacacaggggagaaatcgtatgaatgtctgcaatgtaggaatgccttcagattgaagtcacacctcattcgtcatcagagaactcacacgggagagaaaccatatgagtgtaatgactgtgggaagtccttccgccagaagacaacactctctctacatcagagaatccatacaggtgagaaaccctatatttgtaaagaatgtgggaagtcctttcaccagaaggcaaatcttactgtacatcagagaactcatacaggggaaaagccctatatttgtaatgaatgtgggaaatccttctcccagaagacaacccttgctcttcatgagaaaactcataatgaggagaaaccctatatttgtagtgaatgtggaaagtccttccgccagaagacaacccttgtagcacatcagagaacacatacaggggagaaatcttatgaatgtcctcactgtgggaaggcctttagaatgaagtcatacctcattgatcatcaccgaactcacacaggagagaaaccatatgaatgtaatgaatgtggtaaatcattcagtcaaaagacaaatctcaatctacatcagagaattcatacaggggagaaaccctatgtttgtaatgaatgtgggaagtcctttcgccagaaagcaaccctcactgtatatcagaaaatacataccggccagaaatcctatgaatgtcctcagtgtgggaaagcctttagcaggaagtcatatctcattcatcatcaaagaactcatacgggagagaaaccatataaatgtagtgaatgtggaaagtgcttccgccagaagacaaatcttattgtacatcagagaactcacacaggtggagaggatggcctaactggatgtttatcctagcgtcaacccaccaaagatttggggaacatgtgagtcacattctctgggacattctactcccctttgatcttgcatttccagacatttcagtggctaccacaaaaaataaaaagtatctgtggc

SEQ ID NO: 1397 - DNA, 2680 bp, Homo sapiens
aggctgtcctcggagggagacattccatctccagacacccagagacgctccagaatggaggtcctgagggagaaggtggaggaggaggaggaggccgagcgggaggaggcggccgagtgggctgaatgggcgaggatggagaaaatgatgaggccagttgaggtgcggaaggaggaaatcaccttaaagcaggagacgctcagagacctggagaagaagctgtcagagatccagatcactgtctcagcggagctcccggcctttaccaaggacactattgacatctccaagctgcccatttcctacaaaaccaacacacccaaggaggaacacctgctgcaggtggcagacaacttctcccgccagtacagccatctgtgcccggaccgcgtgcccctcttcctgcaccccctgaacgagtgtgaagtgcccaagttcgtgagcacaaccctccggcccacactgatgccctaccccgagctctacaactgggacagctgtgcccagtttgtctccgacttcctcaccatggtgcccctgcctgaccctctcaagccgaccatcaagaaggaggaaaaggtgctgcctaagaagtataccatcaaaccccccagggacctgtgcagcaggtttgagcaggagcaagaggtgaagaagcagcaggagatcagagcccaggagaagaagcggctgagggaggaggaggagcgcctcatggaagcggagaaggcaaagccggatgccctgcacggcctgcgggtgcactcctgggtccttgtgctatcggggaagcgcgaggtgcctgagaacttcttcatcgacccattcacaggacatagctacagcacccaggatgagcacttcctgggcatcgaaagcctgtggaaccacaagaactactggatcaacatgcaggattgctggaactgctgcaaggacttgatctttgacctgggtgaccctgtgagatgggagtacatgctcctggggactgataagtctcagctgtccttgactgaagaagacgacagtgggataaacgatgaggatgatgtggaaaatctgggcaaggaggatgaggataagagcttcgacatgccccactcgtgggtggagcagattgagatctccccggaagcatttgagacccgctgcccgaacgggaagaaggtgattcggtacaagagggcaaagctggagaagtgggccccgtacctcaatagcaatggccttgtgagccgcctcaccacctatgaggacttgcagtgtaccaatattttggagataaaggagtggtaccagaaccgggaagacatgctggagctgaaacacataaacaagaccacagacctgaagacagactacttcaagcctggccacccccaggctctgcgcgtgcactcgtacaagtccatgcaacctgagatggaccgtgtcattgagttttatgaaacggcccgtgtggatggcctgatgaagcgggaggagacacccaggacaatgacagagtactatcaaggacgcccagacttcctctcctaccgccatgccagcttcggaccccgagtcaagaagctcactctgagcagtgcagagtcaaacccccggcccattgtgaaaatcacagagcggttcttccgcaacccagcgaagcccgcggaggaggacgtggcagagcgcgtgtttctggtcgcggaggagcgcatccagctgcgctaccactgccgtgaggaccacatcacggcctccaagcgcgagttcctgcggcgcaccgaggtggacagcaaaggcaacaagatcatcatgacgcccgacatgtgcatcagcttcgaggtggagcccatggagcacaccaagaagctgctctaccagtacgaggccatgatgcacctgaagagggaggagaagctgtccagacatcaggtctgggagtcagagctggaggtgctggagattctgaagcttcgagaggaagaggaggcggcgcacacactgaccatctccatctatgacaccaagcggaatgagaagagcaaggaatatcgggaggccatggagcgcatgatgcacgaagagcacctgcggcaggtggagacccagctggactacctggccccattcctggcccagctcccgccaggagagaaactaacatgctggcaggcggtgcgcctcaaggatgagtgcctcagcgacttcaagcagcggctcatcaacaaggccaacctcatccaggcccgctttgagaaggagacccaggagctgcaaaagaagcagcagtggtaccaggagaaccaggtgacgctgacacccgaggatgaagacctgtacctgagttactgctctcaggccatgttccgcatccgcatcctggagcagcgcctcaatcgacacaaggaactggccccactgaagtacctggctctggaggaaaagctctacaaggacccacgcctgggggagctccagaaaatattcgcttgatgtccctcctggggcctcagccagagctgccagagaaaggaaacctcttcccgcagcctggctcctgtgttccctctatccagccaatgcctgtttacacagacacctggcctcactgccagcccacctcccctacagccctgtttgttcctgcttctcatgattttcctgtaaataaacacactcttaatttgcc

SEQ ID NO: 1398 - DNA, 1866 bp, Homo sapiens
gaaacttgcgagtgtcgcgtctgcagtgtgtggggttcgcggggcggcgggtagaggcgagtgtttagagacttcgggtccctgactcgcctccagcagtggagacaggtcatcggtctggtctgcgtgggcttctgggaatgtttcaggggcagggagagcgcgcttttttttttctgttgttcgctagcgcgtgaggtccgtgttgcggggagctctcggggagtcctcgctcggagttcgtttcgcagtcgtgttggagttcccagagtctgggagcccatggtctccgcattggaaccagtgcttgggaggtcttcgttgcacagtagcgctagggcgtcgtggtggggaagcgaatcgtgtcagtgttggagactgctctgggcagttcgtgttcattgcttatcacatgcgtacttaaaaaggggtctgctggtccccttgcttccctgctgctgtatattctgtagaaaatgggttttcaggttcattgcgacccaagtaataacatccccatcattttaaatactcctccagaaaataactctggtttagtgtatttcatgtttaatgttggggtcaggtgtctaggtattggtataattttattcgtctttaataacatcttgtcgacttcgtattcccatattacatgctctttgagagttttttaaattgctgcagtttcatcaagtggttgctttaatttgggtagaattgatgtagatctagatacaacactttcaggaacatgtgatggatttctattaacccaatatttttatttgtttgactatctgtagtgtttttccatacgtatcttggacatttctggttatgcttatttctacatagttaatactttttgttgtaaatcgtgaccttttttttgcataagacccctccccctttccttttttgttcctaattttacttagttgacaagaacagaagttaaaaatatatatgtttattctgtcacttcattgtactcatgtcattacatataacttataaattgacgtcttttttctagttgagcatttttgtcatctgcaaataattttagccaggtggcaagtgtatggactgtggagtaagaagtacctgcctctgcctctgacttgggttctggcctataggaacaagacattttcagtaatggaagaaggagcttccaggctggggaagatcatcatttccagtggtagcttgacctgagatgatacctgaccaccacttctgggaaggcccagaatagacagaagagagagaacatactagagttgctagcccctaagagttgaacgaaatgggcaaggcccagctgaaataacaggaaacacatgaaaaatgccacgattgtaatgtctgtgaggagagagcaaggcagttcttcaggggggggggtcattgtcattcgaagatgtggctgtgggcttcaccagggaggagtggcagtttttggaccagtctcagaaggtcttgtacaaggaagtaatgttggagaactacatcaacctagtatcaatagggtatcgaggcaccaagccagattcgctcttcaagttggagcaaggagaacccccagggatagcagaaggagcagcccacagtcaaatctgtccagggtattcattcaggagaaggaccctacagatggagggaatgcaggaaagctaagaagaatcacacctcattgcagatctgcattaccgttggaaaacagcagcctcagaaccacagtagccatgaagaccatcagccttcaaccaccacccttgtatcagaggagacaaataagcttggaaatcctcaaaaagcctcatcctcagagcaatgtcattatatatcttgtcttac

SEQ ID NO: 1399 - DNA, 2062 bp, Homo sapiens
gtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggagggtaaggcctccgccctacagccgcctgcctcaggcccagggagcggcagccccctcccccagccctggggtgatgcccaggtcatcctcgggagccctgccaggccccccttctctttccagccgcctgctgagcagacccctcggagagctttctgctcccttcccatcagcagcttgctttctgggaaccttttatctgccttactcccctttaaacacctgcggcatcgtcacatggcttgtgattaccgttttatctcccttgctcccctttaaaacacctgcggcattgtcacttggcttgtgattaccatttcgtctttaaagcaggtttgttaacagttttaacactcggagtatttaaagccagccaggtgtgggcgtgcctgcacccagatgtggaggtttattttaaggctgtgccccaaggggacccagtttgggggtggctgtgcccgccctggtcctagcatagccctggcccagagcactgctcccacaccctcgggcctcggagctcggctgtgttcatctacagggatctgtcacctgtccctccaggaaagctccttacgcctttgctctcctgagaataaaacttgctctgaatcctcctcc

SEQ ID NO: 1400 - DNA, 2191 bp, Homo sapiens
agttgcgcatgcgcctcggccccgcgagcgcaccgccctcgggtggagctagtgctcagggcgtcctcgtgccttttcttggtggcgggaaacctgggttgaggtgtgaggggcttgcggagtcgctgcggcagctggttccgcccatcgcctttaggtcctccttgctcctgaagctttcagtatttgttattgtgaaagaagttaattcacctgaaacagaggaggggcaacctgagttatcagaaagtgacttcctggccttcccttctttactgatcagaggcacacaaagcgtagtttctaagctgaatgatgacaacgttgcagaataaagaagaatgtggaaagggaccaaagagaatctttgccccacctgcacaaaaatcttacagcctgttaccttgtagccctaactcccctaaggaggagaccccggggatcagttccccagagacagaggccaggataagcctgccaaaggccagtttaaagaagaaagaggaaaaagcaaccatgaagaatgttccaagcagggaacaggagaaaaaaagaaaggcacaaatcaacaagcaagcagagaagaaagaaaaggaaaaatcaagtcttaccaatgcagaatttgaggagattgtccagattgttctgcagaagtcccttcaggagtgcttggggatgggatctggccttgattttgcagagacttcttgtgcccagcccgtagtatctacccaatcagacaaggagccaggaattactgcttctgctgctgatactgataatgctaatggagaggaggtaccacatactcaagagatttcagtgtcttgggaaggtgaagctgcccctgagataaggacatctaagttaggccagccagatcctgcaccctctaagaagaaatccaatagactcaccttaagcaaaagaaagaaggaagctcaagatgagaaggtggagaaaactcaaggtggacatgagcacagacaggaagaccgactaaagaaaacagttcaggatcattctcagatcagggaccagcaaaaaggagagataagtggttttggtcaatgtctggtctgggtccagtgttccttcccaaactgtgggaaatggaggcggctgtgtgggaacattgacccctcagttctcccagataattggtcctgtgatcagaacacagcagacgtgcagtataatcgctgtgatattcctgaggagacctggacagggcttgagagtgatgtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatgaaaaagcgcagaaatgactgcagccagaaactgggggtggccctgatgatggctcaagaggcagaacagatcagcattcaggaacgggttaacttgtttggtttctggagccgattcaacggatctaacagtaatggggaaagaaaagacttacagctctctggtttgaacagcccaggatcctgcacccagaatgggaaggaaagaaggccaagggaattcagattctgaccagccaggccctaagaaaaaatttaaagctccccagagcaaggccttggcagccagcttttcagagggaaaagaagttagaacggtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagttggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcg

SEQ ID NO: 1401 - DNA, 2074 bp, Homo sapiens
agtgctccctccagcctccgcgcatttcagctggcgctgcagctgctgcacagagacccacagaggccaccctcggaaccagcgcccaatgagagggcgggacctgtgttcctccacacaaagccaggcgctgggatctttgagaaccaccaccccagcctttacccttaacattccatccgaggcaaaccacactgagcagccgcctgcaggcctgggagcaaggctacaggaagcaggtgtttccatccctcccaggcgaggccgcccaacaccaacactggagaagaagaaaaaacctcatttgatggcggaagatgaaccttcaggggccctcttgaagccgctggtttttcgcgttgacgagaccaccccggctgtggtgcaaagtgtcctcctggagagggggtggaataagtttgataagcaggagcagaacgcggaggactggaacctgtactggaggacatcctctttccgaatgaccgaacacaacagtgttaaaccgtggcagcagctaaaccaccaccctggaaccaccaagcttaccaggaaagactgtttggccaaacacctgaagcacatgaggaggatgtatggcacttccctgtaccagttcatccccctgacgttcgtcatgcccaatgactataccaagttcgtggctgaatactttcaggagaggcagatgctgggcaccaagcatagctattggatttgcaagcctgctgagttatctcgtgggagggggatactaattttcagtgactttaaagacttcatctttgatgatatgtacatagtgcagaaatatatctccaatcctttacttattggcagatataaatgtgatctccgcatctatgtttgtgttactggctttaagcctttgaccatttatgtttatcaggaagggttggttcggtttgccacggaaaagtttgacctcagtaatttgcaaaacaattatgcccatttgaccaacagcagcatcaataaatccggggcctcttatgagaagatcaaagaagtgattggtcatggttgtaaatggacgctcagcagatttttttcctaccttcgtagctgggatgtggacgatctgcttttgtggaagaaaatccaccgcatggttattctcaccattctcgccattgcaccatctgtcccctttgctgccaattgctttgagctctttgggtttgatattttgattgatgacaacttgaaaccatggcttttagaggtcaactacagcccagccttgaccttggattgttcaacagatgtgttggtgaagagaaaacttgtccatgatattattgacctgatttacttaaatggtctaagaaatgaggggggagaagccagtaatgccacacatggaaattccaacatcgatgctgcaaaaagtgacagaggtgggcttgatgctcctgactgtcttccttatgattctctttcgttcacaagcagaatgtacaacgaggatgactctgtggtggagaaagctgtgagtgtgcgtcctgaagctgcacctgcctcccagctggaaggagagatgagtgggcaggattttcatctgtcaacaagggagatgccacaaagcaagcccaagttacggagcaggcacacgcctcacaagacactcatgccctacgcgtccctcttccagtcgcactcctgcaagaccaagacctccccgtgtgtcctgtcagaccgtggcaaagctccagatccccaagcaggcaactttgttcttgtttttcctttcaatgaagcaactctcggagcttccaggaatggattaaatgtcaaaagaataatccaagagctccagaaactaatgaataagcaacattcctaagtggtaaaaaatcaaatcaagaaaaagtgacatggatttttaaaaaccaaggatcctgtcctagagaaagcaatagttcaagtccctacctgtgccaccagcatgttaactatgacattgggactgaagatgtggccatatgtataaatataacagctctgacaaagcacaatatgttcaagtggtgattaaactacattacatccc

SEQ ID NO: 1402 - DNA, 2315 bp, Homo sapiens
agaagaagaggaagagaggcctgagcgagcatattagcatgctccacccccttgccacgtgatgccctgtgctgcctcggaacctgcagggtcccaccagcaagaaggccctcatcagatacggctcctcaactttggacctccagcctccataactacccaacctgtctgctggctatggacatcctcccttaccttcacatgtcacatggcaagtgccctctcctggtgaggggcaagggtgagatggagggagaagccctgttgagctgcttggccatgaacagtttgggggaacaggaagcttgccttgacctcgggtccaagactccctccctagagatctcatcaaataaccaggaaagaccaaccaacagagaagagactggaatcatctgcccagaaagacttttcatctattcttctaaggacagctccaagagattacctgggggactttgtataaaaaataagacaacctgtgttcctgtgcagcttcatccctcatctttccctaagtgtcaagaagcaatagttagtccacaagcacgagtgaaattactgaacaaaattaagatggatacagcactctaaaacacccatttgaatgcatgtgaaatcgacgactttctcaaggttgaaactttgaatggattaaaggagatcagtgagagtacatgatgctgctggtgaaacacgggtttggaattaccttctggagattggggtttcagaaaacagaaaatcaaagacaagaaacagaattacagtataaaatccttagatttgagcacaactttatggcttacacagggtagtcagatacgttatttgttcctccttgcaaccttaagaggtcaaaatttggatcattcccatttaacagataaggaaactgagggaactaaagcttgaggttgtcaagtaacttcgccaagtatactcaccacagacccagtgctctttgaacttgaacatgtattcacccaatgcattaacactgaccagaatcaaactttacttccccaaataagcaagcccagataaaaacaaatagcagattagtcacatgtacaagcattgggcaatcatatgtatccagggtgggctacatgcaatgtggttgctgctgtgaagggtacacaggtcccagaatcacaggtgccttcatattaaaaaggaccttcgagttcatctactccaacctccacattttacctgaataaactaatgctcagagatactaagcagcttcccaaggtcaaacacagcaaattaaagtcagccaagactcaaggcctggtttccaacaaggctgccttctcaaggagtccacagtctggaggactagactataacaagtcataagacaggagtcatcacaagggaatacacaattatttgcaaatgtctcttattgacaaggaaaaggctgatgcttcagggaacagatgttgctggacccactgacacagcattacatttctgagctaagaggctgagtcaactggacccatacattctgtgcttcctggttttgcaattggattgattgaactctgcagaagcagccataaggacaatctaaggaaataaagcaattgtggccccggggatcaagagctccattgagttgagagtcctagacagctgcctcagagaaccaaagggtttccatatcattaggtgaaggatactcccttctttcatacagaagctgctgtggtgccagtcttcctaggaaatgttcctagtgaccagaaaatgtcgaacagggtgaggctcagtgctggatcttagtcactgagcataccctcctcctaccactctatccactgactattaactagcctcctatctcaccttcctgaggctgagtttactctctaggaggaggttaaaaaccacagagagaagttgggtgtggtggcctgtagtgtcagctactcggaaggctgtggtgggaagatcgtttgagcccatgagtttgagaccagcctgggtaacatagcaagactctgtcgctaaaaataaaaaccacaaaacaaggaattactaagagacctggagggaatgtaggccatgtagcccagagaagaatttcaggatccagagtcagacaaacaaacccttcctcaaatctcaacccttccattccgaggctgattgactttaagcaaatcatgtctattctctgagtgtcacgttcctcacctgtgaaataaccaccatcattgggctttcagggaggagaaggggcagaaatgatatcattcatgtcgagcacctagtaaaaagcctatacatatcaccat

SEQ ID NO: 1403 - DNA, 2054 bp, Homo sapiens
agcctgatcaggcctcgcagtgggacgttgggaagccggtgttggcagatgctgtggctgggaggagtccagagcttcgccctgtccccgcggggctgagccacaactgcttaggagttttgggcaggatcgatggatgcaggaagcagtaggagtttggagaatgcagtgaataggatctatcatgatcagcttgttccaaagataaacacaagcaagaaaatgtccaccttagcgcacccacctaacatcctggaaatgtcacaagagattaagaaaaactgtggaggtaaacaggtagaaatcacacttgaaagaacaaaaatgacaaagggcatcaaagaaaaacaaagcaatgatttagagaaagcagcctttaaacggaaggcagaaggtgaagaaaagccaactagaaagaaacaggcaaagataacagaacttgacaatcagttaatcaccatgcctctgcctcacatccccttaaagaacataatggatgtggaaatgaagttggtctacattgatgaagtgggtgttcgctatgagtttgtagagtccttcatgtctactgggagtcagccaacatgccaagctgctgaaatagtagaccctttgagtgtacataatttcagctttctgcctcagattgacaaatggcttcaggtagccttaaaggatgccagctcttgctatagacaaaagaaatacgccttggcagcaggacagttcagaacagcacttgagctttgcagcaaaggagcagttctgggagaaccatttgatgcacctgctgaagatatagcaagcgtggcaagtttcattgagacaaagcttgttacctgttatctacggatgaggaaaccagatcttgccctgaatcatgcacacaggagcattgttttaaacccagcctatttccggaatcatcttcgtcaagcaacagtgtttagatgtctggagaggtattcagaggctgcccggagtgccatgattgctgactacatgttctggcttggtggaggaagggaagagagcataagcaagctcatcaaactgtattggcaggccatgattgaggaagccatcaccagagctgaatctttctcggttgtgtacacaccatttgcgacaaaaataagagctgataaaatagaaaaagtaaaagatgctttcacaaaaactcatcctgcatatgcagagtatatgtacacagatcttcaagcactccacatgttgcctcagacagttgactggtcatcttttcctccccaacaatatctcttgactcttgggttcaaaaacaaagatgatggaaaatttttggaaaaaatatcaagcaggaagctgccgatattcacagagcataaaacacctttcggtctgaccagagaagatacagtgaggcaaatggagacaatggggaagcgaatcttgccaatattggattttattagaagcacccaattgaatgggagttttcctgcatcctcaggtgtgatggagaagttgcaatatgccagcctcctcagccagctgcagagagtaaaggagcagtcccaggtgattaatcaagcaatggcagagctagcaaccattccctacctacaggacatcagtcaacaggaggcagaattgctgcagtcactaatggcagatgctatggacacccttgaaggaagaagaaacaataatgaacgtgtgtggaatatgatccaaaaggttggacaaattgaagattttctataccaattagaggacagtttcttaaaaactaaaaaactgagaactgctcgaaggcaaaaaacaaaaatgaagcgacttcaaactgttcagcaaaggtagtcattagggagcaggcactaccactaagatatcccagaagaagaggcaagggcatccactccaatgcccacctagtactgtgaagctggataacaaaagcttgtcaccaaaagaaagaggtggtattcccctcagttcatctttaccaaagacactctatgtttcattaatctcaactggcagcaataaatattctcagcaagtttgacttg

SEQ ID NO: 1404 - DNA, 1692 bp, Homo sapiens
ggctgcagcctgtgcctcctgtctcctgcaggcgcctgaagaagctctctagggagggcagctcccatcaccttccacgccaagtccgcccagggccagtgtacaaaccagcacctgctaggaaccaccggccacgtggggggcgtgggaaagcttctcccaccagcttccatgtgtccccacgggctcccctggctcctctggcctccatgccgtcatcagtcccgaagacctccatagagtcccttgggtctccatcatccctgagctcctcccaggcatcagagcctctgtgtcccctgaagcacccttcacaccggccacctgcgagcaccctatcaccaaacctgaccagctccacagaatccttggggtatctgtcatccctcagctcctcccagccaccagagcctttgcgtcccctggaatgtccttcacacaagccatgtgggcgttcccttccccgacgacggaatcctggctgggtgtcctggtccgactccatgcaggctgattccgaaactgacgccataatatgcccaatgtgcaagacccctgagcactcctgtccacacacctggtgggtgccttctagccctcaagtgatccgaggcgttggtcgctgcagtgatcccaacctgggcctctcctggaggcaggaggctgctagagcctggtgccactgcacctcctcacagtacccattcaagcaccctaatcttcccacccacctaccaaaggcttctttctagggagaccccacatgcaggcaggcggaggcaggggtcccgctttcctcagcctggatgtgccaacgctgctggacgcacaagacaccaaaatcccagacactcccatggacaccgaatatccgacatccacgaacaattgggaatctcctgaggacaacttggaggcgcgtcccctcatctgggcaccccacagatgctggaaatgcgtgttctaatggattgggagagaaggagatggggtccaaacctccagtccctggagcccgtaaatctccttgggaggcttggcgcccacagagacctcttccacagcgctgcacacacagatcttccttcctagaggatctgaactcacttagaaaactgccagcacaggagggataacatcagctgtgccccccactggagaacccagagactctgggtcattgtcaacattgcccccagaatgggctctctgctggggaagatgctcaggaattgctgctcttttgcaatgccagtctctcctaacagaactgcagattccacgtgtagacctgcaaacttctgttctctgcagttccctgagtcacagtttacacaatcacaatttttttttttttttttagatggagtctcactctgttgctcaggctggagtgcagtggcaccatcttggctcaccacaacctccgcctcccggattcaagccattctcctgcctcagcctcccgagtaactgggattacaggcttgtgccaccgcacccagctaatttttgtaattttagtcgagagaaggtgtcaccatgttggccaggcttgtcttgaactcctgaccttgagatatctgcccacctcagcctctcaaagtgctgggattataggcttgagccaccacggctggatgaatcacaaattgtaaacctgaataaaatgctgcaacctccaatgagagg

SEQ ID NO: 1405 - DNA, 1851 bp, Homo sapiens
aagctcttagaggcgtaggcaaatatgtgcaggccatcagtacagtactgtgcagtacagcagcaagaaaatcagcttggtaccaccagactgggctgcaggttccagctgttgctgctagcaggaagtggctaagctggccatcgtatcacaggcatccaggcagagggattgatgtccgaagaagaaaaatctgggacatgtatggaccacaaactcagttagaggaagatgcaatcacacccaatgataagacccttttccctgatgttgattggttaatcggtaaccattctgatgaactcacaccatggatacctgtcattgcagccaggtcttcctacaattgccgcttctttgtcctcccctgctgcttctttgacttcattggaagatactcccggaggcagagtaagaagactcagtaccgggaataccttgacttcattaaagaagtgggcttcacctgtgggtttcacgtggacgaagactgcctcaggattccttcaaccaaaagagtctgtctcgttggaaaatccagaacatacccttcctccagagaagcttccgtggatgaaaagaggactcagtacattaagagcaggcggggctgccctgtaagcccacctggctgggagctttccccttctccacgctgggttgctgctggcagtgctggtcactgtgacggtcagcaagctctggacgccagggtcgggtgtgtaaccagggcctgggccgctgagcatggagcagggccccaggctgaaggaccctggctacctggatttcatcccagagaaaaggctgagcgtgtgaggaactgtgccgccctgccacgagattttattgaccaagtggttttgcaagtagcgaatttactgttaggtggaaagcaattaaacacaagaagttctcgaaatgggagtttgaagacctggaatgggggagagagcctatctctggcagaagtagccaacgagctggacacggagaccctgcggaggctgaagcgggagtgtgggggcctgcagacgctgctccggaacagccaccaggtgttccaagttgtgaatgggagagttcacatccgcgactggcgagaggagacactgtggaagacaaagcaaccggaagcgaaacagagactgctctctgaagcctgcaaaacccgcctctgctggttcttcatgcatcaccctgatggctgcgctctgtccacggactgctgcccgtttgcccatgggcctgcggagctgcggccaccccggaccaccccgaggaagaagatttcatgagctgcatccttgccagccgaggcctggttggggaggccaaaccaaggagagcttccccagcagtcgtcagtgctgtggtctctgctctggctgtgtttcagcccacctcctcccagctttctccacatcctcacagtgatgaaccgtatttcataaacatcacacgccagagaagccacagttactcggaagcccccagctgactgcctggcttgtttcagatgcagccgcttgaaacgtgcgcagcatcttcatatcataaagattgtgcacggatccttacaatgtctcctgggggagagcggctgaggctgccttgcacaggcccttcccagggcgctgtccgacgcctgccccaccatgtccacatctgtgaagaggatggggctcctcgagaagtaagaccgtatctgccagcgtttctcaccacactggagagcagctgctctggagcagggatccaccagattggtatttttaaaaaaggtgtcaggcttgctatgttgaggttgtttttagagttacagagaataaaaacactcataatttcctg

SEQ ID NO: 1406 - DNA, 2782 bp, Homo sapiens
agatcttggcaggcttcttggggaggtttcacctgggtttgggtggacaaggaagagttgagcctggtggcttggagaaaggtgttcctggctggggacgtggtgacattccagtggcgggataggttagttgttctgtctggctgtgtgacgcatgcatgaagttagggtcaggtcgggaagggccctgcatgtcaggtggggggaagccaacaaggtcttcaggcttgctgcggagcggagatctgctgtgatgggtccaggcggctggtgttggggagttggggagaagagcgtgacttcatgtcaaggaagccctgggttggtaccgctccctggctagatgaccaccagcaagtcatttcacctctctgagcctctctgttttatcatcttcaagtgggcatgatcctaaccacctcttgggctttttgtgaggttaaccgacagggtgcttgtcaaagctcaacaccttcctggcccaaggaagtgctcagcacatggctgctgaaagcaggcagctgaggactccaggcaccggtcctgcctctgcccagccaggcctggtgcctgctcagcaccggctgcccagtgctctgaccacccccctttcctcccacagatccctttgggcgtcccacaagcttcgcctctttggctgccctctccaacggggcctttggaggcctgggcagccccacattcagtgagtgcgggtgcggtggggtgggggggctgcggccacagggtgagagctcagacggtctgggaggaggcctgaacagggcctcccacttctggcccctgtcactctctgcttcaccctctgcccagactccggcgccgtctttgcccagaaagaaagcccaggggccccaccagccttcgcctccccaccggacccatggggccgcctgcaccgcagtcctctgacctttcctgcctgggtccggccccctgaggccgcccggactccaggctcagacaaggagcggcctgtggagcggagggagccctccatcaccaaggaggagaaggacagggacctccccttctcacggccccagctccgagtctctcctgctactcccaaggcccgggctggtgaggaggggcctcggccaaccaaggaatctgtgcgggtaaaggaagagcggaaggaggaggctgccgccgccgctgccgctgctgctgccgccgccgctgccgccgccgcagcagccactgggccccagggccttcacctgctgtttgagaggccccggccgcccccgtttctgggccctagcccaccagatcgctgtgctggcttcctggagccaacctggttggcagcacccccacgcctggcaaggccaccccgcttctatgaggcgggtgaggagctaactggacccggggccgtggccgctgcccgcctctacggtctggaacctgctcaccccttgctctacagccgcttggctcctccaccaccacctgctgcggccccgggaacccctcaccttctcagcaagaccccaccgggagcccttttgggggcaccacctccgcttgtgcccgccccccggcccagttccccacctaggggccctggcccagctcgggctgacaggtgaggggaacgggggggggtcggggcaaagctccatctccccttcctttaaccaggtcctagggctgaggttttaagccagggctggagggcaaaggtcataacctcaccagccacctctgaggtcatggaacctgggaacagaagcctcaacccccacaagaccaagcatcacatggagtgtagggtcactgggagagcagaggtcacagcctctagagaagggagaggggcgtgtgcatgggagtgtggctcatctcgggggccatggggcctcctgaggtacacctttgcccctgtaagggcctctaggccctgggcctgcctccccaagggctcactaagccagaggccaaagtgccccctcccgttcacctaccacccaagtcctcatgccctccgagggctgggggaggaggggctcaaggaaggggggttccatgtacatatttatcacccctttcacatagccccaagaccttttgtacatttttacaggggtgcccctcccaacagttcccttcctggttaattaaaccctcagactggtgctgtgttcctagcctctggcctctctgtggggaaaggggactgcagggggaagagccgggaagggacagtcaggcttctccctgggaaggtggggccagcaggagatgaccaacagggggcaggacctggggacctgggctggagggaagggcagaagcttcctacttggctgacagccccggttcccccaacatgttcccgttcactctgcccccacccccaaaggctcagcctctaaatctcagactccaccactcttaatggctcagtccccttcaccccatttccaagtgcccccaggactcctgggccctgcttccctgaaccctgttctccaaaaccctgccccaggctaagggtggccagagaaggtcaccatgtaccacacaccaaagaagggggtcggcccaggggtgggcgacacaggcagcttcttcggcagcctcacggcagcaaccccagccttcccaaagcagcaggcgcctccaggctggggcccaacctagaaggcaggggtcaatctaacaaaaccctaacgttgacttttttccctggtggggcttcttctgtaacatgacttgcgaatatttatataaaaacgagtgttacaatgag

SEQ ID NO: 1407 - DNA, 2283 bp, Homo sapiens
gtgctccccacgtgaaggcacccgccctgcgcgtgtgaaagggcgagagcagcgcgagatacggcctagcgcctcagatcttcgttggcggccatggcttcggcttctcagggcgctgacgacgacggcagtcgtaggaagccccgcctggctgcatcgttgcagatcagcccccagccccgcccctggcgaccgctacccgcccaggcccaaagtgcctgggagcccgcgcccgcgcccgcgacgtatcgcgcggagggcgggtggccccaggtctcggtgttgagggacagtgggcctggggcaggggccggagtcggggaactgggggcagcccgggcgtgggaaaacttgggggaacagatggggaaggccccgagggtccctgtgcccccagcagggctcagcctgccgctcaaagacccacctgccagccaggccgtgtccttgctcacggagtacgcggccagcctgggcatcttcctgctcttccgggaggaccagccaccaggaaaagtgttcaaatatagagcccctggaggagaggaattgaaagcaatgtgtctgtggcaggtggaagtgctcagagccttcctcctgagaacagggtggcgtgggctctggagaggggacctggatttgggtcctgactcaagttgggcaaaccgcctgccgtttctgctcatctgtgaaatggagtcacgcatccctgctgtggaggagttgggtccctgcttccccttctcggtgagcgcggaactggatggggtggtctgccctgcgggcactgcgaatagcaagacggaggccaaacagcaggcagcgctctctgccctctgctacatccggagtcagctggagaacccagagtccccccagacctccagccggcctccactggcccccctgagcgtagagaacatcctgacccatgagcagcgctgcgcagcgttggtgagcgccggctttgacctcctgttggacgagcgctcgccatactgggcctgtaaggggactgtggctggagtcatcctggagaggggctgggccgtctctgccccctcctgcacagagatcccgcgtgccaggggccacgtgaaggagatctacaagctggtggctctgggcaccggcagcagctgctgtgctggctggctggagttctcgggccagcagctccacgactgccatggcctggtcatcgcccgcagggccctgctgaggttcttgttccggcagctcctgctggccacacaggggggccccaagggcaaggagcagtccgtgctggccccccagccagggcccggacccccattcaccctcaagccccgcgtcttcctgcacctctacatcagcaacacccccaagggcgcggcccgtgacatctacctgccccccacctcagaaggtggcctcccgcacagcccacccatgcgcctgcaggcccatgtgctcgggcagctgaagcctgtgtgctacgtggcgccctcgctctgtgacacccacgtgggctgcctgtcagccagcgacaagctggcacgctgggctgtgctggggctgggtggtgccctgctggcccacctggtgtccccactctacagcaccagcctcatcctggctgactcatgccacgaccctccgactctgagcagggccatccacacccggccctgcctggacagtgtcctggggccatgcctgccacctccctacgtccggaccgccctgcacctgtttgcagggcccccggtggccccttccgaacccacccctgacacctgccgtggcctgagcctcaactggagcctgggggaccctggcatcgaggttgtggatgtggccaccgggcgtgtgaaggccaatgccgccctggggcctccctcccgtctctgcaaggcctcctttctccgggcctttcaccaggcggccagggctgtggggaagccctacctcctggccttgaagacctacgaggctgccaaggctgggccctaccaggaggctcgcaggcagctgtctctcctcctggaccagcagggcctgggggcttggccctcgaagccactggtgggcaaattcagaaactgaagccagcctcggcgggaccgaggtcccggagccaagctgtacccctgctgggggagtgccctatctgaggagcgttgtggggagaacatgggttgtgcggggtgaaactggggctggagggaaggaggagcctgctgtggttgggaggcggctgctgcacgtttgggcttgaataaagaagtatttctggtt

SEQ ID NO: 1408 - DNA, 2047 bp, Homo sapiens
agcgtcctcgggaggtctcaggccccttgggcagacgctgcgcgtgcccagagggagggatggcaggcttcagccacttctcccagccgccctaccgggatctctgggaacccccgcggcccggcggagaacgagagtccacgcagcggctgggcgggcagaggtccggagccgactccaccgcgtgctcccgggccgggactccgggtgcggagagcgaagctggggcgtgctggctgcacccgcactgttcgttcaccccgcggcctcgcaggcgcgggtgctcagattcactgcggggcagccgaagcctgagcgatgtggcccgcaggcccctggaacgttccaggaagcaccggccccgcagcaggcgcctggaagatgcctggggagagacaggaaccaagccccgcccggcttggcagccgcagacccagctgccaccccagcggccgcagccctgcccgcattaccctctggcccagggagactcgcccccgccttgccccggaggagctggcactcccctgagtggcacattcagggtagaaaaggcacagggtggagaccagtgggcagtgccactcggcagacatctaggtcgctggtccccttcctcagttccctcggagcggtcttctgtgccctcgcaaaagttcaagaggcactcagcctgcgtgtgcgcccagaagagagacagcagcgaccaggttgagtcattagccagccgggactcccagcccttggcctccagcaaagagatgcggagcccgcacacccaggtcctgaagagcaagctggaagaggtggtggtgtcctcccaggaccagcagattgtggccctggtgctgacccgtctcaagaaggcccagaggatacgggagctgcagcagcaggcggctaaggcctgggaggagctgaagcgctcggatcagaaggtccagatgaccctggagcgggagcgccggctgctgctgcggcagagccaggagcagtggcaggagaaggagcagcgcaagaccctccagagccctgagcagcgcggcctgcggcgggacagccagaggaagaacgtgcccccgggggaaagccggtggaaggagcaaccagaggaccaggagagcccgcgccaggagaagctggagaaggcgcgcgcccaggcagagcaccgaaaacagtgccaggtgcggcgcctgcgggagcaggagaagatgctacggaacctccgggagcagcacagcctgcagctgcagaggaggctggtggaagcctgtcgcaagaggcacctacatgccgtggagggccagaagaaggtccaggacaccaacctgagctccctcatcaattaccaggcccggaaggtcctcatggactgccaggccaaggctgaggagctccttaggcagctgtccctggaacaaagtttccagcggtcccaggagatacaccagggcctgaggaaggagcggcaacgcgagctgagggagaaggcccagaaggaggaagagcagttgcagcaggccaggtggcgcgcaggggagtcagaggaacagaggaagatgcgcaaaagaattctggtggagctggcggatgagaagatccgacaggccaggagtcacgtgcacaagaccactagggacaaggtgcagcacctccgggagctcaaccacctgagggagaaaaaccaccacatcctgaaactgaaagccgagaaggaggaaaagtgtcacattgagggcatcaaggaggccattaagaaaaaggagcagagggtgcagcacatttcccaagggaaagacccaaacttccaggagttccagaagctccctcaggcctccaggagagaggagagagcgcctcccaacagctcccttgatcagatggtactagaggcccagctccgtgcctgtcagcagaacaggggttactgagaaccaaggacgcctggcttacagtgcgcagccagaaggagatgtggcaatgtgattccttttgtaatctgattataattgaacattgattttaaaaaagcatgtaaaatagctgc

SEQ ID NO: 1409 - DNA, 1826 bp, Homo sapiens
acacagccagtgtactggatgcctgattaagcgtcatggggtctttcatccagactgcgttttcattattcgctgaaacatacaggttttaatttttacgaggctaaggccacggccgcctcacctcggtttttgccgccacctagaggaactatgtgcgccccaacggttgcccggatgtaggcgtagggtggagccgtaagagattgactagccagttgatttggttggcgcaggctcagaaacgccgtgacgccgcccttccccccaacacgtgatgaaagtcggggtgacgaagggccggctttgcgcaggtgcacagtactcgctatggcccattcgtcacgtgacgagggcgggactgtggcactgtggaggggcgcctagtaggcaggcgctctcagctctctccccggtacgtgacgagactccacggacgtcacgtgaggcaggcggcgagcgcgggtggggcggggttaggcggcgctccgcgagaaccaaagtgcagccgctgacccggcaaaactcagcgggggctggatagccatgcccaagtactgcagggcgccgaactgctccaacactgcgggccgcctgggtgcagacaaccgccctgtgagcttctacaagttcccactgaaggatggtccccggctgcaggcctggctgcagcacatgggctgtgagcactgggtgcccagctgccaccagcacttgtgcagcgagcacttcacaccctcctgcttccagtggcgctggggtgtgcgctacctgcggcctgatgcagtgccctccatcttctcccggggaccacctgccaagagtcagcggaggacccgaagcacccagaagccagtctcgccgccgcctcccctacagaagaatacacccctgccccagagccctgccatcccagtctctggcccagtgcgcctagtggtgctgggccccacatcggggagccccaagactgtggccaccatgctcctgacccccctggcccctgcgccaactcctgagcggtcacaacctgaagtccctgcccaacaggcccagaccgggctgggcccagtgctgggagcactgcaacgccgggtgcggaggctgcaacggtgccaggagcggcaccaggcgcagctgcaggccctggaacggctggcacagcagctacacggggagagcctgctggcacgggcacgccggggtctgcagcgcctgacaacagcccagacccttggacctgaggaatcccaaaccttcaccatcatctgtggagggcctgacatagccatggtccttgcccaggaccctgcacctgccacagtggatgccaagccggagctcctggacactcggatccccagtgcataaggatcaagacagacaatgtcgagggacaaaagatagaagatggaggaggaaagacattatacgtgggcttggcccagccccaccgcccacgcctgggtagtagcagtgcctccctcaagggcctgggttctaccaccccactcctagggatctcttgaaccttaggggtgacctgggcccaagtctctcatcagcccccaatcccctgggtaccaggcttctgccacccccggctcagatctttgcaaatcagtacgacagcctcagagcagagcaagggttgtttgggagaatcatacctggttctaaggagtcccacgctttttgccaagcctggtactgagttcatgataccatggtggacacagctgagaaaatccctgccctcatggtgctcattctacttgagtagacgatgaactagtaaacaaataaacaagaacactgcagacatg

SEQ ID NO: 1410 - DNA, 2480 bp, Homo sapiens
tggtgcacaaagctgtggtggaggtggacgagtcgggaaccagagcagcggcagccacggggacaatcttcactttcagatattcactgaatggccactgtgtgcctggcactgttccaagtgctgaagaaaaatgaagaaaacaaaaatccctgcccttatagaggagacattataatgtgacaagataacataatgaaaaagaatgaagaataaaatagaaaagtaaaatggattgcatgtcacttgatgacaagtactgtggaatgaggctgtcatctaaacggagcacagaaagtggaacatggcgacatctcagccaaaagacccggcagacaccatcttggccaagggatcgaggttggcatcgccagctgtgagcagtgctgacatcttattatcttcgatatggcgtcatgagcaggctgcctcctcttggtgggatcttcccccaaacccagaacctcagtctaatcacaagaaaatgacagccaatcccaagttcagggacatttggcaaaatagcccaccactcctacttaaaagtgtcgaggtcttgaaaggcaaggaaaccctgggaaatcgtctttggccagaggaaactaagcagacatgacgactaaatgcaatgtagaatcctcggacagaaaaggacattagtgggacagctggtgaaacccaaaggaagaacctgtgtcaggacccccagagcggtgtctccactaagcagaagtctctgtttctctcctggcctctcccagaggggctgctctgaagcatgtggatttgatcaggataatcaagtccgagaacagaacacttggttgtcctggcatttcccaagcagtgggaggagttctctgcaggaataaataagcctcagcattcatgaaaatccactactccagacagacggctttggaatccaccagctacatccagctccctgaggcagagttgagaatggagagaatgttacctctcctgactctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggacacgtt

SEQ ID NO: 1411 - DNA, 1787 bp, Homo sapiens
gcgtcttacagtgggagagctcagcctcactgatagccggggatctctcctgttcgagggctgagatctccggtcccacaaccgcccacaaccaggggcacttctggaagtcccctttctagggacatttttcttctaagctctgtaacgcgggccgaggcagaccgaggcttctttcccggatccaatcccctgcccccatgcctaagaaagaaaaaatggccaagacgcccctgtccgatgagaagcagctgcttctgtttcagcagaagttgctggcagaggaggagatggccaaaaagaaggagaggctcctcagccagttcttgaaggacaagctggccaaggaggaacacaacagtgctctgaaccttaataagattaacacacagtggagaactgtccttcgggaagtcaagaccagagaacttcataaggacattgagatcctcagccaaacatttgaacgagtggtggactgtaaggacaatgtcatcaagtctttagctaaagacctgtccgaagccgaggagcagtacgcccatgccctgcgcagccacttgcacaatgttgaccagctcttggccctgcagaggcaccggctcagtctcctggaggaaagttacaacatggagctggaagccctaaccaaggagtttgagacagaaaggaagacaattattgaccaacgtgagaaagagattcactatctgcaagatatcttcatggccatggagcagaactatatagattctgagtatgaaagcaagctggagttccagagcatgtggaatgatctcaaaaacatgaatttagaagagaagcactttctaagactgcacctggagaacagagtagaagatctgtggagaaagttccaggatgtactcaagaattacactgatgccacagaggatcgaaaggctgcctttgagaccctgcaggtgaaggatgagaagagctccaaagagattgaagtacagatgaaaaaaatacagaaactacaggatgccataactatttcaaaaggcaagatcatgatacacagccgtgagagtgaagatgagaaccggtatatccgtaatgacaaggaattggtccttgtacaactgcgaaaacttaaggcccaaagaactcaggcccgggcagcatcccagaagaacttagtcagactcaccctggaaagtaatgccaccctcaaggccctgagaaagattgttgataagggtgaaaagatccttaaacttgctgaaatatgtaggaaatttgaaaccgaagaagaaaaagtgctgcctttttattcatcagtattgactcctaaggagcaggaggggattcagaagaataatctagaagagcttactgaggagctcaccaaggtgatggtggactacataggaatggagaatttctggaaaaggtacaacaaagtgaaactggagcaactgagcctccaacatagacgagcccagctgctagatatcaatgggaagctgcgggagatgctgaagcagtacttggatggcatctcagtgagtgacgaagtgctgagccagctcaacccactctttatagtcaactatcaaagcaacttactccagcccttgtccatacgtatagcccatccaggtgataaacaacatccaaccacttaaaatataattgaagcagcccagatgatcttccacaacctgtgatctaaggaaaaaaatctttcaactcctagagattttttttttttttttgagaaatgtagggatgttgctattaaaaatttccatggagtt

SEQ ID NO: 1412 - DNA, 2311 bp, Homo sapiens
aacattatttcagggatacaggagggtaggaggttatgaggctgtctggggaggcccgtgagacccaggccccaggctcccctccaggccccgcgattgccaccatgaagctgaacgagcgcagcctggccttctacgccacctgtgacgccccggtggacaatgcaggcttcctgtacaagaagggtgggcggcacgcggcctaccaccggcgctggttcgtgctgcgcgggaacatgctcttctacttcgaggacgctgccagccgtgagcccgtgggcgtcatcatcctggagggctgcactgtggagctggtggaggccgccgaggagttcgccttcgctgtgcgctttgcggggacccgggcgcgcacctacgtgctggccgctgagagtcaggatgccatggagggctgggtcaaggccctgtcgcgtgccagcttcgactacctgcggctggtggtgcgcgagctggagcagcagctggcggctgtacgtggcatggccctgccccagccccagccccagtccctgcccttgcccccgtccctgccctctgccctggccccagtcccatccctgccttctgccccagccccggtcccagccctgcccctgccccgccggcccagtgccctcccgcccaaggagaatggctgcgctgtctggagcactgaggccaccttcaggcctggacccgagccccctccaccaccgcctcgccgccgggcctcggcaccccacgggcccctggacatggcccccttcgcccggctgcacgagtgctatggccaggagatccgggccctgcgtggccagtggctcagcagccgggtccagccctgaggccaccagggcgcctgttttagggggacacaagctctatgccctctgggacaggccgggtcctggagagactgggggagcagatcctgagggaaatcatgggcaaggctggcccccaggccctgagtggcctggttttgggggatgcaggctctgagaaggtgctggattctgagtgggcctttaggaccatgtgacccagaaggcctacccttgaggggaacgtcacgtgcaacactaaggagaattcagggcctgagggggaggtttcctgagaactccggccccaggctggcctgagctgccgggcagaggcctgtgctggcaacaggcattgccgggcctgcagctcagagggtcactgggactgagggcgatctgtggcctgaaaagcaaatgcacagttagtgcagctcctgaccgggccttcagggtggacagagggaggatcggtcatggcagccacacctgggcctggccttgctccgggacctgccagaggagctggcctggctctgtgcctgcctgcctccaggagcaggacggtggctgggagggtagtgactggggacacaggtgcaggtgttagtgcaggaccggaagggtgaggtggcctggtcctcggggctcctggcctgggctggctgaggcaggactctgccaaaagtcccctgccaggcctcatggtggtgctcctggtggcagtggctctctggccgcgggccctgtctgtgtctccgtggtggctctcacagggctctccagacactccttgactgcatccttcagtcttggcccctgggcctggggccccttgggagcttgcctgacctcccttcctgggctgggtagccatggcccgaggtgaccttctagcaggttcccccagggaggggaggccaccagctgactcaccgcctaggaaggcccaggtgctgacctagtggcggagaaaaaacagccgcacaccgagtgtggcttccagagcccctcttcagctccaggcagccccctctaacatgtcccctcctgagctcagcccccacccccatactcctggtggggaccaggtcttgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactg

SEQ ID NO: 1413 - DNA, 2159 bp, Homo sapiens
ggagtgtgagagaggagcaggtgaagcagtgggcggcagagatgctggtagcgctggaggcgctgcacgagcagggggtgctgtgccgggacctccaccccgggaacctgctcctggaccaggcagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatggcactgtcccagagccacccttcaggaatccaggcccacacccagctccagctgcccgagtggctcagtcgcccagcggcctctctgctgactgaggtgaggtgtagcccggccagaggaagcagctgcctagcctgaggaaggtgctgggaggggcacagaactgtgtctgaaccacgtgtgcttcgtgctcagtgtctgatgtgggtgcagagggcagcaggggcaacacatttctatatgttggtggccaaccaccaccaatgttcccagggtaaaatgggggttctgtgggccaggctgccagggagcaggccccctagaggccatagtggttggagtccctggaggtcaccccatgcctccacagctggagtggcccagctgactgggcctctctctgcagctgctgcagttcgagcctacccggcgcctgggcatgggagaaggtggtgtcagcaaactcaagtcccatccctttttcagtaccatccaatggagcaagctggtggggtaagagggcagagcgggtgacggaagcagctggcctggtctggatcgcctctcctccttgcctgacacccaacccagggctggccctctatcagcgggctttgggcgaggaatggagggcactgtctgtcctgctgggctcccactggggcctcagaattatggccaccacccaggaagggccagctcctggaaaagctggaggtgggggcagtcaaggcttgccctgctaagcagcttgaaccgtctacccatcagtcaacagacccgttgagcatgtggactcaccatgttaaaggttgccttctgtggcactggcgctgagctgttgaccacctgctgcaccctactgtgaggttctgtgactcactcactgccatgttgtgccccactcaggacatctctggagactcatctcaggacactgatccactggctcagtggacccaaaccagactgtcctggctagtcctctcagtcacacagcgagtaggcctcttccaccagaagctgttcgtgcagctggggaggcccagaagcagggatgccatctgttgtgcagggagggatgaggtaggggacaggatgacccccacccccacccccccccacccccgattcctgaccatgccccctatcttgtgatttcagacttgggagagcaaaagggaggggaagaaaataagaggaatggggggaggaaggaatgcacgggtctgccccttagagcaagtctgaaaccagaatcaagagtcctcctccccagtgggcctgtgtgggggaagaggggcagcctgccccaggggtgcaagaggacagcaattcagcttccaggccaaagcagtttagacaaggtgtgcccatcaggactccctctcaggccctggctgtttaccatgtcactgcctactgtgacttcatgcccttttgggataagaaaccacaaaacgcatggaacaactatccatggctcttagccagaaatgtcctgcctctggtctctgaaaagctggggtgagtggttacctcaaagacaattgcctccagtttgggggctcctctcagggttcaccctgtcaccggggcgtgggaccgacctgggaaatttccactagagttttgccctcagctcctccctgccagcatcccagtcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggcct

SEQ ID NO: 1414 - DNA, 2987 bp, Homo sapiens
cttccggtcaccatggcgaccaggcgccttggggtcggggagacgctgggggccctcaacgcggccctggggccaggcggtccggtgtggatcaaggagacgcgcacccgccacctgcgttcccgagactttctggcaccgcaccgcgcgctgcaggcgcgcttcgatgacggccaggtgggcgtgagccgggcggggccgtgcggccgggagatgggccccgtgccgtggctcttttacacgcccgttctcccgcaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacgggtgagcggggccgcggggccggaatggagaaagtgggactgccgggtacctagaaagcgagcggcgccgcccgtggggactgcggctggaggtgggaagtcgtggcgagctggaccaggtgctcagactgaggcggccgccctcccttcgcagggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctggtgactgaggatctcctctctgtgctggctgagctgcaagaggctctatggcattggcccgaggacagccacccaggcctggttagtgactcccagccctgtaggttctcccaaaccaagtatactgtacttccacagttatgattgtcctcccttaggctggggcctcagatactggtacaggcggctgcctggttgtacatgttgttagctgtgaggaggagttccagcaacagaagttggacctgctttggcggaagttggttgacaaggctccactcagacaggtaggttaataatgatggtggagctccccaccacctaacccccaacctcagagggcccttgaaaacccaccgaggggcttgttagctgacagaaaccaacacttgaccttgggggagttgctggacttgagagggcatgtacagcaggtgcagaggctctggggaaggggggtctgtagacacatcccaagaacactgaagaccaggttgagaaggatgaaccatgcgtagcctgagtggctgggtagacggaggcactcaacctggcagttccaatttgagggagtctgggctgagtagaggcaccagatttgggctcctcaagggacttcctggagagtagcgccaactaggctgagcccctgacatctttctgacagaagcacctcatctgtggccctgtgaaagtagctggtgcacctggcactctgatgactgcccctgagtactacgagtgagtgaggctgggaggaacaccaacctaagccagggtaatgaggggggactctttacccaggaccctgcccactagccttcctctcttccaaacacaggttccggcatacccaggtgtgcaaggcctcagcactgaagcatggtggggatctggcacaaggtgtgcctgggaaaccctggctatgttctgggttaggggcaggttttttgcatccctgcccttgcctgcagactgactgaccaaccctatactccctcagacccagcctggacagagatctttggtgttctctctgtggccaccatcaagtttgagatgctgagcacagccccacagagtcaggtgagcctgggagcctgacagggccagtgttggggcacagggtgtggtggctgccttctctctctgcagctgtgcttctattccccagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgaggtgagtgtccctcctggtagctggcacaaggaggcctggacttcccctcccagcacctttctccccaacagggtgagtggttgttgctcttcaacagtatcctcccctttccggatctgctgagccggacagcagtgctggactgcacagccccggggctccacattgctgtacgcacagagatggtgaggcatagacaaccaggacactctacactctattctttattctggcctggggcacaagagcaaagagatgggccagtgactcagtctctgtctctagatatgcaagttcctggtacagctcagcatggatttcagctcctactacaaccgggtacacatcctgggggtgagcacacagcaaaacggggtgggacgtgcagagaggtatagggtaaaggcaaaggaagcagaggatgagaccagcaggccctttctctttcaggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgttac

SEQ ID NO: 1415 - DNA, 2381 bp, Homo sapiens
ctttttgcgcccaccatgtcttcacctaagagatcttcaaagcccagtatgtctctggcacccagtggatcctccatgcccactgcggatcccaagcctcctgcttccttgaagtccaccaaatcagcaacacccaacagatccttagtgcccaccaaaccagcgacatcccgtaactcagtcatgagcccaagcagttccaagtccaccaaatcgaccagtacaaaaagagccccttctaaccggcccagcagcaggtcccgagtccgcagcaaagcaagaacacccagcagggtgagcaccgacaccaggaccagcaaagccagcaaggccagcgacgtgagatgccaccagcggaggggcacacacagccggggtaggacacctggcagaaggggaagccgcagctccaagaggtcacccagcagggccagcactcctggcaggataagaactcatggtgccagaccaggcatggccagcagggtgagaactcccacttcacagcaaaaagggagccggggaaagagttacggccggcctagaaccagcaacagggaaaggagtgacagccagcctagaaatctgagcaagaagagttaccgcccaccaggaggctcaggtatagggaggagttccgagctggctgtaactcccagtacagccaagtgtcaaaccccgactggaattccctccaaggagaagagtgacaacccatctccatcctcatcaaggaaggtgaagagctacggtcagatgatcatccccagtagggaaaagagttacagccccactgaaatgtccagcagggtcaagagttataaccaggccagcacccgcagcaggccgcaaagtcacagccaatctagaagccccagaaggtcaagaagtggcagtcagaagaggacgcacagcagagtgagaagtcacagttggaagagaaaccatagcagggcaagaagtcgcacccggaagggaattctgagccagatgggaagacacagccagtctagaagccacagcaaggggaaaagtcaaaaccaatctagaacccccagaagaggaagaagtcacaactggtctagaaaccccagcaaggaaagaagtcatagccattccagaagctccagcaaagagagagatcacaggggatctagcagccccaggaaggagagtggtcgcagtcaatcaggaagccccaacaagcagagagatcacagccgatctagaagtcccaacaaggcgagagatcgcagccgatctagaagtccctacaaggcgagagatcgcagccgatctagaagtcccaacaaggcgagagattgcagccgatctagaagtccctacaaggcgagagatcgcagccgatctagaagtcccaacaaggcaagagatcatagccgatctagaagtcccaacaaggcgagagatcgcagccgatctagaagccccagcaaggaaagggatcacagccaacttggaagccctagcaaagagagagatcacagacgatctagaagccccagcaaggagagacagtgcagacaatctagaagctccagtaaagagagagatcacagacgatctagaagccccagcaaggagagacagcgcagacaatctagaagccccaacaaggagagagatcgcagccaatctagaagccccagcgaggagagagagcacagacaatccagaagccccagcaaagagagagatcgcagacgatggagaagccccagcaaggagagagagcgcagacaatctagaagctccagcgaggagagagatcacagccgatctagaagccccaataagcagagtggttacagtcgacctagagcctccagcaaggagaaagctcatagccgatctagaacccccagcaaagaaggaaatcatagccaatctagaacctctagcaaggagagcgaccccagtcaatctacagtccccagaagtcccgactggaagagatcccctactaggacaagcagtctcagtcagaatagaacccctagcaagacaagcagccactccccatcaacatttcccagtgggggccaaaccctaagccaggatgacagtcaagccgacgccaccacctctaaggccaccttacctggggaaaggtcttcatcatcttctcccaagctggcgtagcccccagtctcagctggctcacgggtctctgtcatgaccgggggaggggacaggagacaggagcagagcagcagctgagcagcgtccctccccggccagctctccacagccacacctccggccacaagttctctaatacaggatgttggcaggtagagagggatgctggatagggggaaaggaaagacctgtgatgattcaataaatttttacatagc

SEQ ID NO: 1416 - DNA, 2850 bp, Homo sapiens
actgctctcccatcccagtccctggaaatccacccacttggcccagctcaccccaactccaacccactgggacccagtctccaggggcctgactgtgggcggcagccactcctgagtgagcaaaggttcctccgcggtgctctcccgtccagagccctgctgatggggaagtccgaaggcccagtggggatggtggagagcgccggccgtgcagggcagaagcgcccggggttcctggagggggggctgctgctgctgctgctgctggtgaccgctgccctggtggccttgggtgtcctctacgccgaccgcagagggaagcagctgccacgccttgctagccggctgtgcttcttacaggaggagaggacctttgtaaaacgaaaaccccgagggatcccagaggcccaagaggagagcgaggcctgcaccacccctggctgcgtgatagcagccgccaggatcctccagaacatggacccgaccacggaaccgtgtgacgacttctaccagtttgcatgcggaggctggctgcggcgccacgtgatccctgagaccaactcaagatacagcatctttgacgtcctccgcgacgagctggaggtcatcctcaaagcggtgctggagaattcgactgccaaggaccggccggctgtggagaaggccaggacgctgtaccgctcctgcatgaaccagagtgtgatagagaagcgaggctctcagcccctgctggacatcttggaggtggtgggaggctggccggtggcgatggacaggtggaacgagaccgtaggactcaagtgggagctggagcggcagctggcgctgatgaactcacagttcaacaggcgcgtcctcatcgacctcttcatctggaacgacgaccagaactccagccggcacatcatctacatagaccagcccaccttgggcatgccctcccgagagtactacttcaacggcggcagcaaccggaaggtgcgggaagcctacctgcagttcatggtgtcagtggccacgttgctgcgggaggatgcaaacctgcccagggacagctgcctggtgcaggaggacatggtgcaggttctggagctggagacacagctggccaaggccacggtaccccaggaggagagacacgacgtcatcgccttgtaccaccggatgggactggaggagctgcaaagccagtttggcctgaagggatttaactggactctgttcatacaaactgtgctatcctctgtcaaaatcaagctgctgccagatgaggaagtggtggtctatggcatcccctacctgcagaaccttgaaaacatcatcgacacctactcagccaggaccatacagaactacctggtctggcgcctggtgctggaccgcattggtagcctaagccagagattcaaggacacacgagtgaactaccgcaaggcgctgtttggcacaatggtggaggaggtgcgctggcgtgaatgtgtgggctacgtcaacagcaacatggagaacgccgtgggctccctctacgtcagggaggcgttccctggagacagcaagagcatggtcagagaactcattgacaaggtgcggacagtgtttgtggagacgctggacgagctgggctggatggacgaggagtccaagaagaaggcgcaggagaaggccatgagcatccgggagcagatcgggcaccctgactacatcctggaggagacgaacaggcgcctggacgaggagtactccaatctgaacttctcagaggacctgtactttgagaacagtctgcagaacctcaaggtgggcgcccagcggagcctcaggaagcttcgggaaaaggtggacccaaatctctggatcatcggggcggcggtggtcaatgcgttctactccccaaaccgaaaccagattgtattccctgccgggatcctccagccccccttcttcagcaaggagcagccacaggccttgaactttggaggcattgggatggtgatcgggcacgagatcacgcacggctttgacgacaatggccggaacttcgacaagaatggcaacatgatggattggtggagtaacttctccacccagcacttccgggagcagtcagagtgcatgatctaccagtacggcaactactcctgggacctggcagacggacagaacgtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtgtggtgcgggtcctaccggcccgagttcgccatccaatccatcaagacagacgtccacagtcccccgaagtacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccacccgctgctcggaggcatctgtgcgaaggtgtagctagcggcgacccagtgtacgtcccgccccggccaaccatgccaagcctgcctgccaggcctctgcgcctggcctagggtgcagccacctgcctgacacccagggatgagcagtgtccagtgcagtacctggaccggagccccctccacagacacccgcggggctcagtgcccccgtcacagctctgtagagacaatcaactgtgtcctgcccaccctccaaggtgcattgtcttccagtatctacagcttcagacttgagctaagtaaatgcttcaaag

SEQ ID NO: 1417 - DNA, 2421 bp, Homo sapiens
ctaaaaaagaaggaactcacacttaaagatgtggaatgtaaattctccaaaatgaaaactgcttatgaagaggttacaactgaattagaagaatttaaggaagcctttgcaggagcagtgaaagctaacaattccatgtcaaaaaaattaatgaaatcggataagaaaatagcagtgatcagcaccaagctctttacggagaaacagcggatgaaatattttctcagcactcttcctacaaggccagaaccagagttaccttgtgttgaaaatcttaatagtatagaactcaacagaaaatatattcccaaaacggccataagaattcctacttcaaacccacagacttcaaataactgcaagaacttcttgactgagatggagctggaccgtgtagaacaaataattacaggaacaaagaaaagttttgctatgttgagcacttgctcccgtctactttcttttgtagaatccactgcaccaaggaagcacaggcgagcccttcccatcatgcgctcactagtccccaacagaagaaccactgtcgcatccactgagagcaggacaaacaggcccggtggtgtcaggagcccaggtctccagctggagggaacgtcaaccctgcagtgggagcaggggcccatcgcacatcctaggcacagatgctaatgcaggcactgcagaccataaaggagaacagcaagaagcccccagcaaacatccacagatggccctggacatcaaccacattctgaggaacatgtcatgttctgggagggctaaggcatcaagtaaggcctgtggggctggaggatcccaggcaaggtggggcaatccagagccatgggggcttcccatgggaattgggaggtcccaaggcagagtcagaggttccacaggaggagtcagagagtcaccaagggctctcctggcccagggagcagtcaacaccatggactgaacacttgctgggctccaacccttgggccaggctgcccatgtggggccaggaggcagctcagagtgggaggcagagagagaagtgtgctcagagggcacctgtatctggatgtaatgtggtcctgagactctggctgggaagtgcttccagggtatcatatgtgttatgcagctacttcctctccccagccttaccctgtaggaattctagtgactatgttgccaccatcttggagctccatgccctcatagtgtaatggcaccagcagatctgcctgtgcacagacttcctgtactacctcactcctgaggggagatgcttctgcgggcctgcgacctggtgctcaactttagacaccatcatcctggagcggcactgcaccctcactagccagggtgttgacgtcctcaaggccaaggccacattcaagactttggacttcattgatgcacttgtgccgagcaagcttatctgatcttctgggatctctactaggatgctggcagcccagccagctggtctggccctggacgtgccttcaggggctgggtatgcttcatgacctgtgttttggtgagtggtaagcagcacctgcttctagcttcactgttgggccagatttcatccccaccgtggctcttcattgcggctgctttctgctccctccatggaccctgcgtggaattgccccatgtttctgtttgggcaccactgaggaaggaagcatgaaggacgcacaggtcaggccattctgttgcccacctcgtgctgggtctttactcctgggatggcttcaggggcagctccttttccatgcctccccccacccaacatctctcaggttgctgctcaaaggtcacctcttggaggggtctctccctgtcactgtgtttggaacagctccctcagtttctttctagctcatctcactctggtaatgtctttcattaccaccaccatctgacctggtcttacgacctgttagcttccttcatcagacaagagcaccaggatggcaggggcctcatctgtcctgttcctcctgtggcctgggtcctagcaccatgtctggtacagtgtaggtgctcaagggaagtttactttatagaactgtctacctgggagaggttactgttagtctaagctgcactatttggtaaaccccttgctgttttgcagatcctggttggagtaaaacattccatgggaactcgggctgtgagaaatgtcctaaccacctgactgcagaaacatccttatcacatcctgctgggcaaaggcccaacagcctgacttcaggaacatccttatcatcttctactgagcagcaagctatactgtccagagccctccctcccagcgctatgattaccccagcctgtgagcggcagtgggcactgacactaagctggtttccccctccgcagggttttgctagtaataaacctgtgttgctgttg

SEQ ID NO: 1418 - DNA, 1792 bp, Homo sapiens
aactgacccatttcccccgcggggagcgcctgggcttcagcggttgctccgcggtcctctctggcgggatcggcagcagctccgcctcattccgggcccgggtcaagggctcggcctcctttggcagcaagagcctctcctgccttgggggcagccgaagcctggcgctcagcgctgctgcacggcggggcggcggccgcctgggcggcttcgtgggcaccgccttcggcagcgccgggctggggcccaagtgtccctccgtgtgcccacctgggggcatccctcaggtcaccgtcaacaagagcctcctggccccgctcaacgtggagatggaccccgagatccagagggtgcgcgcccaggagcgggagcagatcaaggcgctaaacaacaagttcgcctccttcatcgacaaggtgcggttcctggagcagcagaatcaggtgctagagaccaagtggaacctcctacagcagctggacttgaacaactgcaggaaggacctggagcccatttatgagggctacatcagcaacctgcagaagcagctggagatgctgtctggggacggggtgaggctggattcggagctgaggaacatgcaggatttggtggaggactacaagaagaggtatgaggtggagattaacagacgcacagctgctgagaatgagtttgtggtgctcaagaaggacgtggatgctgcttacatgaataaggttgagctccaggccaaggtggactccttgacagatgagattaaattcttcaagtgcctttgtgaaggggagatcactcagatccagtcccacatcagcgacacgtccatcgtcctgtcaatggacaacaaccgggatctggacctggacagcatcattgccgaggtccgtgcccagtacgaggagatcgccctaaagagcaaggccgaggctgagaccctgtaccagaccaagatccaggagctgcaggtcacagcaggccagcatggggatgacctcaagctcaccaaggctgaaatctctgagctcaaccgcctgatccagaggatccgctcagagatagggaatgtgaagaagcagtgtgccgatctggagacggccatcgccgacgctgaacagcggggggactgcgccctgaaagatgcccgggccaagctggatgagctggagggcgccctgcaccaggccaaggaggagctggcacggatgctgcgtgagtaccaggagctcgtgagcctgaagctggccctggatatggagatcgccacctaccgcaagctgctggagagcgaggagtgcaggatgtctggcgaatatccaaattctgtgagcatctccgtcatcagcagcaccaatgctggggcaggaggggctggcttcagcatgggctttggcgcctcaagcagttatagctacaaaactgcagctgcagacgtcaagaccaaaggcagctgtggcagtgagctcaaggatccccttgccaaaacctcggggagcagctgtgccaccaaaaaggcctccagatgatggacaagtggttggctctgtgtgatgcttcgatgcaaggagtccagtcaggagctctctcagtggcctccttcttggtcccgtttcgttgggtcattgcctgaaatgcaaagacaacacttacccaggatgtttccccaaggccagctacaagcccctctgcccccatgcctttcttgggccttcactaccaagggactctcttcatcttctgattgggattgtgtccagtcctctgcttcttctgcaataaatgattaaatctg

SEQ ID NO: 1419 - DNA, 1684 bp, Homo sapiens
atggagaaagcgggggaaagagcccccagacaccagtgcaaggcgctcacctggtgaaggccttgcccaacactgtgggtggaggtcagacctgtttttccataccaattgcaagaaccagcccctgctctcctactggtctgggctagagtgaacgctctctccttcccggcagctgccccaacaaagggagccgcctggtcattggtcttggattattcaggtttccaaggaagccatcggtcaggcccagatgattcagagaattcagtaagacacgacagcagatggctctggaggcccagacccccagttcccggacaagggggccaaagagccgctggggagacgaggctgctgccccaggggaaggggctccccggcggggctgtctgaggctggcctggggatgcctgctcagcttcatgtctgcctttcctggccttgttcttcctccgggcaacagttcccagcccgagaacccatgctttgtccagagccgttctccatccaggactgggtctggcatttgagaaaccgcagggaggcccaggctggctctgctgccccagctcctcagctgcctgtcgtgggcccttacaggggtcagggataccactgcattctgaagagccaagcaggccttacgcctttcccagaaggcatgggaaagcgcccagaaacgtggctgtggtttttctctttcctggtgtagtttccctccacccctgccccacctaagcaaaccccatctcccatactgactctccctcctctcttagggcacctgtggtcaaaggtaagagagtgacaatttagaggggggacattgtgagagggtgtgtgtgtgtgtgtgtgtgtgtgtgtgtgtacacaaaagaggagagagtggcttccaggacacatttctgcccactcctgtctgctcagccttaccttgccccagcaatggcacggaagggtcatcatagctaccgtcatagaaatcattaccagcctccagctcactgttgaccgggttaccgtttgcaatgctcttttgtttgactgtgaaaaaggcttgcatcttcacattgtacctggaagcgaggggaggcaggaggtcagggcaatggaaaggagtcccaccaactgggcagcgggtggatcacaccccatccctgcacgcagtcagcacagcccaggagtggtgggtggcaggggaggtgtggagccttagcttttcaactgggctgacagtttcctgacagggacctgggagcattgtgttgtctggtggcacctgctcctattgagctggtggtggacttcctggaggcatgagagaactttcacctaagaaaatgactgaggcctacttactggagcctgtcctaataaaggaagctcggcctcgcctctgggcaggctcgcagggggcattaccaggcctgtcctctctcccccagcagcagatcttgctcccaggatgctcacgggcacctcctgcacactcacagccagcactgccatcacccctgagggaagagtctctccatctcaaagaacctcaggcgggctctcgctgaaaggcactcagagtggagatcatttaaggacaatgctcttgcagtctgatagtttatcacccatctttataaaacattataaatgttttatataaatgtgggatttatatcctcat

SEQ ID NO: 1420 - DNA, 2703 bp, Homo sapiens
ccccattccttggtctcgtctgagcagttaggttccgcctgtggttgcacatttggttcatctgaggatgttcaggctggggctgctggtttgtttctacaatgacctggaattgctggatgccactgtggctcaagtcctgctttaccagatgatcaagtgcagccacctgaggggcttccaggctggcgtccagaagctcaaagcagaactcctggacattgccatggagaaccagaccctcaatgagaccctgggttctttgtcggatgcagttgtaggtttgacctacagccaactggaatccctctcccccgaggctgtgcacggagccatctccaccctcaaccaggtctcaggttgggccaagagccaggtcatcatcttgtctgccaaatacttggcccatgagaaggtgctgtctttctacaatgtcagccagatgggcgcactgctggctggggtcagcacccaggccttctgcagcatgaaacgcaaggacatctcgcaggtcctgagaagtgccgtctcccagtatgtatccgacttgtcacctgcccagcagcaaggtatcctcagcaagatggtccaagcggaagacactgccccaggcatcgtggagatacaaggggctttctttaaggaagtgtctctctttgatttaaggaggcaacctggattcaactctacagtcctgaaggataaggaacttggaaggagccaggctctgttcctgtatgagcttctgttaaagaccaccagaaggcctgaggagcttttgagtgctgggcagctggtcaaaggcgtgacctgctcacacattgatgccatgagcactgacttctttctggcccatttccaggattttcagaacaacttcgccctgctttcaccctatcaggttaattgtttggcgtggaaatactgggaagtttccagattgtctatgccacctttcctcttggctgcactcccggcccgctacctggcttctgtcccagcctcccagtgtgtgccctttctgatcagcctggggaagagctggttggactccttggttttagattcccacaaaaagacttcagtcctcaggaaagtgcagcagtgcctggacgactccattgctgatgagtacactgtggacatcatggggaacctgctgtgtcacttgccggcagccatcatcgacagggggatctcccccagggcttgggcgactgctctacacggcctcagagactgcccagacctcaaccctgagcaaaaggctgcagtgaggctcaagctcctgggacagtatggactccctcagcactggacagccgagaccacgaaggacttgggaccctttctagtacttttctcaggagatgaattaagctctatagccacaaagtttcctgagatccttctgcaagcagcttccaagatggccaggaccctgcccactaaagaattcctctgggctgtctttcagtctgttcggaacagcagtgataagatccccagctatgaccctatgcctggttgccatggagtcgtggccccctcttctgatgacatcttcaagttggccgaagccaacgcctgctgggccctggaggacctgcggtgcatggaggaagacacattcatcaggaccgtggaactgctgggagctgtccagggtttcagccggcctcagctgatgaccctgaaggagaaagcaatacaggtttgggacatgccatcttactggagagaacaccatatcgtctccctggggcgcattgctctggctcttaatgagagtgagctggagcagctggacctcagctccatagacactgtggcttccctaagctggcaaacagaatggaccccgggacaggctgaatccattttgcaagggtacctggatgattcaggatacagtatccaggacctgaagagctttcatttggtaggacttggtgcaaccctgtgtgctataaacatcactgaaatcccacttataaagatctcagaattcagggtggtagtggccagaattgggaccctgctctgcagcacacatgtcttagccgagtttaagaggaaggctgaagttgtgtttggggatcccactgagtggaccagttctgtcttgcaggagcttgggaccattgcagctggattaactaaggcagagctccggatgcttgacaaggatttgatgccatatttccagccatcagcaataaaatgccttcctgatgagatattcaaagagctgtccgcggagcagatcgcctccctgggtccggagaacgccgcggcggtgacccacgcccagcgccggcggctcagtccactgcagctgcagagcctccagcaggcgctagatggcgccaagactcactcctggcaggacgcgcccgctagcgccggtcccactagaacctcatcctcgcgttctcccgcaggagctctccagtcgtggggtctttggcttggttgtcccctgctggttctaatggccaagctcctgtggtgagtggcctgagcgcatcgtcctgtgttgccccaagcagctggccaacatgtgtagagacaggatgctccagatggtgggacacccttccctggatccagaccctcatctagggcagggaaaccctggggccttgatggtgaaaatgcaccccaaatgaaaaataattattaaaaatgatcttgcaaatt

SEQ ID NO: 1421 - DNA, 2230 bp, Homo sapiens
gtgctcctcttccagaagacaggaggtttgctgttgtgagggctgctctttcctgggggagggaatgggaagggctcacctggtggctgccctggtggtgctcagccttggcttgagtgtctggcatactggctgggcccggatatttgtatgtggagccaagagggtggggcgggaaggagggggaaagagctaccagcaaaaaagtggttaacacaacagagttgctgcaggctctggtttgaggcaggttatgaaaccacatcagggcccagcactaagcagccacctgccagctatggcagcagaagttttcggctcaactcctgtagacctagtcgacctctgccagcctcttctctctgtttctccccatctagggtaggggccagttggttgttttactaatggaagtgatatgtatccatagtcacacgaaagtctcaagagtgtttcctcattgccagtctttttgttagtttattgatctcttctttttcaggggtctctggtggtttcctgctctcagggcacctagtgtttaggcttcaggaagaagcttctgagggtgttggctaggacctaggtctaggcttttcctaggctcatcaagttttgttggctgccctgtgaaagccagaaaggcgtatggggtcctgtgatctgggattccccaaggcttttggcactcctggacaaatactaggaagggttagtggactttctataccagcacccctgtaggtgcgggttacagagaggtgatggggtggcagtttcaggtcagacttgggaagctctttccctctccttagtcagagttaagtccttcagagccctcacttgtcagccacatgccgccctcccctctcaggtggaggcttttgcgtagcagctgtcccaggggctgctagagtaactgaagccccaaggccctgggaagataaacaatctgagccagctctggctttctagatacttgaatttctgttaggctcaattatccagcctagtgggctgcgctgatgggtcccaggagcatctcttcaatcagaatgcgccccaggctggcgcacgggtgtttgcttgttgggatggcgtgttgtgggtcacattttctctgaggtctctaagcttggagctgtctgagaagaggaaacttgctcctgttatcctggaagtaaataactggcccctgaggactcagtctcctgtgcagggccctcagggatctggggacagccaaactctggataaggggcagatcattccaccccttccttctctacttccctctgctcactgtgggttgcggccacctcctggttcctcctgctgcaggactcctaccgttggtgctgggcaggggaaggcatggtgctaatatacacctggaaacaggtgctgagaggggagactgagtcctcctaagttggggtttggggagatccagaattgaaaaaatcagaggagaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatgggggttgagcctctggcctaatttcccccctcgcttcccccagtagccaacttggagtagcttgtagtggggttggggtaggccccctgggctctgaccttttctgaattttttgatcttttccttttgctttttgaatagagactccatggagttggtcatgg

SEQ ID NO: 1422 - DNA, 1811 bp, Homo sapiens
atcaagactggcacccagaaacaggcgaaaacagacatggcatttaagaccagtgtggcagtggaaatggctggggctccatcctggacaaaagttgctgaggaaggggacaagccacctcacgtgtatgtgcctgtagacatggctgtcaccctgccccggggacagctggctgccccactgaccaatgcctcatcccagagacatccaccctgcctgtcccagagaccactggccgccccgctgaccaaggcctcatctcagggacatctgcccactgagctgaccaagaccccatccctggcccatctggacacctgtctgagcaagatgcattcccagacacatctggccacaggtgccgtgaaggtccagtcccaagcgcctctagccacctgtctgaccaagacgcagtcccgggggcagccgatcacagacataaccacgtgcctcatcccagcgcaccaggctgctgatctcagcagcaacacccactcccaggtgctcctaacagggtccaaggtgtccaaccacgcctgccagcgcctcggtggcctcagcgccccaccctgggccaagccagaggacagacagacccagccacagccccacggacacgtgccggggaagaccactcaggggggaccatgcccggcagcctgtgaggtccagggtatgctggtgccgccgatggcacccaccggccattccacatgcaacgttgagtcctggggagacaacggagccacacgtgcccagccatcaatgcccggccaggcggtgccctgccaggaggacacgggccccgcggacgctggtgtggttggtggccaatcgtggaaccgcgcatgggagccagccaggggtgctgcgtcctgggacacctggcgcaacaaggcggtggtgcctcccaggcggtccggggagccaatggtgtccatgcaggctgcagaggagatccgcatcctcgcagtgatcactatccaggcgggcgtccgtggctacctggcgcgtcgcaggatccggctgtggcaccggggggccatggtcatccaagctacttggcgcggctaccgtgtgcggcggaacctggcacacctctgcggagccaccacgaccatccagtctgcctggcgcggctacagcacccgccgggaccaagcccggcactggcagatgctccaccccgtcacgtgggtggagctgggcagccgggccggggtcatgtctgaccgaagctggttccaggatggcagagccaggacagtatctgaccatcgctgcttccagtcctgccaggcacacgcttgcagcgtctgccactccctgagctccaggatcgggagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcgaggccaccatacccggagctgtctgaagaacacagaggcgctcttgggaccagcagacccctcggccagctcacggcacatgcattggcctggcatctaggaccctggctccctgcagtggggacttcgtgggaggcactcatggctctctgggtctaatgaataaagtcctccacagcctag

SEQ ID NO: 1423 - DNA, 2446 bp, Homo sapiens
aggcacctctggggtggcacctggcacaacagttgcccctggaagtttcagcacagcagctacaacttctcctggagcaagtggagtgactggcactggacccactgcagagaccacaactttcctaggaggaagtagcaccactggagcagaaataaaatcaggagccaccactggagcaccaggaagtaagacaggcacagctaaagtgctctctggtacgacagttgcctctgggagctccaactcagaggctacaactttctctggaatcactgaagcagtaacagtcccaagtaaaaatggatctatgaccactgcactggggagccaactctccagcagtcaaacagtgattccaggttccagtggcaccatctctcacacaactgttgcacctggaagttctgttacaggaaccaccactggtgcatcagatgatcaagtcactggaagtaaaacaggcactactggtgtggccttgagcacaactgttgcacctggaagttccagtacagaagccacaacttccacaggagtccatagaaccactgtagtgggacagaagacaggagctaccactagagggtcagcaaagcaaggaactagaagcacaatagaagctacgacgtcctttagaggcactgggaccacaggaagtggaatgaatacaggtactactggagtggtctctggcaacaccatctcacctagcagtttcaacacagaagctaccagtggcacatctgagaggccaaaccctggaagtgaaataggcaccactggcatagtctctggcacaacagttgcacctggaagttccaacacagaagccacaacttctttgggcaatggtggaaccactgaggctggaagtaaaatagttaccactgggataactactggcacgaccattgtacctgggagtttcaacacaaaggctaccacttctacagacgttggagttgccactggagttggaatggcaactgggatcaccaacataatttcagggagaagccaacctactggaagtaaaacaggctacactgtaacaggctctggaacaacagccttacctggaggtttcagaacagattctccatcttttccacttttcttgatttgctcttacagaggccacaacttttaaaggtgatgttggaaccactgaagcagaaatttcatcaggcaataccccaggatcaacgggagtcaccagcagccaagaaggaaccactgtggtatcaagtggaatcactggaatcccagaaacttccatctcaggtccttccaaggaagcatctgacaaaaccactgctcctggacctcctaccacagtcactgcttccacaggagtcaaagaaacttctgaaactggagtgcaaacaggctccaccttggttacagctggagtgccaacaagaccacaagtatcccagccagaaaccactgtcgtggcaaccagagaagtagaaaccgaaaataaaacagaatgtctagcctcacttccaccagctccaggtttgtcacggtccattgggagaagagaaatctcctggagacatatggactgccaattgccacagaggtacctgtactgatgcaaagactatagactgtaaacctgaggagtgcccttctccacccacatgcaaaaccggcgagaagcttgtgaagttccaatctaatgacacctgctgtgaaatcggatactgtgaaccaagaacatgtttatttaacaatactgactatgagattggtgcttcattcgatgaccccagcaacccctgtgtctcctactcctgcaaagacacgggctttgctgcagtagtccaggactgcccaaagcaaacctggtgtgcagaagcaagtcatcttaactaatgaacgccgagattcagttctcatattaaacaaaccctggccgggcgcggtggctcaggcctgtaatcccagcactgtgggaggccgaggcgggcggatcacctgagatctgaggaagacagaatctatgattcaaaaaaatgttgctatacatgtaagaataattgcagatcttcccttgtaaatgtgactgttatctacagtggttgcaagaaaagagttcagatggcaaaatgcacaggggaatgtgaaaagactgccaagtacaattatgatatcttactcttggaacattcatgcctttgctgccgagaagaaaactatgaactcagagacattgtacttgactgtcctgatggcagtacaatcccttaccaatacaagcatatcacgacctgctcttgtttagacatatgccaactatatacgaccttcatgtacagttaatgctgacatcaccttcccagttttaacaggcctggtatttattttataagtgaggaaaaataatcatttaaaaagtgagaataaactaaacaatgtgagaataactcaaaac

SEQ ID NO: 1424 - DNA, 1750 bp, Homo sapiens
agcaccaggcacagggccaggcacatgggagccagctcagtgagctgagtgagtgaggtccctctcctcccactcctcctgcgggaggcaggtacgagcacctggtgaatctgctgaccaagatcctgaaccagcggcctgaggaccccttgtctgtcctggagtctctgaaccgcaccacgcagtgggagtggttccaccccaagctggacacgctgcgggacgaccccgagatgcagcccacctacaagatggcggagaaacagaaggcgctgttcacccggagtggaggcggcactgaaggcgaacaggagatggaggaggaggtgggggagacaccagtgcccaacatcatggagactgccttctacttcgagcaggccggcgtcggcctgagctcggacgagagcttccgcattttcctggccatgaaacagctggtggagcagcagcccatccacacctgtcgcttctggggcaagatcctgggaatcaaacgcagctacctggtggccgaggtggaattccgggagggcgaggaggaggcagaggaggaggaggtggaggagatgacggaaggtggcgaggtcatggaggcgcacggcgaggaggagggcgaggaggacgaggagaaggccgtggacatcgtccctaagtccgtatggaagccgccgcccgtgatccccaaggaggagagccgctcaggcgccaacaagtacctgtactttgtgtgcaacgagccgggcctgccatggacgcggctgccccacgtcactccagcccagatcgtgaacgcccgaaagatcaagaagttcttcacaggctacctggacacgccagtcgtcagctacccacccttcccgggcaacgaggccaactacctgcgggcccagatagcccgcatctcggccgccacgcaggtcagcccgctgggcttctaccagtttagtgaggaggagggcgacgaggaggaggaaggtggtgctgggcgcgactcctacgaggagaacccggacttcgagggcatccccgtgctggagctggtcgactccatggccaactgggtgcatcacacacagcacatcctgccgcagggccgctgcacttgggtgaaccctttgcagaagacagaggaggaggaggacctgggggaggaggaagagaaggcagatgaggggccagaggaggtggagcaggaggttggccccccactgctaacgccactttcagaagatgcagaaatcatgcacctggcaccctggaccacccgcctgtcctgcagcctctgcccgcagtactcagtggccgttgtgcgctccaacctctggcccggggcctatgcctatgccagtggcaaaaagtttgagaacatctacatcggctggggtcacaagtacagccccgagagcttcaacccggccctgccagcccccattcaacaagagtaccccagtggcccagagatcatggagatgagtgaccccacagtggaagaggagcaggctctgaaagcagcccaggaacaagccctgggagccacagaggaggaggaggagggcgaggaggaggaggagggcgaggagacagatgactgaggcccaccctctagccactttccccaagcaggtagatagcaaatttccccttagaggtagttagcatggattatattttcactatgtgcttcctgtccccagagggcagggatagaaaaggaaggcaactgcttcaaataaaattcctccacggc

SEQ ID NO: 1425 - DNA, 2256 bp, Homo sapiens
gatgcccaagccatgctgcacacatattaagtcaaattctggaggtgagactcagacctatcattattattttaaactccacaagtgttttaatgtttagccaagtttaagaaccaatacttttagaaagcattaggaaagaatgccagtatagcatggtggaaagcgtaaggcttgagaaccagccctgtgacctaagagtgggcagctggatccacgtctaccctaatggatccctgtttattggatcagtaacagaaaaagacagtggtgtctacttgtgtgtggcaagaaacaaaatgggggatgatctgatactgatgcatgttagcctaagactgaaacctgccaaaattgaccacaagcagtattttagaaagcaagtgctccatgggaaagatttccaagtagattgcaaagcttccggctccccagtgccagagatatcttggagtttgcctgatggaaccatgatcaacaatgcaatgcaagccgatgacagtggccacaggactaggagatatacccttttcaacaatggaactttatacttcaacaaagttggggtagcggaggaaggagattatacttgctatgcccagaacaccctagggaaagatgaaatgaaggtccacttaacagttataacagctgctccccggataaggcagagtaacaaaaccaacaagagaatcaaagctggagacacagctgtccttgactgtgaggtcactggggatcccaaaccaaaaatattttggttgctgccttccaatgacatgatttccttctccattgataggtacacatttcatgccaatgggtctttgaccatcaacaaagtgaaactgctcgattctggagagtacgtatgtgtagcccgaaatcccagtggggatgacaccaaaatgtacaaactggatgtggtctctaaacctccattaatcaatggtctgtatacaaatagaactgttattaaagccacagctgtgagacattccaaaaaacactttgactgcagagctgaagggacaccatctcctgaagtcatgtggatcatgccagacaatattttcctcacagccccatactatggaagcagaatcacagtccataaaaatggaaccttggaaattaggaatgtgaggctttcagattcagccgactttatctgtgtggcccgaaatgaaggtggagagagcgtgttggtagtacagttagaagtactggaaatgctgagaagaccgacatttagaaatccatttaatgaaaaaatagttgcccagctgggaaagtccacagcattgaattgctctgttgatggtaacccaccacctgaaataatctggattttaccaaatggcacacgattttccaatggaccacaaagttatcagtatctgatagcaagcaatggttcttttatcatttctaaaacaactcgggaggatgcaggaaaatatcgctgtgcagctaggaataaagttggctatattgagaaattagtcatattagaaattggccagaagccagttattcttacctatgcaccagggacagtaaaaggcatcagtggagaatctctatcactgcattgtgtgtctgatggaatccctaagccaaatatcaaatggactatgccaagtggttatgtagtagacaggcctcaaattaatgggaaatacatattgcatgacaatggcaccttagtcattaaagaagcaacagcttatgacagaggaaactatatctgtaaggctcaaaatagtgttggtcatacactgattactgttccagtaatgattgtagcctaccctccccgaattacaaatcgtccacccaggagtattgtcaccaggacaggggcagcctttcagctccactgtgtggccttgggagttcccaagccagaaatcacgtgggagatgcctgaccactcccttctctcaacggcaagtaaagagaggacacatggaagtgagcagcttcacttacaaggtaccctagtcattcagaatccccaaacctccgattctgggatatacaaatgcacagcaaagaacccacttggtagtgattatgcagcaacgtatattcaagtaatctgacatgaaataataaagtcaacgacatctgggcagaatttattttttggaagaagtttaatcaaaggcagccataggcatgtaaatgaatttgaatacatttacagtattaaatttacaatgaacatgcaaaataaaaggacttgtaaat

SEQ ID NO: 1426 - DNA, 1818 bp, Homo sapiens
agtcctcttctggggacttacgggccactttgttatgatgagtcctgggccctatggagccattgttgaggatttccagcagcacccagtctgcatcaacaacttctggaagcagagagtccctgaaccttggagcaaggagaggtatttgagattaggttgtttctgcttcctccgtttaccaatagggagagtcggatggagagaggcctgcatcaccctctggggcacatggcttgtgtggagggagcagcagctccttgggagttgagggtgcagaatcaggggcagcgtggatggccttggggtcaggccaccctgggctcaaatcctgactgttgctgtgccactgagcatgtgcctgagctctctgggccgcagtctcatgctggctggatgagtggcatctcagggctgccgtgtgccacgaaggcaccgagagcaggacttgtgcaggatgtgcgtccaccagtaccatacaccatcttcctgatgagggccagggcaaccaaggtcctttgtagacaccagcaccttctaacttggtgaggtcctggctgccgtgccgtgcatggagtcacctgcctgcaaacagccactctctatcctgctccagtccagtttgaaaaacaagcaaggtctattccagtgaagagccaccagggaagagtcaaggagggcatctgctgttcaaaccctgaccccctcttgctaatgatggcatcacgcttacttttagatgtaacatacagcctcggaggggttggaggagaggtccatggagatcacctggctcagccttctcgttttccagatgattttttttagtccaaagagactaaatgacttgactaaggccacacagcatgtcagcgggccagctaggactccacccacagcccctgagtctggggatccctgtgctcttggctctgagcaaggctgcctcacttcattttagtttagtctgtgtgacttgagcacaagttctgcacacaaaactgtgcaaggccactaatagcactcacagagcagtgctatcccttccttcctttgaaatggtggaggtggagacagtacatacaagagttactcaagacaaggatgggggtgcagggaggaagccgagcccttccatgccacctctgagacagctggagggcatagccgctccatggctgcagcccggtttagaatgtgccaggggtggggtcaggcaccgctttcttaaatgatctttcctctgttgtctcaagacattttccaagtaccagacaggacaaaatggcttagatgtaagcctctctactttgccgcaggccccagtgctctctgttgtcccacctaggctcctgctgcctgccctgatgtctgcagattcacttggtcaagaggagttccttctatgcctgctgtgtttttcagccatagcacagaactgttttatggggggagcatgctcatgcgctaaatcagtggtctctcactcagggaggaagagaggccaacatttgctgagggcttactgtgccctgggttctcagctgtccccacgagggggtgcaatgcccttggttttaaagagatgaaaatatcaaggctccaagaggtaaaaaacttgccccaggccacctagatgtggctggtgaagctatgtttgaacccaccgctgactaactccaaaattcatattcttttctcttctctcggctgtcttccaagtatccagaatggactgtctggaaagcgttctgttagtacttcttgactgtgggactacaggtctttgagtttctcctaataaagtgatttctgatg

SEQ ID NO: 1427 - DNA, 2273 bp, Homo sapiens
aaaagtggagggagggggtgaaaatggcgcccagctcgaaatcggagcggaacagcggggctgggagcggcggcggcggccccgggggagccggagggaagcgggcagcagggcggcggcgggagcacgtcctcaagcagctggagcgggtcaagatcagcggacagctctcccctcgcctcttccggaagctgcctccccgggtgtgcgtgtccctcaagaacattgtggatgaggacttcctctatgcaggacatatcttcctgggcttttccaaatgcggccgctacgtcctctcctacaccagcagcagtggggatgacgacttctccttctacatctaccatctgtactggtgggagttcaacgttcacagcaagctcaagctggtccggcaggttcggctattccaggacgaggagatctacagcgacctgtacctgaccgtatgcgagtggcccagcgacgcctccaaggtcatcgtcttcggcttcaacacccgctcggccaacgggatgctcatgaacatgatgatgatgagtgacgagaaccaccgtgacatctacgtcagcaccgtggccgtgccaccgccaggccgctgtgctgcttgccaggatgccagccgagcccacccaggagacccgaatgcacagtgcctacggcatggcttcatgctgcacaccaagtaccaggtggtctaccccttccccaccttccagcccgccttccagctcaagaaggaccaggtggtgctgctcaacaccagctactccctggtggcctgcgccgtctccgtccactcggcaggtgacaggagtttctgccaaatcctgtatgaccacagcacctgccccctggcgcctgccagcccccctgagccccagagcccagagctgccccctgccctccccagcttctgccctgaggcggccccagcccgttcttctgggtctcctgagccctcgcccgccattgccaaagccaaggagtttgtggctgacatcttccgccgggccaaagaggccaagggcggggtccctgaggaagcccggcctgccctgtgcccaggaccctctggcagccgctgccgtgcgcactctgagcccctagccctgtgtggagagacggcaccccgggacagcccccctgcctcggaggcacctgcctccgagcctggctatgtcaactacaccaagctgtactatgtgctggagtccggagaggggacggagccggaggatgagttggaggacgacaagatctccctgcccttcgtggtgactgatcttcgtggccgcaacctgcggcccatgcgggagcggactgctgtccagggccagtacctgacagtggagcagctcacactagacttcgaatatgttatcaatgaggtcatccgccacgacgctacctggggccatcagttctgttctttcagcgactatgacatcgtcattctggaggtctgcccagaaaccaaccaggtcctcatcaacattggcctgctgctcctggccttcccgtcccccactgaggagggccagctccgaccaaagacctatcacaccagcctcaaggtggcatgggacctcaacacagggatcttcgagacagtcagtgtaggcgacctgactgaggtcaaagggcagaccagcggcagtgtctggagctcctaccgcaagagctgcgtggacatggtcatgaagtggctggtgccggagagcagcggccgctacgtcaacaggatgaccaatgaggcgctgcacaaagggtgctccctgaaggttctggcggacagcgagcgatatacgtggatcgtgctgtgagggccaggccgccccagacactgactccaactacctccgtggcctgggaccggcccccttcctggggtggcctcttcctggccggctggcccaccgactgatgaccggcactagtgttagcctgcggaacggggctgggcagggcagcctctgttggcctgagggtctggacgctttttatttatgcctatttaagttgggaaggggcagagagagggcgccccctgccccaccagcctgagtgccccgccttcaccccgagctgggcatgggcctggcccctcgtgcatttgcccttttctcggctacagctgtggacgttgccctcggggaggtcgaatggaccccattccccctgccctgcccgcccccagcctccccacccaggccggcaacctggccatccccattccgttcttcttcatgtaataaatgttttaatttctg

SEQ ID NO: 1428 - DNA, 2590 bp, Homo sapiens
atgactttcaagccctgtgtcttggagggcactgtgatctggaagttcaccttccccatgaaaaaacccaaaccagcctctccttttcctgcatggtgatccgtctgtaatgatcagtgacattctcagaattaaccaatcaggaaattcttggaaagtccacgcctcagcatttagtgcttgggaaattctacttccagatcccagaggggacagagcagatttccagttctcctagcaccaccatgatctcaggactaaccactgcacacccgtgatgggattccaaaccttcgctgcaagaggacaaggtgacgagttgctgacagtgaaggctaaactaacgcggacagtgaagtgctacatgagtcggactcagactccaggtgaagcagccagcagaggtcagagagagacagctcacgttccggaatagttctccagacccccagctggccatgtggtgagttcagggcccaaatcaagtagtaccagcaatcagggaactcctatctgttttgaatggattcacaccagccacaagcctggaaagatggtgtcacaatctacagtcaggcaggattctcctgtggagccctgggaagggatcagcgatcactctggcattattgatggttcgcccagactcctgaacactgaccatcctccttgccaattagacatcaggctcatgaggcacaaagctgtctggattaacccccaggatgtgcagcaacagccgcaggacttgcaatctcaggtgccagcagcagggaacagtgggacccattttgtgacagatgctgcctctccctcaggcccttcaccttcgtgcctcggggactccctggcagagacaacgttgtctgaggataccacagactccgttggcagcgcttctccccatggctcgagtgaaaagagtagcagcttctctctgtcctcaacagaggtacacatggtccgcccaggatactctcatcgggtgtctctgcccacaagccctgggattttggccacctccccatatcctgagactgacagtgctttttttgagccttcccatctgacatctgctgctgatgaaggtgctgttcaagtcagtagaagaaccatttcttcgaattccttctcaccagaggtatttgtgctgcctgttgatgtagaaaaggaaaatgcccacttttatgttgcagatatgattatatcagcaatggagaaaatgaagtgtaacattctgagtcaacagcagacagagagctggagtaaagaagtcagtgggttacttgggagtgatcagcctgactctgaaatgacttttgataccaacataaagcaagagtctgggtcttctacttcttcatacagtggctatgaaggttgtgctgtgttacaggtcagcccagtgactgaaacacgtacttaccatgatgtgaaagagatttgcaaatgcgatgttgatgaatttgttattttagagcttggagattttaatgatatcacagaaacctgtagctgttcctgcagctcctctaagagtgtcacttatgagccagacttcaattctgcagaactattagccaaagagctgtaccgcgtgttccagaagtgctggatactgtcagtagttaattctcagctggcaggttccctgagtgcagctggctcgatagtcgtaaatgaagagtgtgtccgaaaagactttgaatccagtatgaatgtagtacaggaaattaaatttaagtctaggatcagagggactgaagactgggctcctcctagatttcaaatcatatttaatattcatccaccactcaaaagggaccttgtggtggcagcccagaattttttctgtgccggctgtggaactccagtagagcctaagtttgtgaagcggctccggtactgcgaatacctagggaagtatttctgtgactgctgccactcatatgcagagccgtgcatccctgcccgaatcctgatgatgtgggacttcaagaagtactacgtcagcaatttctccaaacagctgctcgacagcatatggcaccagcccattttcaatttgctgagcatcggccaaagcctgtatgcgaaagccaaggagctggacagagtgaaggaaattcaggagcagctcttccatatcaagaagctgttgaagacctgtaggtttgctaacagtgcattaaaggagctcgagcaggtgccgggacacttgactgatgagctccacctgttctcccttgaggacctggtcaggatcaagaaagggctgctggcacccttactcaaggacattctgaaagcttcccttgcacatgtggctggctgtgagctgtgtcaaggaaagggctttatttgtgaattttgccagaatacgactgtcatcttcccatttcagacagcaacatgtagaagatgttcagcgtgcagggcttgctttcacaaacagtgcttccagtcctccgagtgcccccggtgtgcgaggatcacagcgaggagaaaacttctggaaagtgtggcctctgcagcaacatgatgcccctgagtactgtgaaaaagactgttcaacatgccttatgataac

SEQ ID NO: 1429 - DNA, 2894 bp, Homo sapiens
gaaaagaaacgggaagtggccgtgggccggtgaattccgtgtagtggccaagctttgttccaaagagggggaggtgttgacagtctcttgcccactgaagcgtgccagacagagtgctaggcatgggggcagaggtgaatcagatgacagccacctctcaccacgaggagtggctgaaagtgtggctggactacaggcaatcctggccttggcagggagtggggccagccagcagaaacagtgggctgtacaacatcaccttcaaatatgacaattgtaccacctacttgaatccagtggggaagcatgtgattgctgacgcccagaatatcaccatcagccagtatgcttgccatgaccaagtggcagtcaccattctttggtccccaggggccctcggcatcgaattcctgaaaggatttcgggtaatactggaggagctgaagtcggagggaagacagtgccaacaactgattctaaaggatccgaagcagctcaacagtagcttcaaaagaactggaatggaatctcaacctttcctgaatatgaaatttgaaacggattatttcgtaaaggttgtcccttttccttccattaaaaacgaaagcaattaccaccctttcttctttagaacccgagcctgtgacctgttgttacagccggacaatctagcttgtaaacccttctggaagcctcggaacctgaacatcagccagcatggctcggacatgcaggtgtccttcgaccacgcaccgcacaacttcggcttccgtttcttctatcttcactacaagctcaagcacgaaggacctttcaagcgaaagacctgtaagcaggagcaaactacagagatgaccagctgcctccttcaaaatgtttctccaggggattatataattgagctggtggatgacactaacacaacaagaaaagtgatgcattatgccttaaagccagtgcactccccgtgggccgggcccatcagagccgtggccatcacagtgccactggtagtcatatcggcattcgcgacgctcttcactgtgatgtgccgcaagaagcaacaagaaaatatatattcacatttagatgaagagagctctgagtcttccacatacactgcagcactcccaagagagaggctccggccgcggccgaaggtctttctctgctattccagtaaagatggccagaatcacatgaatgtcgtccagtgtttcgcctacttcctccaggacttctgtggctgtgaggtggctctggacctgtgggaagacttcagcctctgtagagaagggcagagagaatgggtcatccagaagatccacgagtcccagttcatcattgtggtttgttccaaaggtatgaagtactttgtggacaagaagaactacaaacacaaaggaggtggccgaggctcggggaaaggagagctcttcctggtggcggtgtcagccattgccgaaaagctccgccaggccaagcagagttcgtccgcggcgctcagcaagtttatcgccgtctactttgattattcctgcgagggagacgtccccggtatcctagacctgagtaccaagtacagactcatggacaatcttcctcagctctgttcccacctgcactcccgagaccacggcctccaggagccggggcagcacacgcgacagggcagcagaaggaactacttccggagcaagtcaggccggtccctatacgtcgccatttgcaacatgcaccagtttattgacgaggagcccgactggttcgaaaagcagttcgttcccttccatcctcctccactgcgctaccgggagccagtcttggagaaatttgattcgggcttggttttaaatgatgtcatgtgcaaaccagggcctgagagtgacttctgcctaaaggtagaggcggctgttcttggggcaaccggaccagccgactcccagcacgagagtcagcatgggggcctggaccaagacggggaggcccggcctgcccttgacggtagcgccgccctgcaacccctgctgcacacggtgaaagccggcagcccctcggacatgccgcgggactcaggcatctatgactcgtctgtgccctcatccgagctgtctctgccactgatggaaggactctcgacggaccagacagaaacgtcttccctgacggagagcgtgtcctcctcttcaggcctgggtgaggaggaacctcctgcccttccttccaagctcctctcttctgggtcatgcaaagcagatcttggttgccgcagctacactgatgaactccacgcggtcgcccctttgtaacaaaacgaaagagtctaagcattgccactttagctgctgcctccctctgattccccagctcatctccctggttgcatggcccacttggagctgaggtctcatacaaggatatttggagtgaaatgctggccagtacttgttctcccttgccccaaccctttaccggatatcttgacaaactctccaattttctaaaatgatatggagctctgaaaggcatgtccataaggtctgacaacagcttgccaaatttggttagtccttggatcagagcctgttgtgggaggtagggaggaaatatgtaaagaaaaacaggaagatacctgcactaatcattcagacttcattgagctctgcaaactttgcctgtttgctattggctaccttgatttgaaatgctttgtgaaaaaaggcacttttaacatcatagccacagaaatcaagtgccagtctatctggaatccatgttgtattgcagataatgttctcatttatttttgatgtagaatttacattgccatgggtgttaaataagctttgagtcaaaagtcaagaaagtgactgaatatacagtcaccttttatg

SEQ ID NO: 1430 - DNA, 1820 bp, Homo sapiens
agtcacaataataggtacttaaaaacatgtcatatgataggaaactagaataacacacccctaaataatccatggattaccaacttctcagcaatggtgtaaattcttctgctaaataacccgtgggttaaagaggacatcacattggaaattccagagtacttaaaataagtcagataaatatgatgcacgtgatgttgaaaggctacaacaagatgataactgggttgaaagttacttatcttggagacataatattgtagatgaaacactgaagatgctcgatgagagttttcagtggaggaaagaaatttctgtcaatgaccttaatgaatcctccattcccagatggttattggaaattggtgttatttatctccatggttatgacaaagaaggtaacaaattgttctggatcagggtgaagtatcatgtaaaagaccagaaaaccatattggacaaaaagaagctcatagcattctggttggaacgttatgctaagagggaaaatgggaaacctgtaacagtgatgtttgacctgtcagaaactggaataaatagcattgacatggactttgtacgctttatcatcaactgctttaaggtttattaccctaaatacctctcaaaaatagtgatctttgatatgccttggttaatgaatgctgctttcaaaattgtgaaaacctggcttggtccagaagcagtgagcttgttgaagtttacaagcaaaaatgaagtccaggactatgtcagtgtagaatacctgcctccccacatgggtggaactgatcctttcaagtatagctatccaccactagtagatgatgacttccagaccccactgtgtgagaatgggcctattaccagtgaggatgaaacttcaagtaaagaagacatagaaagtgatggcaaagaaacattggaaacaatttctaatgaagaacaaacacctcttcttaaaaagattaacccaaccgaatctacttccaaagcagaagaaaatgaaaaagttgattcaaaagtgaaagctttcaagaaaccattgagtgtatttaaaggccccttactacacatcagcccagcagaagaactgtactttggaagtacagaatccggagagaagaaaaccttaatagtgttgacaaatgtaactaaaaatatagtggcatttaaggtgagaacaacagctccagaaaaatacagagtcaagccaagcaatagcagctgtgacccgggtgcatcagtggatatagttgtgtctccccatgggggtttaacagtctctgcccaagaccgttttctgataatggctgcagaaatggaacagtcatctggcacaggcccagcagaattaactcagttttggaaagaagttcccagaaacaaagtgatggaacataggttaagatgccatactgttgaaagcagtaaaccaaacactcttacgttaaaagacaatgctttcaatatgtcagataaaaccagtgaagatatatgtctacaactcagtcgtttactagaaagcaataggaagcttgaagaccaagttcagcgttgtatctggttccagcagctgctgctttccttaacaatgctcttgcttgcttttgtcacctctttcttctatttattgtacagttaaagaagtggtgccgggtaggaaccacggttccttcgtccattagttggaaaaagtaacagacctaaaactctaccaagctactaaaaacattgcacatctgtgcttcctaaaaggaaatatgcagcacgtggaggggaacacatacatgtcttgaaaataaactgctagaataaag

SEQ ID NO: 1431 - DNA, 3090 bp, Homo sapiens
gaaaccggaggacgcccggtagccgcccccaccgcctccgccccaggcaaggccggccggcgccgcggaaagcagcctcggggaaggaggaggaagaggggcaggtgtagggagtgaagaagcaaaaagaggaggaggaagaggagctcagggccgtccccgcgcaattaatgggcggctcctgcgccctggaccggcccgcccgcccagcccctcgacccctgtagccccggcaggggaggaagggcagacccacaggtcagggattaggaatcatgttgcatgacgcaagggacaggcagaagttcttcagcgatgttcagtatctgcgggacatgcagcataaggtggactctgagtatcaggcttgtctgagacgacaggaatatagaagagacccaaatgagaagaaacgcgatcagttttgggggcaagagacaagttttgagagatcccggttttctagcaggtcatcttccaaacagagttctagtgaggaggatgctctaactgaaccaaggtcatctatcaagatatctgcatttaagtgtgactccaaacttccagcaattgaccaaacatcagtcaagcagaaacataaaagtaccatgactgtaaggaaagcagagaaagtggaccccagcgaaccctctccagcagaccaagcaccaatggttttattaagaaagaggaagccaaacctgaggagatttacagtcagcccagaatcgcacagcccgagagcatctggggacagaagcagacagaaacagcagtggcctgcaaaggtgccggttcccaggggagcagatcaagtagttcaacaagaaggcctgatgtgtaacactaagctgaagaggccaaatcaagagagaagaaacttggtcccatcgtcacagccaatgactgagaacgcccctgatagagccaaaaaaggagacccgagtgctccttcccagagtgagctgcatccagccctgtcccaggccttccaaggaaaaaatagtcctcaagtattgagtgagttctcggggccaccactcacacccaccactgtaggagggccaagaaaggcatcatttaggttccgagatgaagacttttattccattttgtcattgaacagcagaagagaaagcgatgacactgaagaggaaacccagtctgaagaatgtctgtgggttggtgtgcgctcaccctgttctccttcccatcacaaaagaagtagatctggggggacatcgacccctcaggccaaaaataaaaattttgaagaaaatgctgaaaattgcagaggtcattcttcaagaagaagtgagcccagtcatggctcattgagaataagcaatgcaatggagccagcaacagagcggccttctgctgggcaaaggttgtcccaagaccccgggctgcctgatagggaatctgctacagagaaggacagaggtggcagtgaaaatgcgaaaaagagccctctttcgtgggacaccaaatccgagcccagacaagaggttggtgtcaatgctgaaaatgtatggagtgattgtatttctgtggaacataggcctggcacccatgattctgaaggatactggaaagactatttaaacagttctcaaaattctcttgactactttatttctggcagaccaatatctccaagatcatcagtgaattcatcctataaccctcctgcatcattcatgcattctgctctgagagatgatattccagtagacttgtcaatgtcatcgacttcagttcacagctcagactcagagggaaactcagggtttcatgtttgccaaccactgtctcccattagaaataggactccatttgccagtgccgaaaaccataattatttcccagtaaatagtgcacacgaatttgctgtcagggaagcagaagatactactttaacaagccagcctcagggggctccactatatacagatctcttactaaatccacagggcaatttgtccttagtggattcttccagctcctctccatcaagaatgaactcagaaggccatttgcatgtgtctgggtctctgcaagaaaatacaccatttactttctttgcagtgtctcatttcccaaatcaaaatgataatgggagcaggatggcagcctctggtttcacagatgaaaaggaaaccagtaagataaaggcagaccctgagaaactcaagaaattgcaagaaagtctcctggaggaggactccgaggaggagggagacttgtgtcgcatctgtcagatagccgggggttccccaagcaaccccctcctggagccttgcggctgtgtgggaagcctgcagtttgttcatcaagagtgcctgaaaaagtggctgaaagtgaaaataacatcaggagcagatcttggtgccgtgaagacctgtgagatgtgtaagcaaggcctgctggttgacctgggtgactttaacatgattgagttctaccagaagcaccagcaatctcaggcacaaaacgagctgatgaattcaggcttgtacctggtgctgctgcttcacctctatgagcagaggtttgcagaactcatgaggctcaaccacaaccaggtggaaagagagaggttgtcaagaaattacccacaacccagaacagaggaaaatgaaaattcggagttgggagatggaaatgaaggcagcatttctcaaagccaggtcgtctagcaaggaagccaactgtggagctcggcggagacctctcccgccagcccttctttctacgtccccaagtgcctccctccctcctcctctttactgaaactgaaaccaaagcgttcacagttagattttcaccttgtgccactctcttttggggtctggcttgagcatctatgggcagccacagcgaccagtctagtcccagacagcacaggtcaagcagcgtgggactgtggagcccctggcaggctggcctggtgctgctcccttagcccagaagccctgccaggtccagtggcctggggtcccactgctgagggcacctgccaggcctcactccaccctgaatggactcgagccatgtattcattcagtaaactgacattattctccc

SEQ ID NO: 1432 - DNA, 2450 bp, Homo sapiens
tatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagcagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgctgccctccttcccagtgaaagagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaactctg

SEQ ID NO: 1433 - DNA, 2304 bp, Homo sapiens
ataacggtgccccgggcgcaagttgctgcggtgtagctacccgggccggggcgtgcgccctggccccgtagcttgcgggcgggcgggcgcggtgccgcggcgggtggggagacctaaagggcaaggaaataaagtttcagtacaaaacggttcgattcatcaaaaagatgctgtaaatgatgatgattttgagccatacttaagtagccagacaaatcagagtaacagctatccaccaatgtcagatccatacatgcctagttactatgctccatccattggatttccatattctcttggggaagcagcgtggtccgcagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatttctctacatgggggacaagtggatctcagggacaatcaacacaaagttctgcttatagtagcagttatggctatccacctagttctcttgggagagctattactgatggacaggctggatttggcaatgatactttgagtaaggtgcctggcattagcagtattgagcaaggcatgactggactgaaaattggtggtgacctgacagctgcagtgacaaaaactgtaggtacagctttgagcagcagtggtatgactagcattgcaaccaatagtgtgcccccagttagcagtgcagcacctaaaccaacctcctgggctgccattgccagaaagcctgccaaacctcaaccgaaacttaaacccaagggcaatgtgggaattgggggttctgctgtaccaccacctcctataaaacacaacatgaatattggaacttgggatgaaaaagggtcagtggtaaaggctccaccaacccaaccagttctgcctcctcaaactataatccagcagcctcagccattaattcaaccaccaccattggtgcaaagccaactgcctcaacagcagcctcaaccaccacaaccacagcagcaacaaggacctcagccacaggcccagcctcaccaagtgcagcctcaacagcagcagctgcagaatcgctgggtagctcctcgtaacaggggagcaggcttcaaccagaacaatggagcgggcagtgaaaactttggtttaggtgttgtacctgtcagtgcttcaccttctagtgtagaagtgcatcccgtgctggaaaagctaaaggccataaacaactataatcccaaagactttgattggaatctgaagaatggacgtgtgtttataattaaaagctactctgaggatgacatacatcgttccattaaatactctatctggtgtagtactgagcatggtaataagcgtttggatgcagcttaccgttccctgaatgggaaaggcccactctatttactcttcagtgtgaatggcagtggacatttttgtggagtggctgaaatgaagtctgttgtggactataatgcgtatgctggtgtctggtctcaggataagtggaagggcaaatttgaagttaaatggatctttgtcaaagatgttcccaataaccaattacggcatattcgcttagaaaataatgacaacaaaccggttaccaattcaagggacactcaagaggtacccctagaaaaagttaagcaagtgcttaaaataattgctactttcaagcataccacctcaatctttgatgactttgcacattatgaaaagcgtcaagaagaggaggaagccatgcgtagggagagaaatagaaacaaacaataaccgtatgaagatgtcctgttaaatttacaacactaacgatgtagactctggaaatgcctaataagtcaaagaagacgtatcaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgctgtcttttgtaattatgcatcctagctaaggcacagaagactgaatgaatgcaaggattcattaactctttgaatttgttaaatactaacagttaaccattagaagtggttcaatgatgtaagagtcacactgcttcaactttttctttgttgtagtttttaaattgtcgatttttagctatttgacagattaaaagcaaaataatcatgcc

SEQ ID NO: 1434 - DNA, 1952 bp, Homo sapiens
atttcagaacaacgggataggatgatgacatcacaaggggatggggactcttgtcgtctcagagagaacgtgccagcctggctctgctttcttttcctagagggtctaacacctctcccggccctgacatctagctggtccctgaggaggaggcagaagtcatgaggaggcaatggggaaacagccatggcagccagtgcctgcctgtggatgcttggacattaaagggtcaccagctgagtgtgggctgagtgtccctgaacacaacatttgtgcttaggaagaacccattccagagctgagagagaaggatgccaacatgctgcttcctccctctttctgggggcatttcttctgcccctccaaccccatctctgagagctggtcccaggtccagcccaagcaggagaggcagccctcaccttcccaggtgtttgtaggcatgttactctccctcctagagagtgttccccgcagctccgccttccctgcaggcctcctccatcctctaaagcacaaatcatcaccacctgcacaactcgaatgtctttctcagccatgcctgattcctctgcaggaaggaaaaaggaagcagttcctggtagtgtatggagggacccacagaaaagccaagagcccacagcagatattgcttgttttttacctctaactactctggagtgcaagaaagggcatccattgtaaagtccaactcttaccaagtgggtgaggctatagacatcttgtctctttcttcagctgtgcagctcagacaggcccagatgttgagctcatgcaggagctagacccatacctgcgcatcatgtggatgaggcctttgtctagcctatgtgtctgaggctcctagataggcaaaggccatgaagttggggagaacctgtgagatgggatgaaactcaggaaggagtataaggctgtgggtgtcaagccccccagccccagcaaagctaaatacttccagcagcaacttcctagcttgaagcaaccttgtctgttcaattttataatcacaaaggaaaaagtgtcccagtcccctggcctttcctctcatcacaatccccttcctctgacatcacagaggcaagaactgtcttctctgctcggagcactgagtcgagggcatctccaggacaggcattcaggcagagcaagctccaggtttcaccacaatgcccatccctgcctccccactccacccacctctgccttccttactgctgtatctgctgcttgaactggcaggagtcacacatgtgttccatgtgcaacaaacggagatgtcacagactgtatcaactggggagtcaatcatcttgagttgcagcgtacccgataccttaccaaatggacctgtcttgtggttcaagggaacagggccaaaccggaaattaatctacaatttcaaacaaggtaactttcccagagtaaaagagattggagacaccaccaagcctggcaacacagacttttccacccgcatccgtgaaatctctcttgctgatgctggcacctattactgcgtgaagttcataaaaggaagagctatcaaggagtaccaatcaggtcggggcactcaggtgtttgttactgagcagaatccaagacctcccaagaacagacctgcaggcagagcaggctccagggcccaccatgatgcccatacctgcctctcggccctgcctgagagaaacagcacaaactatttcgtccaaccctgctgctgcctccggctgctgggactcacaggcttgctgtcaaaataatccaaacagggaaggaacgtacaagtaaataacaaaagcccccatactcttctgactccctggagacagctactttttaggagtttcatttgccttcttcaagagagctctcttccactgacataaaatgccagcttgatcgtacaataaatctgtctatttacctgg

SEQ ID NO: 1435 - DNA, 2875 bp, Homo sapiens
gaaaactgcttttgctgataaagaaacacaggcaatctaccttctgaccgatgggagacctgatcagccacctgaaacatttatagaccaggtcaaacgttttcaggaaattcctatttataccatctccttcaattacaatgatgagattgcaaacaggtttttgaaagaggttgctgctttgactggaggagagttccatttttataattttggttgcaaggatcccactcccccagaggctgttcagaatgaagatgtgactcttttagttaaggaaatggaacagggtcacagtgatctggagaagatgcaagacctttattctgagtccttgatcatggactggtggtacaatgcagaaaaggatggagacagcaagcatcaaaaggaaatctgttctatgatttcaaccccagaaaagtgtgcaaagcctcaatctgatgtcgattcaacacaaacttcatctctgaatatgttgaagggaccatggggcctttcagatcaaaaggttcagaaaaagaaagtccttcacgcagaatcaaccaaaaccagcctgctcagaagccagatgtcctccctcaggagctcagcttgcagtgaaaggaaggatggcctctccaatgccagcagccggaggactgctctaagtgacaaagaaatgagcatcttgctggctgaggagtggctggatgacaaatcgtcagaaaaggtgacgcgagaaggaagccaggtttatgaccacgattcttcagatgtgtcttcagaaaactggctgaagacctatggcttggtcgccaagaaactcaccctcatggatgccttgtcagtggcagcagtcccgcacagctccacctatgttcccgtcctggacaagcatgtcatgtctaaggtctttgatgaggtgttccctctggcacatgtgtgcaacgacacaaataagatgacattaattaacccccaaggagccaaactcaatatctacaagcgaaaagtggaacaggcaattcaatcctatgaaaagcgcttgaataaaattgtttggcgagcattatctcaagaggaaaaagaaaagttagatgcaaacaaaccaatacagtacttggaaaacaaaacagttttaaaccaggctttagaacggttgaattggcccatttcactgaaagagctgtcgatgctggaaagtgaaatcctagctgggaaaatgtacatccagcaggccatggaactccaggaggctgccaagaagaattatgcaaacaaggccccgggagagcaacagaaattgcaaggaaatccaacaaagaaaaccaaatcaaaaagaccagatcccctcaaaggacagaaggttattgcaagatgtgatgaaaatggcttttattttccaggggttgtgaagaagtgtgtgagccgcacccaagcactggtgggcttcagttacggagacaccaaggtcgtgtccacctccttcatcacgcctgtggggggcgccatgccctgcccgctgctccaggttggagattatgtgtttgccaaaattgtgatacccaaaggatttgacttctatgtccctgccattgtcatagcacttcccaataagcatgtggccacagaaaaattctacacagttttgaagtgtaacaaccggagagaattttgccctcggagtgcacttattaagatcagccaaaacaagtatgcgctctcttgctctcatataaagtcacccccaattcctgaggatccagaagtagaggatgtggaggcgaggaactctgctttcctcttctggccactgaaagaagcggacacgcaggattccagagagccaagacgagagaagcccaggaggaaaaagaggcccgccaagcagccactccagcaggcggcgccctcggactcggacggctcctcccacggcatcagctcccatgggtcctgccaggggacacaccccgagcccaaggtttgggtgatggggggggaacacaacatcgcttatctcaggaacaccctgaaatccctttcaagaatagtacacctaacatcgtccttcagattctgggcctgtttaggctccagtgcagcaaagaccctaacatccttaagtaatgctgaactctgcttccccagacagcccacctccacttccccgcggccgggcgtctaggactcagcagccacgccatcattgccacacctccacctcgagcagccctgccctgtactctccaagtcacccacagcagcaaagggctgaggagcgtccctgagacactttaaggccgtctggtggcagctatgtttaagagaccagcgtccttccaggctgttcagacctcagcgttgacactgaaactggcccctccgcggaggtaaggccgccctccgcgccgcctatgcctgccctgtctgtagcaaagactcctctcccctccatccctgctgcctcccctacccgtttgacgacttggttctggcttttttctgactgttctttatcctgttttccccctgcactcacaaaattgtattccatcttctggtagacgccccacccccagaagttttaacctgaaggatgactgtcacaggactttcaaattgtttagcagtcagcatagtcaggatccaagcccgcaatcttgttttaaattaattatcacatctaaattagagaatttgtcacccaatattaggactgaaattcagactcggtaacttgtctgagatctgcaagactgaacatcccctactgtatagtttcctgacattttcatttagcctttcctaattatttttgtctatagtctgttgtaggtaactctaattgagcccgaaaccggaataaaaactcttacattggaaacatttc

SEQ ID NO: 1436 - DNA, 1803 bp, Homo sapiens
aagctatgtaacatatcttaacaaccagggagccacacaggctccttggagtaagagtgtgagaaactggatgaagacagctgtattcttttggaagcgttcgagattggtctgtctctaccaactaaaaacttctagcttaagtgcagagatttaaggagatcaacaaaaactcagtctagacatattatgaggctgggagggtatcaacagacttgagttcttgtcagcaagatcacctgcttttaatattgtcctcagggtctgagcacatctggaagtgaggtcaatcaagttagaccccaaaaacttttgtgacaacagtgaagaggggaaaataaacacaccacaaacatgaacctcaaccccccgacatctgctcttcagatcgagggcaaaggcagccatattatggctagaaatgtaagctgctttctagtcaggcacacccctcatcccagaagagtctgccacatcaaaggcttgaataacattccaatctgtactgtgaatgatgatgagaatgcatttggaacattgtggggagttggccagtctaactacttagagaagaacaggataccatttgccaattgcagttacccctccagcactgcagtccaggagagccctgtaagaggaatgtcgccagccccaaacggtgccaaagtgcctccacggcctcattctgagcccagtagaaaaattaaagagtgcttcaaaacttccagtgagaatcccttagtaattaaaaaggaagaaattaaggccaaaagaccaccatcacctccaaaggcatgctctactcctggctcctgttcttcagggatgacaagtaccaagaatgatgtgaaagcaaacaccatttgcataccaaactatctggatcaggaaataaaagccactcttctgtagggctgctgcagtttgctgggggtctgctccagaccctggttgccttgagttttcccatacctagaggtatcatcagtgagagttgcaagacagcaaaggtgtctgcctgctccttcctctgggatctccatcctaggggggtactgagctgttgctggctcgaatgctcctataggagatcctggcaaagctctgtagcattttgcatactgattctctggcagaagttttacagtggctgcttcatgcaacttcaaaagaaaaagagtgggtctcagctttgattcattctgagcttgccgagataaacctgttaactcatcacagaagaaacacctcaatggaaccagcagcagagactgggaagccacccacagttaaatcaccacccacagttaaattgcccccaaattttactgcaaaatcaaaagtgctgaccagagatacagaaggggatcaaccaaccagagtgtcaagtcaaggatctgaagaaaacaaggaagtaccaaaagaggctgagcacaagcctccactacttataagaagaaataatatgaaaatacctgttgcagaatatttcagcaaaccaaattctcctcccaggcctaacactcaggagagtggatcagcaaaaccagtgtcagcaaggagtatacaagaatacaacctctgtccccaaagagcatgttatccttcaacacaccggaggtagaagttctagactgggtgaattctttcatgaatatgagcttcacatttacatcatcaaattatttttcaaatgaatatttttggtattgaggaatcaagtggtcctctttatggtggcacatgtaaatctaaaaatacctgtatgtaatgctacaaataaatattactggaaatgat

SEQ ID NO: 1437 - DNA, 1939 bp, Homo sapiens
cttttttccctgggtgcccacatgaacagagacaccaggatgctctcctgagaccacagcaactgcagaagctgaagacatttccagaagttcaagcttccaccctctgcaggtccccactgagctgggacccaggtcatccaccccaccccaaatccctggataggaaacccctttctcctcctgctccttgtccccttcatccctgccgcccagcatcctactggcctcagcacctgtggccagaccgtccaagatcctctgaaggcccagctcttgctgtccaccccggcagtaggcaggcagcctggccatgtgccctccggtcagcatgcggtatgaggaagagggcatgtcctacctgtacgcctcctggatgtatcagcttcaacatggagatcagctaagcatttgcttcacctgcttcaaggctgcctttctagactttaaagacttgctggagtcagaggactgggaggaagacaactgggaccctgagctgatggagcacactgaggcagagtcagagcaggaggggtcctcagggatggagctgagctgggggcagagcccaggacagcctgtgcaggggggctctgaggcatgggggccagggaccctggcagcagccccagaagggttggaagatgcaggtctggacccccactttgtccccactgaactatggcctcaggaggctgtgcccctgggcctgggccttgaggatgctgactggacccagggtcttccctggagatttgaggagcttcttacctgctcacactggccaagcttctttccttcatagcaggggtttctcaaagtggacctgcccccaggggagcccatggtgttgaagctgggcattacctgggcagtggaccctgccgaggctgaggcctagttactggccctgcagcttgtctccatggtgggctgctatgataccatctacctacagaagatgaccccagacagggccctgaggaccccagggcagcactggaaattgctgctggagcctggtgaagtgtgggtggtgagactccaagatgcaccccaagagcaggacctgcactggtggatgctgagcattctagaaacatcgttaacaggacacagggcagagctggtccctgcagcctcagccctgcagaagaggattcaccatagtctcttattcaccctggaccaacagggagagcaagaagggagactcagcctgtaagccacagtcctccagccaagaacaggatctcagcacccctgagacacagagcaggggtcctgaggaaagcctggctgttgcaggagcctcggccatgggggagctgccctgtttccagcctcagtccagggccccagaactgagagactaaggctcatgtagctgccattgtcctgggcacaccaggacatcagagactgggaagggccagcaattgctgttccacaacagccaggggagcagttggcaaaggaaacatggggagcaactttaggggctgggagatagggcctgttgtggcctcagagggaagcattacaaatattcataacctggaaacaagttcttaccagttgattgtcacatagttctggatgtgttggcctgaatggctgttgtgctgcttgtgacatggggggcagggcacagaacttgtgcctatttcaccttggccatggggagggacattgcttgtaaaacacatgctctgcagaacacaccaggatctgtggtgacctggatgtgttctcgactttgccaggacaatctcaggggtgccacaagaccctgtcagcagcactaggatctctggtctacagtggagggagagctggttttaaatgttggccgttgatgcaatttaaccatttaattcctgttgctctatatgttgtttttaattttaaaaagtcataaaagctttcaaacaag

SEQ ID NO: 1438 - DNA, 2513 bp, Homo sapiens
gtttctctggagaaccctgactaatacagaaggagagagggaagaaaggcgggttgagtagcagaaagcttaggctgtagcacaattccgataaagtttaaggtcagctgatgaagaacactcaaaccaaagtcgcccattggaggagccccctacctcacaggaataggcctgcattattagtataccttcttcattcagttattgttattcttatggaaacaacccatgggaaatgtagccttggcatgactgtatcaatggattcagagagcagtagcggggacccccccagtcaattacgttccacagcaagagatctcagtggtgcatatccactgctggctcagtccaccccttgggctgcacagctctattcaggcctagctgccaggaagattactaggtatcattgtcaactcaggctctgtgcccagtaaacctggaaatgtctggatattcttccttgccagcatatagtcataaatctatttggggaagaacttgccatttcatcaaagtctgtacatgtatagcagggttcttcctcctagtgacctgtgacctagtaacccagccacctatgggttcttccatctgtggcttccttacctgaaaagtgcttcaggtctaggaactgagaaagggattgtgatgtgtcattggagccagtgcggttccattcgtgccttatttggttataggcgttaagcagcattcttgttagatgcccatctattttgcctataggggtgttactttcaattaattatctcctaaacaccctgtgaatcaaacccccttaactacccctccaatttcaccagttgttatagtaattatggcctcttgacttttggtaattaagcactagtcctccagagccctctattacttgagggtccattacccctgaatcatattaacaatcccagctctgtgaccacctcatttaccatcagccctggtctaaagagtaaagccactactgcacttagtgatactggtaccttctcacaggctcattcttggtggccttagtgaattgtcactatttcatgacatattcatcacagtatatccatcacatattcattcatctgacccttatgaaggtgtgatggttaatttcatcacagtacatacatgccattgtatagcaggtccttaactaatatagcaacaccaacgttctcaggcagaaccaatagaccctgttgaagggcaggcaagcccagagcaaaccatctatatgcagttcttttaacagcctgcaaggcactgtaagattagggagacgtttatcgaattatgttctgtggaaaactagttccataggatatgaactgatgtcaggagaaaaattaaattagaaatttgcttcagtgccagattctcaaagccattcgtatgtgaatgtttagtgcaactctccaaaagagatgatttgatgtgttacatgtggcagtagtatgatgtgcagcccagatcccccttcaaagaacggcttgctccccacttgctgggtgtgatgttagcaggcagcctgcagctgtcagccctcttcaggaattggcatagctgtagaaaaccacttcacctaaggtcacacttttttgtggagtggcccatagccaaggattgatcagtgtggagatacaaagttgttctcttgcccatctgaggacatctccgagggccgttttaactccagagctccctgtggggttggccaaggctgtcgttggacctacattataactcattttctcccaattccgcttctctctctctttgaacaaatgtttggcaaaaggcacttcttaataaatatcctgcaattaaagtatatctcagaatctgcatcctggagaatactgtctgagacaccccactttctaattttgtttgcccatcaaagcccattccccgccccccttttttttttgacagaggcttcttctttcacctggaagggagtgcagtggtgcaatctcggctcactgcggcctctgcctcccgggctcaagcggttatcctgcctcagcctcccgagtagctgggattacaggtacccaccaccacgcctgtctaactttttgtatttttagtgtagatgggggtttcaccatgttggtgaggctagtctcaaattcctgacctcaagtgatccgcccgcctgggcttcccaagtgctgggattgcaggtgtgagccactgtgcctggcctaaaaccctttttcatagagtacctaacaagagtaggccttaagaaatatattctggatgctggtaagtgcaggtgtgagaactaagtacctatgtggaaagtaaggggaggggtacccaagacttaaatctcagcttatgaattcctttgagatttgaaactagcttaattttgatgtgtaactctaatgcttaaagtactgcaggatctactatctatggaggtgctacggagaggatctaaatattatgtgacctatgcaaataaattttcttttctctgt

SEQ ID NO: 1439 - DNA, 1797 bp, Homo sapiens
gtgacgcgcggcccgaggcgcacgcagggctcacaccacctgtcctggcctccgacccgggccgactatggcggcgctgcggctcctggcgtcagtgctcgggcgcggggtccccgccggcggctcagggctcgcgctgtcccagggctgcgcccgctgctttgccaccagtccccggctccgtgccaagttctacgcggacccggtggagatggtgaaggacatctctgacggggcgaccgtcatgatcgggggcttcgggctctgcgggatccccgagaacctgatcgccgcgctgctcaggacccgcgtgaaagacctgcaggtggtcagcagcaacgtgggcgtggaggacttcggcctgggcctcctgctggccgccaggcaggtccgtcgcatcgtctgttcctacgtgggcgagaacaccctgtgcgagagccagtacctggcaggagagctggagctggagctcacgccccagggcaccctggccgagcgcatccgcgcggggggcgccggggtgcccgccttctacacccccacgggctacgggaccctggtccaggaagggggcgcccccatccgctacaccccggacggccacctggcgctcatgagccagccccgagaggtgagggagttcaacggcgaccacttccttttggagcgcgccgtccgggcagacttcgccctggtgaaagggtggaaggccgaccgggcaggaaacgtggtcttcaggagaagcgcccgcaatttcaacgtgcccatgtgcaaagctgcagacgtcacggcggtggaggtggaagagatcgtggaggtgggggctttccccccagaagacatccacgttcctaacatttatgtagatcgcgtgataaaggggcagaaatacgagaaacgaattgagcgcttaacgatcctgaaagaggaagatggagacgctggaaaggaagaggacgccaggacgcgcatcatcagacgcgcagctctggaatttgaggacggcatgtacgccaatctgggcataggcatccccctgctggccagcaacttcatcagtcccagcatgactgtccatcttcacagtgagaacgggatcctgggcctgggcccgtttcccacggaagatgaggtggatgccgacctcatcaatgcaggcaagcagacggtcacggtgcttcccgggggctgcttcttcgccagcgacgactccttcgccatgatccgagggggacacatccaactaaccatgcttggagccatgcaggtttccaaatacggcgacctggcgaactggatgatccctggcaagaaggtgaaaggcatgggcggtgccatggacttggtgtccagtcagaagaccagagtggtggtcaccatgcagcactgcacaaaggacaacacccccaagatcatggagaaatgcaccatgccgctgaccgggaagcggtgcgtggaccgcatcatcaccgagaaggccgtgtttgacgtgcacaggaagaaagagctgacgctgagggagctctgggagggcctgacggtggacgacatcaaaaagagcacggggtgtgcctttgctgtgtccccgaacctcaggcccatgcagcaggtggcaccctgacgggacctggatctgggcggggtggtgcgctcctcagggcgggtgccaccgggttccccaggggaatacatgtccccagctctgggaggggtttgctactggcctcctactttcctccctaggtggacagtgctcctctagagagctgcgactttaattaaaaacaacaggaaaac

SEQ ID NO: 1440 - DNA, 2272 bp, Homo sapiens
actgtgtggcccggcaacccagcacaaccaggtatctgcttggaacccagccaccataaagcctgctagctaaaaaaaattttacatctctcagttcattcggcacagacccctgcctcattcacctgtgactctgcttggaaaattcatcagttacaaagcagccaatgcaattatctcaaggcattgaattctgcatcttttagtgaagaaaataactgaacatggttttcttctgaagacacaaagtccaaaggccaatcacacacctcttacatcgatctcttggaaattgaaaaatggacctttgaaaatgctagatttacaatgagaaatgccataattcaaggtttattctatgggtccttgacatttgggatctggacagctctgttattcatatatttgcaccataatcatgtgagcagctggcagaagaaaagccaggagcctctgtcagcttggtcccctggaaaaaaagtgcatcagcaaattatctatggctcagagcaaataccaaaacctcatgtaatagtcaaaaggactgatgaagataaagcaaagtctatgttaggtacagattttaaccatacaaacccagaacttcataaagaacttttaaaatatggatttaatgtgattatcagtagaagcttgggcatcgaaagagaagtgccagataccaggagtaaaatatgtactgtcaccttattaccataattatcagttgaaggagtaaagagtcaaaaagatgcaaataaggagaagtgtttgaacgagatgacacaacatccaaggcatttagatggatggttttcttcatattgcttctgcctgcaggcgtcttcaaaaacattacccagcccgcctcccgactgccagcattgtcatttgcttctataatgaagaatgtaatgccttgtttcagaccatgtccagtgtcacgaacctcacgccacactattttcttgaagaaattattttggtagatgacatgagcaaagttgctatgaggagctattaagggcttaatgcaggaaaatgagatgatctaggaattccatgaaagaagcggaatcagaccaactgcagttaaggcctggctcatggcgtcccacttttccctcctcttgctgcctcctacatcctggatgtgagtgaggtgtctggagatctttgagctgagatgctgcccaggcctgcaagtgcagctatgcagcctgtatccctgcctctttctaaaaacaaggaagaagatccctccttctgctgggattaccatgaacctgttcctgttcaacctgcccctgacccagattgctgggacttaggaatttagacctctgagatgatttgaaagaaaaactagactatcacctggaaacttttcggggaaaggttaaaataataagaaacaaaaagagagaggggctgattcgagcaaggctgattggagcttctcatgcttcaggggatgttctggtgttcctggacagccactgtgaggtgaacagagtatggctggagcccctgctgcatgccattgccagggaccccaaaatggtggtgtgccccctgatagatgtcattgatgatagaactctggagtataagccctctcctcttgtaaggggaacttttgattggaacctacaatttaaatgggataatgttttctcttatgagatggatggaccagaaggatctactaaaccaatccggtcacctgcaatgtctggaggaatttttgctatgcgtcggcattattttaatgaaattggacagtatgacaaggatatggatttttggggaagagaaaatttggaactttcactaaggatctggatgtgtggaggccaactctttataatcccctgctctcgagtaggacatatcagtaagaaacaaactggaaaaccttctacaatcatcagtgctatgacacataactacctaagactggtgcacgtttggctggatgaatataaggagcagttttttcttcgaaagcctggtctgaaatatgtcacctacggaaatattcgcgagcgtgttgagttaaggaaacgactgggttgcaagtcatttcagtggtatttggataatgtcttcccagagttggaggcatctgtgaacagcctgtgaaaggaaaacaaatcactttcattaataaagggttaaaagtctcctagtcattcaacatagtgtcacaagagtgtaagtttggaacatcgtggaattacgtgaaatgcaattaaaaaaatatgaccag

SEQ ID NO: 1441 - DNA, 2140 bp, Homo sapiens
gtgtgctgtggccgggggcggccgttgacctggtgaccgcggcgccgccccagaccgggggcgcagtcccactcgctccgagccccggtcccccaagcctccctcccgggtacctggggccgcgcccgccctgcgcccagctccgccctccgtcggcccaggcctgacagagcccggcagccatgagtgccaacccccggtgggacatcagcagggcgctgggggtggccaagctcttccacctggtgtgcggggtgcgggaagcctgcgtgaccccgttcctgaccctttacctgaggcagctgggcttggccgcgccctgggtgggcaccctaatgggaaccaagcacctaatcgctgccttctgggctcccgtctgtgccttcctggccaaaagctaccggaaaaggagagcgcttctgatcggctccctgctcggctcggtgggggccagcctgctgatggtcctggtcccaccggtagacaaaaatcgggtgcacttcccttgtaatggaagcagcggcctgaccagcacagacgcactcccgggggtcacgctacctgtgaacatcacctcggcccaagagtctgcctccagccacccagccaagaggactgcagaggtggaaatgcctggcttcagaaacccacctggtgaaagtgaccgagaaactttccgtgatctgcacgtctacttagcgccctccgttgaaggagctaggaccacatcccaagctctcctccatcctgtcacttcggggctgaaagatcatccctgggaagttacttttgaggtggtcaagacagccctccccttgcttcctggggggaaagggcccgggaatccagccaatttgtcagggaccaaggggaaagcctgggcttttgacctgtccttggaggcgttgcggcggacttttatcctctccttggggtccgtggcgttctgggagctgctgacagcgcctctggagcaggtggcagatgacagcctttatgagttcctggattctgtggatgccactgaccgatacagaagcctgtgggtctggaggttgctgggcatgtcggcaggcgtgtgtggcatcacagccttggtggggcagctggactgcttcctgatgaccagtggcccccgaggtgtggtccacttctatgggtactcggtggtcagcaccctggccttactggtgagcattgcctttcccattcccatctgtcagcagtgggagcccagctacaaaagggtcaaagcactgtccattgtggggggtgacccccacctcattctcctcgcctccaccactgttttggtaggagccatcgtcagtactgtccagaactttctgttctggcacatgaaggaccatgggagcggcgagctggtcatgggtttctcggtcgccctcagcttgctgggggaaattctgcttcatccgttcaaagctacattgcttaggaaactgtccaggacgggcctggtggggctggggctgagctgcctcgctgggcagctgctgtactactctttcctctggagctggtggtccgtcctccccattcagatcttgagtgccattagcaacagagctttgtggtgggctgtgggggcctcagtagaggacctggccactccccgcatggagagggctctgagtgccttgttccgaggccacttttacgggagtggctgtagcctgggcagctttgtcgggggcttcgtggtgatgcgcttcagcctggctgtgctctaccaggcctgctgtgtggccctgttgctctggttggccttgctcctgtccatacagcggaggctgccccgagagcggaaaatcaagtactcgaagctgctgtccatggaggtgagtgacaccagtgactctgagcaggggacagaacaggactggcttgtgaaggccatgagggaggaacactcagactgaaagggctgagaaatccagagtgtgctgatccagcaaggaacgaatggactgaacaaaactcagcctgctgaggacagaaacctgccctggactgctgggagccggggaagagaggatgggtctgtgctgaaggcccaacaggatcatctcattgcatgattttctttacttttgaagtaaaaggagatttaactttt

SEQ ID NO: 1442 - DNA, 2035 bp, Homo sapiens
ctctcacacatgccctccctcgatggcccccagctcttgtaggacaagccctcatggcagagctagatggcaccctaggggccatacaggtgcgtgcactccttgcctcgcggatgaggaagatgagcccagaggaggagctgacatggctgagtggccaggtgggatctggagcctagtgtccttgccgtctggacccctcccagcatatcatgctgtgtcctactaaggctcccaaaatggggacaaacttttcatctttcagcttctcccagtgcaccttcttgctgcctaagccctgactctctgcttaggtttcaaaaaatgagacaactcatgagagaaaagaaaatggtcagatccgcaatgcatggaaaaatatctctttatgtgtgtcatctcctcaagactcccaacaaagcctatgccagcctctctcttacagaggaacaaacagaggccaggaggttacgtggctcgtccaaggctagacagcattaaaatgtggtggcaccaagagtcaacctggaccaggcgtcaaaactcaagctgttctacttttaccttctcctaatcatgtacagtgattattcatattgcaaactcgcagctttagtcttactggaggggtgacacctggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccacagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccaaattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcagacttattacaagaaggacaacataagcagctatcaatgttccaaagataaatcccactttagtggttaaagagattgctcaagctaagcacttcgtcttccttattgatgatgattccagaaatacaccactgcattgttgtatgttaccccagttaaagcacatcctcattttt

SEQ ID NO: 1443 - DNA, 1817 bp, Homo sapiens
gttcttccgtgccaagtcgtgcttgtaaagaagcggtacttcctcttactcccgggacagaacttcccctcaggagggagaacatccgccgaacgaaatggagagcaaaagaccgcgactgctcgaggaagcagacaagcagaaaaagacagtcagagtgggactcaatgcaccttccatgctacgaaagaaccagctaggtttcctcagattcgccaactattgccgtatagctcgcgagctgcgtgtaagctgcatgcagaggaaaaaggtccagattcatagctgggatccctcctctttggcaagcgaccgatttaaccgcatactggcgaataccaacactgaccagctcttcacagtgaaccaagtcgaagctggaggctccaagtacggcatcatcaccatgcgaggcctgacgacccctgagctccgggtatacccgcacaaaaccctctacgtccctaatcggaaggtgaattctatgtgctgggcctcactgaatcacttggattcccaccttctgctgtgcttcgtgggacttgcagatactccaagctgtgccgtgctgctcccagcgtcgctgttcataggtagcttcccaggaatgcgtcggcctggcatgctttgcagtttccagatccctgatgcctggtcctgtgcctggtccctgagcatccacgcgtatcactctttcagtacaggcttgtctcagcaggtcctgttgaccaacgtggtgacgggacaccagcagtcatttgggactagcagtgatgtcttggcccagcagtttgcaatcatgactcctttgctgtttaatggctgtcgctctggggagatctttggcattgatctgcgctgtggaaatcaaggcagcgggtggaaggccatttgcctgtcccatgattcagcagtgacttctctgcaaatcctccaagatggccaattcctggtgtcatcagacatgactggaactatcaagctgtgggacttgagggccactaaatgtgtaacacagtacgaaggtcatgtgaataactccgcctacctacccgtgcatgtgaacgaagaagaaggagtcgtggcggccgtgggccaggactgctacacgagaatctggagcctccgtcatggccacctgctcacaaccataccctccccataccccgcctcggagaacgacattcccagtgtggccttctcttctcgcctcgggggcttccgaggagcaccagggctgctcatggctgtccgggaggacctttattgtttctcctacggttaattcttcaggatgcagcccggaggaacgtggatttgacttaaagaagtaaagagcatcgtattaccgtttctatgagcgcattttaagagatgttcggtgtttgtagatcccatccatccggctgctaggggtaaggtgctgttttatgtgaagatagttctgtaaagttgtttcagttaaactgggctgagagagcttgaaagtccttttcataaaagataactatttccttttcttgttgaataccttagaatagttgtccccccctttttttttttttaacaaaaaaacacttttctaaggactgaagattggcaaaaactaaaataaattaaaactgcttacaccagaagccttttagagaagcatgagactgtttgactagtcctacctgggttccggaaatacatgcatcatctgtacttgaagaggccagtgggagaggagaggagggggaggtcatttatctgagtctctccagaagtttttaaggctacattttggaatcattaaacttggccttctcaaactc

SEQ ID NO: 1444 - DNA, 1966 bp, Homo sapiens
agcagctgcccctgcaaatgtcagcgccagcccagtcaaaagagcttgaaacctaccaagccggaggactgtgctgtgcctctctcgcccacattttccccaagcactctcaggaacctggcaacagtgtccccttgtggccaagcccggaacatcacatctgtacgttgcaatctgtggatcagctacgagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacctcagcaaagccattcgctgtgatctctgattgtgcagtgtcatgtcctgtcaccagagccccctcgtgtttgatgttggccaatgccgccagcatgatctagcaggccaaatcctaatctaccattctctgacaccagctggtcccctgggtcgtccacccgatgtcccccattctccccacttggcctcccccacaggctctcggcaaaggaccgtgggaggcacctgtgacactgcccttttcctgtgcagctgtttttcttcttcattcttttcactcctcgttactcttttttttttcactctcagcccacacaaaactaggaactttgttattctacttatttttctgtactctgtctgtttgcacacagatggatatctgagagccagcgaactttctttacctcctagtatcatttcatgaaaattagtagcacctgcacaatggggccttggagacaggaataaaaggaaaaatctggaatggaatcacatgacgcaacaggctatgaagactccctgcccggctgctatatgtctggtaaacagaataaatagtacttgagcatccctgactctgagactgtggggtagctggttgttttaagatgggaccagggtattgtgcacttattgccaattcttgcttcagtaagtggggtggctgtgcagagtgagtggcctgtgtatgaaccagggtccgtcccatctaatgagagtccggtcaggctgagtcctcactaagacttcagcgtggattcatcagtaaccttggttcactggcaggcttgctggactttggagaaaaggctgaccctcccccaaagcagcccattgctgccactgccctaggaacagagggcctggagccagggcttgacctggtacaggagcttttgcacaaggccggctcaaacctccaaacctggggaaacaggatgcatggtgaagtgaagaagaaagaaaatgcatccaccgttccttcctgttggtgtcagcacgatgaggaataattacctggatctggaaagcaggcgtgtgggaggctgcaggcccccctggtctgtgtagttaggcacttaatttttcatcctcctccttctctctgccctcccgaaaccgccgttttcaaaggaaaaacagaaaaacgtatctgggtaacccgtgtaatactgtttacatcagcccacttggcccagaaaggataccagctccttactgatgctcagataacagggttagtgcttaaaaaaattatgccttgggccgggtgcggtggctcacgcctataatcccagcactttgggaggctgaggtgggtggatcgcagggtcaggagatcaagaccatcctggccaaccaacatagtgaacctgtctctgctaaagatacaaaaagtagctgggcgtagtggcgcatgcctgtggtcccagctgctcgggaggctgaggcaggagagtcgtttgggcctggcgggcggaggttgcagtgagctgagattgcgccacactgcactccagcccaggcggtggagtgagtctccatctc

SEQ ID NO: 1445 - DNA, 2055 bp, Homo sapiens
acagtcaagaaaggtgtagatcctgcagactgcgtggaggccatgctttcacatcaagccttcctcggtgacttgctcagcctgactgtgttcttatttgctgggtctctctctggaaatctccactttgagtgtttccaacaactgtgattccatttttgtgaatgggaaggaaatgaagagcaaagtggacacgattgtgaacttcacccaccagcacttcacctcccagttcgaggtcactgtctgggcacccaggctccccctgcagattgagatctcagacaccgagctgagccagatcaagggctggaggatcccggttgctgccaacagaaggcctacccgggaaagcgatgacgaggacgatgaggagaagaagggacgaggctgctccctgcagtaccagcacgccacagtgcgtgtcctcacccagtttgtggccgagtcacctgacttagggcagctgacctacatgctgggccccgactggcagtttgacatcactgaccttgtgaccgagttcatgaaggtggaggagccgaaaatcgctcagttacaggacggcaggaccctggctggtcgggagccgggaataaccacggtgcaggtcctctcgccgttgtctgactccatcctggctgagaagacggtgattgtcctggatgaccgagtcaccatcgcggagctgggagtgcagctcgtagctggcatgtctctctccctgcagccacaccgagcagacaaaagggccatcgtctccacagctgctgccctggatgttcttcagtccccacagcaggaagcaatagtaagttcttggattttgttcagtgatggttcggtgacacctttagacatttacgatcctaaggattattctgttactgtctcatcattggatgaaatggtggggtctgtccaggcaaaccttgagtccaaatggccaattgtggttgcagagggtgaaggacaagggcctttgattaagttagaaatgatgataagtgaaccttgtcagaagaccaagaggaagagtgttcttgccgtgggtaaaggaaatgtcaaggtcaaattcgaaccaagtagtgatgagcaccaaggaggcagcaatgatattgagggcataaatcgggaatataaagaccacctcagtaattccatagagcgcgaaggaaaccaggagagagcagtccaggaatggttccaccgtggcacacctgttggccaagaggaaagtaccaacaaaagcacaaccccccagtctcccatggaagggaagaataagttactcaaaagtggtggtccagatgcctttacaagcttccccactcaagggaagtcaccggaccccaataatcctagtgacctcacagtgacctcaagggggctaacggacttggagattggcatgtatgccttgctctgcgtcttctgtctggccattctggtcttcttgatcaactgcgtggcgtttgcctggaaatacagacacaaaaggtttgctgtgagtgagcagggcaacatcccccattcccacgactgggtctggcttgggaatgaagtggaacttttggaggaccctgttgacattacactcccatcagaggagtgcacaaccatgatagacaggggcctgcagttcgaggagaggaacttccttctgaatggcagttcccagaagacttttcatagtcaactactcagaccctctgactatgtctatgagaaagaaattaaaaatgaacctatgaattcttcgggcccaaagaggaagagagtcaagttcacttcctacaccaccatcctcccagaggacggcggcccatacaccaactccatcctgtttgacagcgatgataacatcaagtgggtctgccaagatatggggctgggggattcacaggactttagagactatatggaaagtctgcaagaccagatgtaaactcctttcttatgtttgtattcacctttatgccttctgttttttgaatgctggagcagtgagtttgatcagcaataggggatgatttaacaaagtttgatttgtgg

SEQ ID NO: 1446 - DNA, 1698 bp, Homo sapiens
agtacaatctgctgcccaggacctggacattgacagataaaatgaagtgggaagaatatgaagaactgcttcattatgctatagtgactccaaatattgaaccccgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcctcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtg

SEQ ID NO: 1447 - DNA, 1782 bp, Homo sapiens
attggctgtgtggaagggctaaaggaactagtacatctggaatggctgaatttggcaggaaataatcttaagaccctgcttttacatggaaacatcatcacctctcttagaatggcacctgcttacctacccagaagtcttgctatactttctttggcagaaaatgaaatccgagacttaaatgagatctcttttttggcatccttaactgaattggaacagttgtcgattatgaacaatccttgtgtgatggcaacaccatccatcccaggatttgactatcggccgtacatcgtcagctggtgcctaaacctcagagtcctagatggatatgtgatttctcagaaggaaagtttgaaagctgaatggctctatagtcaaggcaaggggagagcatatcggcctggccagcacatccagcttgtccaatatctggctacagtctgccccctcacttctacactaggtcttcaaactgcagaggatgccaaactagagaagattttgagcaaacagagaggcagttgatgaaccaaagccaaaatgaagagttgtctcctcttgttcctgttgaaacaagggcatcccttattcctgagcattcaagccctgttcaagattgccagatatcccaggaaagtgaacccgtcattcaagtgaattcttgggttgggataaacagtaatgatgatcagttatttgcggttaagaataattttccagcctctgtacacactacgagatattctcgaaatgatctgcacctggaagacatacagacggatgaggacaagttaaactgtagtcttttctcttcagagtctacttttatgccagttgcatcaggactgtctccactatcacctacagttgagctgaggctgcagggcattaacttgggcctagaagatgatggtgttgcagatgaatctgtgaaagggctggaaagccaggtgttggataaggaagaggaacagcctttatgggctgcaaatgagaattctgttcaaatgatgagaagtgaaatcaatacagaggtaaatgagaaagctggactattaccttgtcctgagccaacaataatcagtgctatcttgaaggatgataaccacagtcttacattttttcctgagtcaactgagcagaaacaatcagacataaagaaaccagaaaatacacaaccagaaaataaagaaaccatatctcaagcaacttcagagaaacttcccatgattttaacccagagatctgttgctttgggacaagacaaagttgcccttcagaaattaaatgatgcagccaccaagcttcaggcctgttggcggggattttatgccaggaactacaaccctcaagccaaagatgtgcgttacgaaatccggctacgcagaatgcaagagcacattgtctgcttaactgatgaaataaggagattacgaaaagaaagagatgaagaacgtattaaaaaatttgtacaagaagaagctttcagattcctttggaaccagaaatggggtcttgccatattgcccaggccggtctcaaacttctgggctcaagcagtcttccctcctcagcctcccaaagtaaggtctctacaggtttggcaacagacagtggaccagcgtctaagttcctggcatactgatgttcctcctatatcaagtactcttgtgccatcgaaacatccattatttacccaaagccaggagtcctcttgtgatcaaaatgctgattggtttattgcttctgatgtagctcctcaagagaaatcattaccag

SEQ ID NO: 1448 - DNA, 2104 bp, Homo sapiens
acaacagagagggccaccatgggggaccggaggccacaggaccggccaaggtcccaaggcatggactccaagccctggtactgtgacaaaccgccttccaagtacttcgcgaagcgcaagcacaggcgcctgaggttcccgcctgtggacacccagaactgggtatttgtgacggagggcatggacgacttccgctacgcctgtcagtctcctgaagatacgcttgtttgtcgccgtgacgagtttttactccccaaaatatctctcagaggtccccaagctgaccgcaaaagcaggaagaaaaagctgctcaagaaagcggccctattttccgagctctcgccagtacagccagcacggaaggcgttcgtagaggaagtggaagcccagctgatgaccaagcatcccttggccatgtaccccaatctgggaaaagatatgcctccagatctcctactacaggtgctgaaacagctggatcccgagaggaagctggaggacgcttgggctcgttgtgaggcccgggagaagacaaccgaggtacccaccgagtctggtaaatatccctgtggggaatcctgcccgcggcctcccgagactccggtgtcccgtctccgtcctcagcttcccaagactccggtgtccagtcgccgcccagagcctcccaagactcgggcgcccagtctccgcccagagcctcccaagactcgggtgtccagtctccacccggaacctccagagactcgcgcatctcatctccgcgtggatcctcccgagactggagtgtcccatctctgcccagagcctcccaagactctggtgtccagtgtccacccagagcctcctgatactggagcgtcccatctctgcccggagcctcccgagactcgcgtatctcatctccacccggagtctcctgagactggagtgtcccatctccgcccagagccttccaagactcaggtgtccagtctctgcccggagcctcccgaggctggagtgtcccatctctgcctggaacctcccaacactcatcgggtgtccagtttcctactacaggtgctgaaactggattctgagaagaagctggaagacgcacgggctcgttgtgagggccaggagatgacaaccgaggaactcaccaagcctggtaaataccatttttgggaatcctgtccgcggccttttgagagtcggatgccccatctccgcctggtgcttcccataactcgtcgaatggccagtctctgcctgaagcctcccaagactcgtcgggtgtccagtctctgcccggagcctaccaagaccggagcgtcccatctaaaagaactgtttcaggaagatacaccaagcacaatggagtgtgtttctgactctcttcaacgtagacacacatcgagaaaactccgtgacttcaagtgggctggagacctaggagttaatgaagaatccatcagcagtctgtttgactttacccctgagtgcagaacaaccgatcaagaccaaaagattaagaaggcaaacgagtgtgcttcaaggctgatgtacggcatggagctagacgacatggatgaggtcgaattcttacggataaaatactgggacaggagacgccgggcggcaccgcattcttatagtgcacagcgtgggaggataaggtatggaccatggtacttcgagcctaagttggggaaaaagctaagaagtgatgaacctttgattgaccccaagcccgtacttgaaaagcctgatgaacccgacattcttgacggtctttatggaccaattgcctttaaggatttcattctaagcaagggctacagaatgcctggcgtcattgaaaagctgtttgccaagaagggatggacttacgactctgttaagactcctattcaacgtgcagtgcaagtttacaagtacaaagaagacgtcacagatgcatcaaaagaagattagatggttttcaatttactgcttacttgggtatttcttgctctcattctaaacatcaatcagaatttatgatgactggccccgtgaatgtacaactttggcaacatctgtaaattcaatacccaatgcttataaatatgtcttaatgacc

SEQ ID NO: 1449 - DNA, 2347 bp, Homo sapiens
acacaatttctgctccgactctgcggactactgcagtggagcttgactcttaatgggtcccaaagcaaaaaagtctggcagtaagaaaaagaaagtcaccaaagctgaacgattgaagctgctacaagaggaggaggagagacgactgaaagaggaagaggaagccagtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtcacacttgaggttcatgagaatgtaatcttttttgaggatcctgtggttgtaaggtggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagaatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgc

SEQ ID NO: 1450 - DNA, 1664 bp, Homo sapiens
atgaacatgagggtcctctgagagaccagggacagagggagacccaaagatctggtctgtagctaagtgaattttctaaaactcattgattcacacgccatcccttgaggtggctggtgtcccgcgatggccacaggcgccctcctgccgtgctcgcgcccgtgcccgatgtcccggctggacttcctcaaggcctcgcacttctcgctggggcctgacctgcggctgcacgagggcgccatgcgcaccacgtcgcaccgggactttgcctacccggctgccacccgggagccgccgagcctgcagccgccgcccgcgctgcttttcccaatggacccgcgctgggaccgggaagagcgcgtgtcggaggcgcaccgcgcgttcccgccgccatccacgccgccgtgggagctgctgcaagcgcaggcgcgggaacgcacgctcgccatgcaggccggcaacctgcacctgcacgaggacgcgcacgccgggatcggcctctccaacgcgcacgccgcctacggctggcccgagctgccggcgcgcacccgagagcggatccgcggcgcgcgcctcatcttcgaccgcgactccctgcctcctggcgaccgcgacaagttgcgcatcccgcccaccacgcaccaggcgctctttccaccccacgacgcgcgcccgcagcctcgcgcgcccagttgccacctcgggggccccaacaccctcaagtgggactacacgagacaagatgggacttcctaccaaagacagttccaggccctgccaggcccacctgccttgaggtgtaagagggcctcctccggagtggagctgggagactgcaagatcagctatggatcaacgtgttcggagcagaaacaggcctacaggccccagggtctgcctgaagataggtatgacaaggcccaggccacagcccacatccactgtgtaaatatccgtcctggtgacggcctcttccgcgacaggaccaccaaggccgagcacttctatgccagggagccagagccttttgttcttcaccacgatcagactccggagtcgcacatcctgaaaggaaattggtgccccggccccggcagtctggacaccttcatgcagtacttctacggccagccgccacccccgacccagccacccagccgccacgtgcctcatgagaaattgcagagtcatgtgaccctaggggagccaaagctactcaaacgcttcttcaagaccaccatgggctcggactactgcccctcagagtggaggcaggtgcagaaagcgcccaacctccacttgcagcaaagcaacctgccgcggggcacgggcgaattcgattttttaaccatgaaccagaagatgctgaagccacacagaacacctccggccccggtgactgaagagatgctacagcggtgcaagaacagccacatggagccccctctgggtggactgcgcttcttctcaacacaatacaaggacgagtttcctttcaagtaccagggcccagcagccctgagactgaaaaatcctcaggagggcttcgtgcccctgggcacgcctcaccagcgcggctgcagggagaagatagaccctctggtcccccagccctctatgtacccgtgtcccagccagcaataaatgccatcttggcaacattc

SEQ ID NO: 1451 - DNA, 1899 bp, Homo sapiens
agtcacacagctgcctggaaggtgactggaggccttgatcggttctcattgcgattttgctgctgtggccccaaccctgcctccctccccaccctgcgatggcagaagaaactcaacacaacaaattggctgcagccaagaaaaagttaaaagaatattggcggaaaaacagccctagagttccagcaggagcgaacaggaacaggaaaacaaatggcagtatccctcagacagccacttctggtggttgccagccacctggggattcagcaacaggttttcacagggaaggccctacatcatctgctaccctgaaagatctggagagcccgtgccaagaacgagcagtagtcctggattcaaggtccgtagaaatcagtcaactgaagaacaccatcaaatctttgaaacaacagaagaaacaagtggaacatcagctggaagaagtaacgtgatttcgtttccttgcaacatgactgctggaagaaggctcacccttcagattccaccccatcccctcagggccccgataacctggtcccatgggtgggcctgtcctggggcattggtggcattctgggggcatgtctcttgctgtgccatctctgcctccccctggtaagagctctgtcttcctcttcctacaggaaaagaaagcaaacatcaagaaacagaaagccaaaagggtgctagaggttcaaatccagacattgaacatacagaaagaggaactaaatacggacctgtaccacatgaaacgttctctcagatactttgaagaaaagtccaaggatctggctgtccgcctgcaacattcattgcagcgtaaaggagagttagagagtgttctctctgatgtcatggccacacagaagaagaaggcaaaccagttgtccagccccagtaaagcaggtacggagtggaagttagagcagtccatgcgggaggaggcactactgaaagtgcagctgacacagttgaaggagtcatttcaacaactccaattagaaagacatgaatatgctgaacatctaaaaggagagagggcccggtggcagcagaggatgagaaaaatgtcgcaggagatttgcacattaaagaaagagaagcagcaagatatgcgtcgggtagagaagctggagaggagcttgtccaaactcaaaaaccagatggctgaacccttgcccccggagcccccagcagtgccctctgaggtggagctgcagcacctgaggaaggaactagagagagtggcaggagcgctccaggcccaggtcaaaaacaatcagcgcataagtctcctgaaccggggacaagaagagaggattcgggagcaggaagagaggcttcggaagcaggaagagaggattcaggagcagcacaagagccttcagcagctggccaagccacagagcgtcttcgaggagccaaacaatgagaacaagagcgcactgcagttggagcagcaagtaaaggagctacaggagaagcttggtgaggtgaaggagtcggaaacctccaccccatccaagaagggctgggaggcgggcagcagcctctggggaggggaggtaccaggccagaggcagcttccagcctgggggctggtgaccacagcaccccccagggcagtcctgtttcttgcttcctgcctctgacttttaaaggtgggtagccctgggctcctctcaggtctggacatcatcatcctagctagaggcatggagcccccaatcacaggggaagagacagtggtataacaggctccttatgccaggtgcagtggctcatgcctataatcccagcactttgggaggctgaggcaggagaatcacttgaggtcgggagtttgagatcagcctggccaatgtggtaaaacctcatctctactaaaattac

SEQ ID NO: 1452 - DNA, 2405 bp, Homo sapiens
agcgaccgctgccttcgctgccgcccagggcgcttccccgctcaggagcttcctctgggcctctggacggaggcgcgcaggggcccgggaggcgggaacgatgggcctttctaggcggtatcagggccgatgctcgtggatgcagagcagtgaccagcccagaaccgtaccggcttcccggggcaggggcggcccgagcgcgccgctaacgggagcaacgggccctgcccccggtggtgtaggggccacctcgccccgcccagcccagcccgatattgatgggggcccacgccttcattgtttttttgttgttgttgttttttgttgttttttgtttgtttgtttttgagacggagtctcgctctgttgcccaggctgcagtgcagtggcgcaatctcggctcactgcaccctccgcctcccgggttcaagcgattcccctgccccagcctcccgagtagctgggactacaggcggccgccaccacacctggctaatttttgtatttttggtagacacgaggtttcaccgtattggccaggctggtctcgaactcctggccttgtgatccgcccgcctcggcctcacaaagtgctgggattacaggcgtgagccaccacgcacggcccatttgcgttctaatttcaggcgttcctcaatcctctgtggaaccaggaagggcgcaaattataaagggactggcccagcgccgcctctgggcaggctttgggcagcgcctggcccgctgccggcttggacctcccagacctaggggcccggttcctggtggaggctgcagggacctctgccccacccgcccgggggaggcccgaggggctggactcagactgagattgaatgcggctttgtcttcctagttcagccccggcccacacctggggctgagtggaatcgggagcttcgaggggtctggacagagagattgatgccaagaagggggtggccgagccagaggttgaagtgggctggatcctgaggccccctgttaaaggagagggctccccactcagtgctcctggaactttccgaactagagactgggacttataggagccttctagaggaaactgtcgtgttttcacagtgtctgcgagattaatctctcatggccgctgcacaagaacctggcttttagctgaactaaggagaaagtcctacaacagtttggcgtgcaacatggggcttgagaaagggttttcagcagcttccggaggccgcctggactgcagaaggcgccctgggcgtgtgtacttccacctccgcaggcgctggcatctccaggctgcttcaggccgctttggacctcaccatcggtagcatctgcgtcttcttgaggtgactggagcccgtctatggtttcagccattgacttctggacatggaagtgtcgaggccatttttggcccctctcatatccgggaagggctccgtgcccagtagaggtgcagtgcagcagccagctcgcagtagtgctcccgtagagctgatggcattggcaggagtggcggctcagcacagggaagttctccagtgcccaggcccaggcttgctctcggtttaggtcccatggcacgtggggctctggacctgcctgcctccaagacagctcttccaaggttgagggttggaactccacagcctcagcctcccaaagcttgaccaggcccagccatagctagtctaggaaaagagcaaatggccgtgtttttatattttgacttttgcatttcaatattaatttttttggtaatgtaatgcattcaaaacatggtcccccccccccccaaaaaaaaagaaaagaaaaagaaaaaagcatgtttctaaccaggggtccttcatcttctgcagatgccaagggtgtccctggcacagtaaaagtttggaagccctgccctaaagcctcacctcacctggcagctgggtgtttcattcatagcaaatgttctgtatattcaccatgtaccaaacacacatgtcactaatgatacaaacacatgtgcactgacattgacctcctcactgtcttactatagtcccatccacagccaccttatcagagtccatgggactctgacaacttgtaatgggaaaattaaccgtgcctgtaggggccgcctgggtagcgggaggtggttcatgagtaccaggaaagctggccctggggcagacctgggcagggcagagcacagcttgcaggacctagtacacagtgttgggaattgaatttgggttttgacctttgaagctgtgcataaagtctaaaacaagaagaggagtggaggctggggttgtatttgtattttaaaatgagcatttgccacacaaagccaggagcttcagaccagcgtggttaacacagcgagaccctcctctctgtgagaaatt

SEQ ID NO: 1453 - DNA, 2210 bp, Homo sapiens
gttgtagtcgccgcgtcgccggtgcggccgccattgtccggcgttcggcgagtcgggtggtccctttggctggagtgcctctctggtctggggatcacctcaggcgctgtccttcactgggcgatccagcatggaccccgaggacgaaggggtagcgggagtgatgtctgtggggccgccggcggcccggcttcaggaaccagtgaccttccgggatgtggctgtggactttacccaggaggaatgggggcagctggaccctacccagaggatcctctaccgtgacgtgatgctggagacctttggtcacctgctctccataggtcctgagcttccgaagcctgaagtcatctcccagctggagcaagggaccgagctatgggtggctgagagaggaaccacccagggctgccatccagcctgggagcctcgatctgaaagccaagcatcacgcaaggaagagggcctgcctgaagaggagccatcccatgtcacgggaagggaaggattcccgacagatgctccttatcccaccacgttagggaaagacagggagtgtcagagccagagtctggcactcaaggagcagaataacttgaagcagttggaatttggcctcaaggaagcaccagttcaagatcaaggctacaaaactctcagactcagggaaaactgcgtcctgagttcaagcccaaatccattcccagagatctctagaggggagtatttgtatacttacgactcacagattacagactcagaacataactccagcttagtcagtcagcagacaggctccccaggaaaacagcccggtgaaaacagtgactgtcacagagattccagtcaggccattccaattacggaactcacaaaaagccaggtgcaggacaaaccctacaaatgtactgactgtgggaagtcgtttaaccataacgcacacctcaccgtgcacaagaggattcatacgggagaaagaccttatatgtgcaaggagtgtgggaaagccttcagccagaactcctccctcgtccagcatgagcgcatccacactggagacaagccctacaagtgtgccgaatgtgggaagtctttctgccatagtacacaccttaccgtccatcggaggattcacactggggagaagccctatgagtgtcaggactgtgggagggccttcaaccagaactcctccctggggcggcacaagaggacacacactggggagaagccatacacctgcagtgtgtgtgggaaatccttctctcggaccacttgccttttcctgcacctgagaactcacaccgaggagaggccctacgagtgtaaccactgcgggaagggcttcaggcacagctcatccctggcccagcaccagcggaagcacgcgggggagaagccctttgggtgccgccagaggctgatctttgagcagacgccagctctcacaaagcatgaatggacagaagccctgggctgtgacccacctttgagtcaagatgagaggactcaccgaagcgacagacccttcaaatgtaatcagtgtgggaagtgtttcattcagagctctcacctcatccggcaccagataactcacaccagagaggagcagccccatgggcgaagccggcggcgtgaacaatcctcgagcaggaactcacacctggttcagcatcaacacccgaactccagaaagagctctgcaggcggagcaaaggcagggcagccggaaagcagagccctggctttgtttgacatccaaaaaatcatgcaagagaaaaaccctgtgcacgttattggggtggaagagccttctgtgggtgcttccatgttatttgacatcagagaatccacataggagagaaactttgctgatgacttttaaccacaagtaaaaaatgtggtaagtccacatagtgtactcatggaaggaggggctgggggtagaaatgtcatgggtgacttctgactttctaaggaaatgatgcttcccaagcactcgaggttggttggtcccaaatctatcaaactcagtgccctctttagcgacatattttgtgacattccttccattacaccacagtgagttcacaggtaatataacctacccacctgtgtaatgtcaaaaaaaatcaatatgcggccccattttgtaaaggatcattaaaatgaaagtaatttatggtagagtaaattgtagagtaacgtgt

SEQ ID NO: 1454 - DNA, 1902 bp, Homo sapiens
ctctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccctgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgttttgttctttgaaatacaaccaaattctcttaaaatgattggtaggaaatgaggtaaagtacttcagttcctcaatgtgccagagaaagatggggttgttttccaaagtttaagttctagatcacaatatcttagcttttagcactattggtaatttcagagtaggcccaaaggtgatatgactcccattgtccctttatttaggatattgaaagaaaaaataaactttatgtattagtgtcctttaaaaatagactttgctaacttactagtaccagagttattttaaagaaaaacactagtgtccaatttcatttttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttgg

SEQ ID NO: 1455 - DNA, 1891 bp, Homo sapiens
ttcctggggccgcccgtgaggatgtcgcgaccgcccccgggtgcccctcagccccagagacgccgccgcggcggagtccgcagcctccctgcctgaggcgtccgcggccgggatccggcccctcccctcgcctcctctcctaggtgccggccgggagggcggccgcagcagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctccgttcccccagcccaggttcaggagaatcagcaggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcctcctgtacccaacccatccccaccccatatgggagatgcttgcccatgtgtttcatcaatcagaagtcctcctccccagcacattcggatttaaatttctggtctctccggctttctgtgctttaactatctttgctaaagtctcttgctacattgcctaaatccatttgtttctttggaccaaaaatgttagtttaccagaccgatagtggtccttaggacagattttagaccagtaaacttatctttggtgagaaatgaaatacaaatgctatagaaaaattt

SEQ ID NO: 1456 - DNA, 1743 bp, Homo sapiens
ccatcccctcgctgtccgagtgccagtgcgggatctgcatggaaatcctcgtggagcccgtcaccctcccgtgtaaccacacgctgtgtaaaccgtgcttccagtcgaccgtcgaaaaggcgagtttatgctgtcccttctgtcgccgccgggtatcgtcgtggactcggtaccatacccgaagaaattctctcgtcaacgtggaactgtggacgataattcaaaaacactatcccagggagtgcaagcttagagcgtctggccaagaatcagaggaagtggctgatgactatcagccagttcgtctgctcagtaaacctggggaactgagaagagaatatgaagaggaaataagcaaggtggcggcagagcgacgggccagcgaggaagaagaaaacaaagccagtgaagaatacatacagaggttgttggcagaggaggaagaagaggaaaaaagacaggcagaaaaaaggcgaagagcgatggaagaacaactgaaaagtgatgaggaactggcaagaaagctaagcattgatattaacaatttctgtgagggaagtatctcggcttctcccttgaattccagaaaatctgatccagttacacccaagtctgaaaagaaaagtaagaacaaacaaagaaacactggagatattcagaagtatttgacaccgaaatctcagtttgggtcagcctcacactctgaagctgtacaagaagtcaggaaagactccgtatctaaggacattgacagtagtgataggaaaagcccaacagggcaagacacagaaatagaagatatgccgacactttctccacagatatcccttggagttggagaacaaggtgcagattcttcaatagagtcccctatgccatggttatgtgcctgtggtgccgaatggtaccatgaaggaaacgtcaaaacaagaccaagcaatcatgggaaagagttatgtgtcttaagtcacgagcgacctaaaaccagagttccctactcgaaagaaactgcagttatgccttgtggcagaacagaaagtgggtgcgcccccacatcaggggtgacacagacaaatggaaacaacacaggtgagacagaaaatgaagagtcgtgcctactgatcagtaaggagatttccaaaagaaaaaaccaagaatcttcctttgaagcagtcaaggatcaatgcttttctgcaaaaagaagaaaagtgtcccctgaatcttccccagatcaagaggaaacagaaataaactttacccaaaaactgatagatttggagcatctactgtttgagagacataaacaagaagaacaggacaggttattggcattacaacttcagaaggaggtggataaagagcaaatggtgccaaaccggcaaaaaggatccccagatgagtatcacttacgcgctacatcctcccctccagacaaagtgctaaatggacagaggaagaatcccaaagatgggaacttcaaaaggcaaactcacacaaagcatccaacaccagagagaggctcaagggacaaaaataggcaagtgtctttaaagatgcagttgaagcagtcagttaatagaagaaagatgccaaattctactagagatcactgtaaggtatccaaaagtgctcactccctacagcctagcatttcacagaaaagtgtttttcagatgtttcagagatgcacaaagtaaggcctggtaaagggagtgctttgtgatctagtaaagctggaatgtg

SEQ ID NO: 1457 - DNA, 1620 bp, Homo sapiens
acatgcaaaaagtggggcctggagatggggctgtcttttttctccaaacacttgcccatccaggaaggccagccctgggcattgaagactccagctgacatcatctctaccgttgagttcaaccacacgggagagctgctggccacaggtgacaagggcggccgggtcgtcatcttccagcgggaaccagagagtaaaaatgcgccccacagccagggcgaatacgacgtgtacagcactttccagagccacgagccggagtttgactatctcaagagcctggagatagaggagaagatcaacaagatcaagtggctcccacagcagaacgccgcccactcactcctgtccaccaacgataaaactatcaaattatggaagattaccgaacgagataaaaggcccgaaggatacaacctgaaggatgaagaggggaaacttaaggacctgtccacggtgacgtcactgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcaacatcgtggacatcaagccggccaacatggaggaccttacggaggtgatcacagcatctgagttccatccgcaccactgcaacctcttcgtctacagcagcagcaagggctccctgcggctctgcgacatgcgggcagctgccctgtgtgacaagcattccaagctctttgaagagcctgaggaccccagtaaccgctcattcttctcggaaatcatctcctccgtgtccgacgtgaagttcagccacagcggccgctacatgctcacccgggactaccttacagtcaaggtctgggacctgaacatggaggcaagacccatagagacctaccaggtccatgactaccttcggagcaagctctgttccctgtacgagaacgactgcattttcgacaagtttgaatgtgcctggaacgggagcgacagcgtcatcatgaccggggcctacaacaacttcttccgcatgttcgatcggaacaccaagcgggacgtgaccctggaggcctcgagggaaagcagcaagccccgggctgtgctcaagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacatcttccaggacaaggtaaactctgacatgcactaggtatgtgcagttcccggcccctgccacccagcctcatgcaagtcatccccgacatgaccttcacgaccgcaatgcaaggaggggaagaaagtcacagcactgatgaggacagctgcagaggtggcagtgtgtggacacaggaagtttgggccccctccctgccccagctttcctaggccagaattgtgtttggcagtaattgtctgtttaaaaaaataaaaaggaaaggaagcgttcaccgccacaaatcat

SEQ ID NO: 1458 - DNA, 1390 bp, Homo sapiens
aatcccgtgcggcgcgcacaggcaggaggttgcagttgggcgctcagcagctgtggcagccggttgaggtctggcagtagcgttgggctgaagcagcggagttcgccatgcgcgagtgtatctctatccacgtggggcaggcgggtgtccagatcggcaatgcctgctgggaactgtactgccttgaacatggaattcagcccgatggccaaatgccaagtgataaaaccattggtggcggggacgactccttcaacacgttcttcagtgagactggagctggcaagcacgtgcccagagcagtgtttgtggacctggagcccactgtggtcgatgaagtgcgcacagggacctacaggcagctcttccacccggagcagctgatccccgggaaggaagatgcagccaataattacgccaggggccattacaccatcggcaaggagattgttgacctagtcctggaccggatccgcaaactggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacagcctccctgcgatttgatggggccctgaatgtggacttgacggaattccagaccaacctagtgccgtacccccgcatccacttccccctggccacctatgccccaaagacgtcaacgcggccatcgccaccatcaagaccaagcgcaccatccagtttgtggattggtgcccgactggatttaaggtgggcattaactaccagccccccacagtggtccccgggggagacctggccaaggtgcagcgggccgtgtgcatgctgagcaacaccacggccattgcggaggcctgggcccgcctggaccataagttcgatctcatgtatgccaagcgggcctttgtgcactggtacgtgggcgaaggcatggaagagggagagttctctgaggcccgcgaggacctggcagctctagagaaggattatgaagaggtgggcgtggattccgtggaagctgaggctgaagaaggcgaagaatactgaggggagggtgtggtgggttctcccctgccacccccgggatggctgcttccaagttgtttgcaattaaaggttctgtataaaacc

SEQ ID NO: 1459 - DNA, 3817 bp, Homo sapiens
tctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaggtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacttggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctgtgctcacagacatctgaaaagtgaatggccaagctggtctagtagatgaggctggactgaggaggggtaggcctgcatccacatagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacgactgcaaaaaaaaaaaaaaaaaaaaaaaaaaaaaaaaaaaaaaaaaaaggccacagcatcgagtcggccttgttagcctactgggacggctgcagaacatccgccgcaccgctgggggccaacgttgtcggaccgaggagtccgaggtggcgactgagtgagatacccagctgtgcggagctaggacgcggaacatcccagaggccagcatcaacatgtttccatccttggggaatgaccacgcaactgggcccagccctggtgctgggggtggccctgtgcctgggttgtggccagcccctaccacaggtccctgaacgccccttctctgtgctgtggaatgtaccctcagcacactgtgaggcccgctttggtgtgcacctgccactcaatgctctgggcatcatagccaaccgtggccagcattttcacggtcagaacatgaccattttctacaagaaccaactcggcctctatccctactttggacccaggggcacagctcacaatgggggcatcccccaggctttgccccttgaccgccacctggcactggctgcctaccagatccaccacagcctgagacctggctttgctggcccagcagtgctggattgggaggagtggtgtccactctgggctgggaactggggccgccgccgagcttatcaggcagcctcttgggcttgggcacagcaggtattccctgacctggaccctcaggagcagctctacaaggcctatactggctttgagcaggcggcccgtgcactgatggaggatacgctgcgggtggcccaggcactacggccccatggactctggggcttctatcactacccagcctgtggcaatggctggcatagtatggcttccaactataccggccgctgccatgcagccacccttgcccgcaacactcaactgcattggctctgggccgcctccagtgccctcttccccagcatctacctcccacccaggctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccagctctctgcctccaggatgaccttgtgcagtccattggtgtgagtgcagcactaggggcagccggcgtggtgctctggggggacctgagcctctccagctctgaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtcctccatggcaaggaagcagttccagggagagtcaggttccagctagttagggctgccagcctagggctttgtgcctacacctcactaagcccatggagaggtcacagatgggccgtgcacgggcagatgggccccaaaaaatcttggcgaaggtcggtaaagtgctaagctgttgtctgcactctttcatcataaagtcacttttttccactgcc

SEQ ID NO: 1460 - DNA, 1757 bp, Homo sapiens
agttttaaaaatgtaagtttctctgcacaagctctctttttgcctgctgccatccacgtaagatgtgacttgcacctccttgtcttctgccacgattgtgaggcttccccagccatgtggaactacatctacccctggagaaagagcccaatgagaagtaatctctgaagcccagatttcctaaggatgaagcttcaggagaggccttatcaatcctgacaacaaacttttctcgtcaatttagtttcatttaatggaagttttaaatgtgtaaagttcagaaggctattaaaattggttccagctatctaagatacacacacaaccacacacgcgcacacacgaatacaaatatgccttcccaatcatctcccaaagtctcaactcattccagcgttaactcaaagaccaaaattcaaagtctcatctgaaacaaggtgttgccaaaggagattattatttgagtcagaggactgggagaagcagacctaccctcgatctgggtgggtgtcatctagtcagctgccagtgtggctagaatgaagcaggcagaagttggaaagagcagacctgctgagtcttctggccctcaccgttctcccgtgctggattcttctggccctcaaacatcagactccacgttcttcagcttttggactcatggacttacaccagtggtgtgccagggcctcttgagcctttggtcacagactgaaggctacactgtcagcttctctaattttgaggttttgggactcagactgatccaccactggcttccttgctcctcaacttgcagatggcttctcacgggacttgactttatgatcatacttggccaataagatgttcctgcctaagactttgaatctggaatggggaacacagagaacatgagcaacgaagaattattcacagcacagcacagcagtgctgacagcatcgacagtcctgtggtgccagcaagaatccaaaagaagtgtcctacataaattcccttaatcactgaccatttaatgaggctgattcagcctcataaaaattttgtatgcttcttcatacaatttttaattgtgctgtaaaagttaaccagagacaatttctgttgcttgcacacagtaagttgactaagcaaaaaaattcaggagagattattttatagaagtcaatgcaaatgcattaatttacaagaagtgaaactgcaagttcactttgctgccttatggccagcatattctcttacaagggaagtctatatggcaatctgtgttatgatcagaagatttgggaaagatggaatctgtgagagagttttatgacacatggttacaactgatcacaggatcaaacactaaaactccaatatatatatttattcttattagcaaagcttttatgctatggaggaaaaagaaaaagaaataagaaattctgagtttctctaaacttccagtatgtggatgagttaaaaactatgtcatcttggattccccattttaaatatttcataataatgcattataattggtacatgttaatatcaattttttcttttgctgtttttgaagtggtgtgaatcacctgtaacaaggtttccttatcatccatttaattattattgtcctataatatacttttcaatacagcaactactttttatgttttgggattacttttactattgttagataaaacctatggttgattgtgtgcctctagaagaacttcaaaagtacaatataaatcttgctaacact

SEQ ID NO: 1461 - DNA, 1929 bp, Homo sapiens
ataacgggcgttaataaccataccctgttagactaagcatggtccacccgcgaatcctctacagagatggccaagcgctggggtcgtggctgcgtcctctaggccagccttgtgcaaaggaccttctcaccacagatcagccagaccatcttcctccttccaagtcatcaaagagttccaagctggtcacctgtcccttgatgttcccaggaaaccaggaaagaggacccctgcattttatcttcccatccagagtggcaggatctctgcctgggaaacaggcttcattcagcacagctgtggtagcattaacaaagcaaagtgggcacatgtagaagttgaagctaaaacattcaagaactccagtctgtttctgtggatgttaagggggtgaagataaaacaatggaggtgatgaggaggaataacttgaagacagtttaaagccacagtgatacaaagaatgaagagaaggaaggtgctggattttactaagaaaacagactgagttcaggagtctcaccagtagaactttatagtattgcgtttcgattacatgtgtgtgaattttaaaaactgattaccctccagtaaaaatgtggaaccaatttgcatttggattaaaacattaggtttggggacaaaagtggaccccatgctgcctgagatgaagagagagagcaggatggcagaggaatcaccagctcaagaaaccccaagacttggacagtcttccagcagaagaggccagggtctctcagtgtactactccaaacaggcctctcctagagatgtagtctgggaaggtccaaaacccaccagacaggcacatccagtggggaaaagacttcccattccagtgtggcctgcatccctcacctctgcttcccagtcttctgctgacctcagaggagcagggtggccattgctgatctgggttagggagatgccagaaacacacccaggtttgaaccacaggttagtggtacaaagtcacagtccttgtgccttcagaaaacccagaggccccaaatacgagtgggaagagagttgggaaaaactgaaccagactcttccaatggccattaaagagaaaattcagcaacgcttgcctttgtctttgaccctgagaagttaagggacacagattgtggcgccgtgatggaacatggagggaaggcatggtgtgcttcctgcagagatgcctctggagtccctgtggccacgggatctcactggccccctcttcaggcaccttgatggggctcagtggggccaggccaaagggtggaagtagaaaagcatcaacaggctgtccagatcaattggcaccatccaaggccctgctgcacccacacatggaggtcaccagctcagccccaggggttctttcacacacaagctccttccctaaggagtcctgtggggttccacactcagtgtgctgcccaagtcagagatttaccacagatctgtctccccctcaacctggactcaagttactgtggtgagaaacctcactgtccatggttaactgaagaaatccctccttcagaaagaacttgagtagtagatgaggtggttagacaggatctttttccctcaagctgtttggacgccacagccaggaccaactctgacagctgcgagagagagagcccctccaatgtggaacctcctacacagccccccttttgggtccctggatatgagcccccagcaggaccaccactctagggggaagtctccctcccatccctcagatccccacattgttcctcctgtaggagaaaagtcagccctgcccctggagcttctccaagatggcactggactcgccgttatcttgaggagccaggagctgaaatggctccggcttagcaacccagtatggccaaagtggaaaggttctctgtcctttgcagtcacc

SEQ ID NO: 1462 - DNA, 1593 bp, Homo sapiens
atttgcctctcaagcagcctctggtcatctatctgcctttgagccatcaagatgccgatgtcttctcttccagcagctattttgtctcacatgacagctattaacaatgtgcctcctcctccacttcacagtataccaaacttgaaaaagtctaagcacattaattatggccagttgaatgcattatgccacattagaggacaacacagccggagtatgagcaatatcttatcagctcacgatacatttatgaagcaatatcctaaagtattcctgcaccaaaaacccagacttcctaaacttttcaaacaggaggaacaaagggaactcaatgaaggcaaagaggaaagtcaacatcaacaacctgatgattctaacaatatagctgtccatgttcagagagcacatggtggccatattttatatagaccaaaaagagccacagagaaatttgaagaattcctagctatcttaaagaaattgcccattcacaggacgccatatgaacacaaaactgtgtggaagttcctgaaaacaattccagatttaacctttcagctaaatgataagcatctgaaaacacttagtaagactgtcttttccgaaacctggttgaaaggcagcacagtggttgcaaatgatggattttatgtaatactgaaaggcctagctcgacctcaaacaaacgtgtataaaaatctgattgaaggaagtgattcaccagactcgttcatatctcagagtttccacagcttcatttggagtgaagaattcaaaaactctacacttgctgagatgtacctaccttcatatgactcaatgcttagcaaatggagtacctttgggactctggaagttatgcctcagaatgaatcggaaacacagatgttctcggtggtgacagaagacgattgtgaaattcttaaaatcccagcaaagggatatgcaaagataaaggaggaaaaaataaaacttgaaaatatgcaaaagttgaaattaatccgtatgtgtccttattatgaggaatggcctactttatccatatatgagctaattgcactccttaaatggaaaaaatttcctccaggtcatgtgatagtggaaagtggaaatataatttcttttgtgggttatattaactctggatgctgtaacatttatagaagtattataggatttgtgaaactacgatcaaataaagtgaaaagatctcaaaaacttgtttatatggggaaacttaaggagaaggagtcctttggtgagattagcgtccttcttcaagttcctttcacgtgcacaatcattaccaaaaaagaagttgagatggcaatcattgaagataaggacctatttgtggcctagatctagaaacaacctcagtgaacattaattaagaaagtattgactaaataatggaataattgcattctggaatactatcaaactaccagcaatgaatttggtctattgtgactacatatcctggattccccaggaaagtcccactttcgaattgcctttcaaacacagtttttattagcagtctttcttggtttggatactaaaataaatatagttatcattgcttgattt

SEQ ID NO: 1463 - DNA, 1618 bp, Homo sapiens
atttttcaggtgaggaaacagaggctctgggagctctcgcctgaagccactcgctgtccgccgggccggtggcgttcaccccgcaccgcgctgccccgcccggggcactatggcctggggctggactatgccctccccacctcagccggcgccccccacccacgcgcgctgagggtgcggtgagctgagtgcggggccaagcatgttctggcgtcgacttcgcccaggggcccaggacctggcgcccaaggggctccctggcgacggagacttccgacgcagcagcgacccgcggctgcccaagctgaccccgcccgcgctccgagcggctctgggcgcgcggggctccggggactggaggatcccggggggcggcgccgcgtggtggccggaaggggacgccaagcccggggtgggcgtcggacgcctcccgccgcgcctgcccgccttgctcaccgcgacccggcgggccgtgcggaagcgggggctgctgcggtccctgctgccgcctcccctgctgtcggccggcgcgtcccgggaatcggcgcccaggcagccagggcctggagagcgcgagcgcccccggaggcgcgtggccagggaggaccccgacttcttgggcgccttcctaggagagctcctccccagcaggttccgtgagttcctgcaccagctccaggagaagtgcaccgaggagccggagccactgacatccccagcaccgcaacatcaaaggggtgtattagagcactgcccagggtctccgcggtgtcccaactgttcattcctcccagacctgtggggccagtcatcgcacctccaggatagtcttacgaagatttcgctccagcagacacctattctggggcccctgaagggtgatcactcacaattcaccactgtcagaaaggccaaccacaggccccacggtgcacaggtccccaggctcaaggctgcgctgacccacaacccctcgggggaaggctctaggccctgcaggcagcgttgccctttccgggtgcgattcgctgacgagaccctgcaggacacaacgctccgctactgggagcgcagacgctcagtccaacagagcgtcattgtgaaccagaaggccgccctgccagtggcgtccgagcgggtgtttgggagtgtcggaaaacggctggagagtttgcccaaagccctgtaccctggggccaaggaggagaccctggccagctcctcgtgttgggactgcgctggcctgtccacccagaagacacagggctacctttctgaggacacctccatgaacagcagcctgcccttctgttcatggaagaaggccgctgcttagaggccgcgaagcagcctccgagccttcttggacccgcacagaaacctggagcaggagtccctcctgcccaaccgggtgctgcagtcggtcctgaagcaaggctgccctaaggggtaccatctcctcctggcctccgcaacactgcagccagataagaggtgaacactcgcgaacccaaggccaggggcacacatgggccaggcaatgaggagcgtccttccttgccccacaaataaaggcacatcccaggtggctgggacctgccagtaggtgtcacaccac

SEQ ID NO: 1464 - DNA, 1914 bp, Homo sapiens
gtgtttccggcaggtgacgctgccgagtccccgcagcagggggcgagcaagggactcgcggttgacgggacacggatcctctaaggcccagagtgtcccgagtagcggcagtggggagtgctcagggtacgctaatgatctgtgtcttgtaaagagcatattgctgggcttacatccgtttatcttgtttgactgttattttaatagcttggtgttctcaagagtctgccctttccgaggaagaagaggatacaaccaggcctcttgaaacagtgacatttaaggatgtggctgttgaccttacccaggaggagtgggagcaaatgaaacctgctcaaagaaacttgtatcgagatgtgatgctggagaactacagcaacctagtcacagtgggctgtcaagtcaccaaaccggatgtgatattcaagttggagcaagaagaggagccctgggtgatggaggaagaaatgtttgggaggcactgtccagaagtttgggaagttgatgaacagatcaagaagcaacaggaaacacttgtgaggaaagtcacatccatctccaagaaaattctgataaaggaaaaagtcattgaatgtaaaaaagttgcgaaaatatttcctctgagttcagacattgttacttcaagacaaagcttctatgactgtgactcacttgataagggtttggaacataatttagacttacttagatatgagaaaggctgtgtaagagagaaacagagtaatgagtttgggaaaccattttaccattgtgcatcctatgttgtaaccccctttaagtgtaatcagtgtggacaagacttcagtcataaatttgacctcattagacatgagcgaattcatgctggagagaaaccttacgaatgtaaagaatgtggaaaagccttcagtaggaaggaaaatcttattacacatcagaaaattcatactggggaaaaaccgtataagtgtaatgaatgtggaaaagctttcattcagatgtcaaaccttattagacaccacagaattcatactggggagaaaccttatgcatgtaaggattgttggaaagccttcagtcagaaatcaaatctcattgaacatgagcgaattcacactggagagaaaccctatgaatgtaaggaatgtgggaaatccttcagccagaagcaaaatcttattgagcacgagaaaattcatactggggagaaaccttatgcatgtaatgaatgtggtagagctttttctcgaatgtcatctgttacgctacatatgagaagtcacacaggggagaaaccctataaatgtaataaatgtggaaaagctttctctcaatgctcagtatttattatacatatgagaagtcacactggtgagaaaccctatgtatgtagtgaatgtgggaaagccttctctcagagttcatccctaaccgtacatatgcgaaatcatacagctgagaaaccctatgaatgtaaggaatgtggaaaagccttcagcaggaaagaaaatctcattacacatcagaaaattcacactggagagaaaccttatgaatgcagtgaatgtgggaaagcttttattcagatgtcaaacctcattcgacaccagagaattcatacgggtgagaaaccctatgcatgtacagtatgtggaaaagcctttagtcagaaatcaaacctcactgaacatgagaaaattcatactggagagaaaccttatcattgtaatcaatgtgggaaagctttcagtcagagacaaaatcttcttgagcatgaaaaaattcatactggagagaaaccattcaaatgtaatgaatgtggtaaagccttctctcgaatctcatccctcactcttcatgtgagaagtcacacaggggagaaaccctatgaatgtaataaatgtgggaaagcct

SEQ ID NO: 1465 - DNA, 1939 bp, Homo sapiens
agattagactcctcagaagctaattgactagggaaggatcaggaagacaagacacatcaaaaaggggagggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcgggacctggtggaagatgaagagtgggagaaggagaaccgcaccacgatggaaagggaaagagccttgcaggagctggaggaagaaacagccagacttgaaaggaagaataagacgttggtccacagtataacagaacttcaacaaaagcttacaaggaaatcacaaaagataaccaattgtgaacaaagcagtccagatggagccctagaagagacaaaggttaagttacaacagctggaagcttcctatgcatgccaagagaaggagctgctcaaggtaatgaaggagtatgcatttgtgacccagctctgtgaagatcaagccctctacataaagaagtaccaggaaacgttgaagaaaatagaagaagaactagaggctctgttccttgagagagaagtatcaaaactcgtgagcatgaaccctgtggaagaagagcataccagccaaaataatgagggtactcctacccaaaagacagcaagattattcagtaaaaaatgggcctcctccttttagtggcaagatggctgccaacaatccagatctcgtactaccagattggcaacctttgcagaataaaagtcttttccaacaggttcagcagtaaagtccagaaaaggtcataaactggcctatctgaggtcaattgcctaccctgtcccacagtcaatgtggccagagggatggagtactctgattggtcaagcttatgtcatatgttcagccccttactaaggattaagagcagtcaaagaagaagaacaaagtaagggaatgacctaaactatatgaaatgcatttctcccactaaaaggggctcagtgcctatggaagagaaaagggatgctggacacgcaaaagcagaggtctacttcattgctaaactctgtgtcttcctataagcaaaaattataacttctaaagatagtagattaagacggtgaaagcttctacaaagagctcagtttaagaaccatgtaaataatcaggtcactagggctaaagtaagcaacaattctaaaataagtagaatatgactggtataaattgcttcaccaactcaaagtagcatatatatcacacctcttatttttccaattaattgctgaaacattcacatgccttactaataggatatactctacattattttccagtacaagagaaaattattttaaatggtaaggttttaggtctaaaagtgtctcaattttaagaaagctgatatcaagcaggtcatattttctaggcattgtgcaatgactatagaaattatgaaaatgtgtaaccaaccagtaatatctagccacaggcaaattttataaaagatccttttaattaacttctggattaaatggaaaatccaaactgagattacttttatagggtcagttacatgctaaggaggaagcatagagagtagaagaatggttaccagaggctgtaaccttcttaatttaaggtaaaaaattctacctattagcttagtattagatgaaaacagaaattcttgtcacatacaggcactattcactgcagtgaagtatatcttttcagaaagttgcataaaatcgaataaaataccatgtattaaatt

SEQ ID NO: 1466 - DNA, 2402 bp, Homo sapiens
cagtgcatacttggaggaccacagctacaacgtggagcagatatggagggatattgaggacgtcatcatcaagaccctcatctcggcccaccccatcatcaggcataactaccacacctgcttccccaaccacacactcaacagcgcctgctttgagatcctgggctttgacattttgttggaccacaaactcaaaccctggctgctggaggtcaaccactctccaagcttctccaccgactctcggttggataaagaggtgaaagatggtctgctgtatgacaccttagtcctgatcaacctggaaagctgtgacaagaagaaagtcttggaggaggagagacaacgggggcagttcctgcagcagtgttgttctcgggagatgaggattgaggaagccaagggtttccgggccgtgcagttaaagaaaactgaaacgtatgagaaggaaaactgtggagggttccgactgatttatcccagtctgaattcggagaagtatgagaagtttttccaggacaacaactccctcttccagaatactgttgcttccagggctcgggaggagtatgcccggcaactgatccaggagctgagactaaaacgggagaaaaagcccttccaaatgaagaagaaggtagagatgcagggggaatcggcaggcgagcaagtgagaaagaagggcatgaggggctggcaacagaaacaacagcagaaagacaaggccgccacccaagcctccaaacagtacatccagccattgacattagtatcctacacacctgacttgctcttgagtgtcagaggtgaaaggaaaaatgaaacagacagcagcctcaaccaggaggctcccacggaggaggccagctctgttttccccaagctgacgtctgcgaagcccttcagttctctacccgatctgaggaatatcaatctcagcagctcgaagttggagcccagtaaacccaacttcagcatcaaggaggccaagtctgcctctgcagtgaacgtattcactggcactgtgcacttaacctccgtagaaaccaccccagaatccaccacccaactctcaatctccccaaagtctccgccaaccctggctgtgaccgccagctctgagtacagtggcccagagacggacagggtggtatcctttaaatgcaagaagcagcagacccctccacacttaacccagaagaaaatgttaaaatcttttctgcccacaaaatccaagagcttctgggagagtccgaacacaaactggactttgctaaagagtgacatgaacaagccacatttgatatccgagctactcaccaagcttcaactgagtgggaagctctccttcttcccagctcactacaaccccaagctggggatgaataacctgtcacaaaacccctccctgcctggggagtgccactcccgcagtgacagctctggcgagaagaggcagctggatgtgtcctccctcctcttgcagagtcctcagagctataatgttactctgagggacctgctggtgattgccactccagcccaactggatccaaggccttgtagaagccacgcaagtgctatgagggacccatgtatgcaggatcaagaagcatacagccattgcctgatctctggccaaaaaggatgtgagaggagctagaatcagactggatctctgccacttttcccttcctacctcttaacttgcaggaaacaatgtgtctcttccgacagtgtctccagtgttcacagaatcaactgaagttttgtttgctcatctagatatactggtcttccattagttcctagtagcagcaatggggccaacagccctgcctctgttccctcccagttagcttacagtgctacaggaccatgatttctggggttggattggtgctgccccaggacacactccagttgccgtaccagtggcacttctctgggttcttcacatggcaccatcatccagaatactcccccagataaagcaacttcgggagtagtgtttcagagaaggactcatgatttccaggagtcaaaagccctcagtccaccaacagaactatgccagttggtcttcatctccaagataaaagatgaggtcagggatgggcatggtgcataactctgagccctgagtgagagaactgaggcagctgcaacttcacaaggtcaaggcccgacctccgcccatccccaccagcccaaagacttgccacctcagtgcccgagcatcctctggtgacctccctcaccagcccaacttaatctcaccagtgaaaacagaggtgaggcgagagtacccagcctgaagatgcttcttctatcagcctgcagaaatgttacactttcccttcaggcatccattaataaaagaaattgccatgcttactgcc

SEQ ID NO: 1467 - DNA, 1613 bp, Homo sapiens
ctgcctgtcagatgcctcattcccacctgtgatgctcagagagaaaccatgagccctcaaaaacaccatattgttttgtgatgtcacctctggaatgttctgagtgttttggtgaccaacttctgcataggacctatacctggcaactcacattgcactcaaggccaaattatacaagaaaaagagataccagatctgaaagcctagaaattccaatcagtgtggttctacctcagaggggcacagccgaacccttcccgaggctccacaacttgtacagcacccctcgctgcgcgcagcaggccgccctgccccggctgagccgcaggatggcgagccagcactcctatccactgaaccgcttctcctccgtgcctttagaccccatggagcgccccatgtcccaggccgacctggagctggactacaacccgccgcgggtgcagctcagcgacgagatgttcgtgttccaggacgggcgctgggtaaatgagaactgccgcctgcagtctccctacttctccccatccgcctccttccaccacaagctgcaccacaagaggctggccaaggagtgcatgctgcaggaggagaacaagtctctgcgggaggagaacaaggccctgcgcgaggagaaccggatgctcagcaaggagaacaagatcctacaggtcttctgggaggagcacaaggcctcgctgggccgagaggagagccgggccccctcgccactgctgcacaaagacagcgcgtccctggaggtggtgaagaaggaccacgtcgccctgcaggtgccccgtggcaaggaggacagcaccctgcagctcctccgggaggagaatcgcgcgctgcagcagctgctggagcagaaacaggcctactgggcgcaggcagaggacacggccgcccctgccgaggaaagcaagcccgccccctcaccccacgaggagccctgcagccccgggctgctgcaggaccagggctccggcctctcctcccgcttcgaggagcccaaagggcctccggcccggcaggaggactccaaggagctgcgcgccctgcggaagatggtcagcaacatgtccgggccctccggggaggaggaggccaaggtgggcccgggcctgcccgacggctgccagcccctgcagctgctgagagagatgaggcaggcgctgcaggccctgctcaaggagaaccggctcctgcaggaggagaacaggaccctgcaggtgctacgggcagagcacaggggcttccaggaggagaacaaggccctgtgggagaacaacaagctgaagctgcagcagaagctggtcattgacaccgtgaccgaggtcaccgcgcgcatggaaatgctcatcgaggagctctacgccttcatgccggccaggagccaggaccccaagaagcctagcagggtctgaggcctcggccttgcaccgggacgccgagtttgggacaccgaacactgggcaaaagagaatcccctgccttcccttgtcgtcctcgccttccccagccagttcgtacctattgaaaagcagcgttagcagccttcctaaactcagagttttaataaaggtgtgaggaggctggggccagttgacacc

SEQ ID NO: 1468 - DNA, 2046 bp, Homo sapiens
ctggtgggtgcgcggcacgagccccgaagttgcttaggagctggcgagccagtccctcaaaacgacttcgttcgaggttggcgcccgcctttttcagagagcacttcttagtgggtattccgtccggggccacttttctgaggccgaaggacccctagtcagtgtgtgagacatagcctggccgagcctgggaaccacctggggctgagagacgaccttaagtggacagagattctagaacaggagaaataaaacagctatcgtttgggagcaatgagtttaaaaccctttacctacccgtttccagagacgaggtttcttcatgcaggacccaatgtgtataaattcaaaatcagatatgggaagagtatcagaggagaagagatagaaaataaggaagtcatcacccaggagctggaggtagggaaagaagcatacgacttctggaaaagttactctttaaggatgcatccacattcaggttttaattatttcctacaaactgagtcacaacctccacttgataacttggcttcctcctgctacatctcctttgcaaaggaactttatgtttttccatgggaatttaaagcctgtattctttctcagttttcctagttgaaatgtcagcacctttgaggctgagagctttttgttttcaccagtttccagccttgggcagctctcttttgttgcagctggcatagagaaagattccggaggactgcctccttccagggctctgggaaacctcaccatcccaaccactgcctggtacttgacgttcaggaaactcgactgtaaatacacagacaaggctgctgtgtcttcatttaaattggcaacatttgcaattgccttattccgacttcattttcattcctttctacccggttcctctagctttaggttttcctacagaagaagactgagcaggtgatcaactttacaaattggtggaagcaatggacaaggagttagagttctgggggttggccctggattccagtcctggcatagccaccacttagctgtgtgaccgttggcaaatcatatatcaacttggatcttaattgcctcatttggaaaatgagaggtctaaactagcttttcctcttctgacttcacaattcggattctgtccgcgtggtcttgggaaacttggacaatcttcagccctttgctacagaacacttcattgtatttccctataaaagcaaatgggagagagtttcccacctgaaattcaaacatggggaaattatcttgatcccctacccatttgtttttactctatatgtggagatgaaatggttccatgaaaacctgtcacctgggaaaccaataagtgacagtcctcttgggttggtcccagttgagaagaaagcagtaggagctgtgatgaggaaacgaaaacacatggacgagcccagctcccccagcaggccagggctggacagggccaagatagggacttccagccaaggccccagcaaaaagaagccccctgtggaaaccaggagaaatagggaaagaaaaacccaacaaggattgcaggagactctggcctctgatatcactgatgtccagaaacaagattctgagtggggacacagcctgccagggcgaattgtcccacccctgcagcacaactcacctccacctaaggagcgagcagccaccggcttctttgggtttctaagctctctcttcccgtttcgatatttcttcaggaagagcagccactcttgagccttccaaatgcagcgctggaaagaggatcatctcttgtagtgactcctcccgagccattcttcctccaactctatccttttcttatgacacttcagtcgtggggaatgaggtccccatgctgagtcctctgtggttttatcgtgtcctttgcccctttataatagattttttcccccaatttaaaacattaagaatggaactttctaaaatgttcatgtcctgagggccggtttaggccttttgtcttcggcacttaggatcctaatgacaataaattatttatgaagagtt

SEQ ID NO: 1469 - DNA, 2579 bp, Homo sapiens
aggtgcaaggaccaggactagggcgagggcagcggtccaagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaagactacagcaaaaggctactgaagtttttagtaagacccggaatggagaggatgtgaggataacgatcactttaacaaatgaacttccacctacatcaccaacttgtttgcagttctataatattattttcaggaggcttttgaaaatcatgaatttgcaacaaattggacgaaattattataacccaaatgacccaattgatattccaagtcacaggttggtgatttggcctggcttcactacttccatccttcagtatgaaaacagcatcatgctctgcactgacgttagccataaagtccttcgaagtgagactgttttggatttcatgttcaacttttatcatcagacagaagaacataaatttcaagaacaagtttccaaagaactaataggtttagttgttcttaccaagtataacaataagacatacagagtggatgatattgactgggaccagaatcccaagagcacctttaagaaagccgacggctctgaagtcagcttcttagaatactacaggaagcaatacaaccaagagatcaccgacttgaagcagcctgtcttggtcagccagcccaagagaaggcggggccctggggggacactgccagggcctgccatgctcattcctgagctctgctatcttacaggtctaactgataaaatgcgtaatgattttaacgtgatgaaagacttagccgttcatacaagactaactccagagcaaaggcagcgtgaagtgggacgactcattgattacattcataaaaacgataatgttcaaagggagcttcgagactggggtttgagctttgattccaacttactgtccttctcaggaagaattttgcaaacagaaaagattcaccaaggtggaaaaacatttgattacaatccacaatttgcagattggtccaaagaaacaagaggtgcaccattaattagtgttaagccactagataactggctgttgatctatacgcgaagaaattatgaagcagccaattcattgatacaaaatctatttaaagttacaccagccatgggcatgcaaatgagaaaagcaataatgattgaagtggatgacagaactgaagcctacttaagagtcttacagcaaaaggtcacagcagacacccagatagttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcaaagtctgcctgcaagcggctctgagggcttggaatagctgcaatgagtacatgcccagccggatcatcgtgtaccgcgatggcgtaggagacggccagctgaaaacactggtgaactacgaagtgccacagtttttggattgtctaaaatccattggtagaggttacaaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccagtaagtgcttctacttgttgatgtttagcaaataaaggacattcacttttcaaaatg

SEQ ID NO: 1470 - DNA, 2166 bp, Homo sapiens
taaagtctggagggtgctgaggcagcagggggctggtgtattagcactgccctgagcgtgtgcacacctggccaggctgcaacagtgcccaggctcgccctgactttactctgagatcaaagtggacactgacagcagggagaagccaggcagcagaagcaggcacttccaaacctgcgaaggccggggatggggcttcctgggccccctagagtgcagagatgcctgggtctgcagccatggtttgggtggctgtagctgcgcctaggagaggggcttctctctgctcccggcttccaggagcacagggatgcctgggtctgcagccatgacttgggcagctgcatctgtgcccagaggggtggggctcctgcctgctccatggagcagaaggcctggatctgcagctgggacttgggtggggcttctgcctgctctgtggagcaggaggtctgggtctacagctgtgacttcagtggctgcagctgtgcccaggagagtggggcacccatctgctcccggcccgagagcacagggatgcctaagtctgcagagagctaccacccaactcggaaggggcagggctcctgcttgtccgcagctcctgccagttccatggagcatgcagccctggctgtgcctccctgctgcagctggcatgatggcaccagccactttagatggaccgtggtgtcatcactgagaccctgtcttgacacagctgtcaggacactctctagccacacttgccttcctgctgccagtgccgccgtggctcaggtggctgcagttccttgagatgtcccagtgggtcctgggtgagcccatccagctgatgggccatgaggcaacaggcaagtggacaggccagcactgtcccccttcctcttcttctgccccttcaactgcaggctggaaaattcatatgttaccaggaaaacagccggctacccagggctatttacctcaggggccaagcttcccgtgggatgagatcgttgggctcagagaacgtgttgagcaaacacagtactttctgtgagctgggttaggcttgtacagactccagagtcccaaatatggcttcatccacagtgtcggagcagcagcgagggctctaagaccacccagctctcttcctggctattttttccatgctactcatcccaaaacttgatctcacattgctctgtttctttctctgcctccatgcttgatgcatttacttaatctttcgcaggatgggtcattactttttgcaatagcacactcaaaggtaatgaccaagataaattgaaaagaggattcaacagtattcattgtaagattgaatgggatataaaatacgtaatcagcacttgtgaggaatatcactagattctcttcttcctactccccctcctttttttttttttttttttttttgcattaaaacccgggaatttgatgttgattgtggcctaaatgttaagcatattctggattttctacaccgttctgacaccacaggtacttgtttctttctcagaaggcaggtgaagctcagctgtgtggggctgtgcttggtggcagtgtgggaaacgtgtggaactcaccatggtgttagcagcttttactagccgtttgcttggaaaacagtctccgatctgcacttgcacacccaccacgatgccttctccccatggctctgtggacaccaggaggtcagggcacagaggacgtgcgacttgtgctcctgtcttgctgcacagtctaaagacctcacgtacgttttgaatgttcaaccactattagagtgagaaatggcatccaagatgcttttactgaggaacattgacaactggaaaacaaatcaagcttggattccagggaacactgtccagatttcctgttttatgaattttaccattcactcttaaggctgttaggtttgaataacttgataaatgatcaagagaaaaccatgcagcattatgttcactgccaagtaatatggacgtagaggatggaagaattctgtaaaaccacttctggagttcaacatttaaccgagcacattttacttacctgttaccagtgtgtcgcttggaatgtcttctattaggcatttctcctcacgttcccctgcgtggaaataaaaggcagttgaaaatggaaaaccaaaac

SEQ ID NO: 1471 - DNA, 2052 bp, Homo sapiens
gcgcgtgcgcctgcttgctggagagcgagcgtcttttgccacgaacacctgcggcgtgccgaagttcctcttctctgccccggttccgggcggtccgctgggaggtggcgcccggagggacacccgtgcctggggtcggggccagtgctcttctcggagctccagaagttctgctgagaagcgcggcggcagcaagacgacttctccggagtcgccgagctggagttagaggtggagctccgtggggccgggcccccggctgcggggcagcggctcctgcaggcggaggccccggcggagaatgagccggagccggaggtggtggtggtctcctggcagagcggtgggaccgggagcaagctgcggtggttcaccaccttgatgctgtgtgcctccttcctggggctgggattgagtgttgctatagtgggacccacgtttcaagatttggcaacaaacgtgaaccgaaatatcagtagtctgtctttcatttttgtgggtcgtgccttgggatatttgagtggctctgtgattggtggatttcttgtcgatgtcatgaattattttttacttttgggaatctcaatgtcggctaccaccgttggtctttatcttgttcctttttgcaagacagcaatattactcactgtcatgatgtctatcttcggtgtttcaattggcattctggatacaggtggtaacgtccttatcttggctatttggggggacaaaggagccccacatatgcaggccttacacttctcttttgccttgggtgcctttttggctccactgctagctaaactggctttgggtccgacagcgtctgctgaaaaccacacagagtctgacttccatcctgcactcaaccaatcatctgatgctgactcagaagctctgtttggagtacctaatgataagaatttactgtgggcttatgctgttatcggtacttacatgttcttagtttctgtcatttttttttgtctgtttttaaagaatagctcaaagcaagaaaaagcaagagcatctgctgagacatttcgaagagcaaaatatcacaacgcccttctttgtctcctttttctgttcttctttttttatgttggagctgaggtaacatatgactcttatgttttctcatttgcaaccacccatgctggcatgaaagaaagtgaagctgctgggttgaactccatcttctgggggacatttgcagcctgcaggggcctggcaatcttttttgctacctgtttacagcctggaaccatgattgtgttgagcaacattggcagcctgacttcatctttatttctggtgctttttgacaagaacccaatttgtctctggatagcaacttcagtgtatggggcttcaatggcaaccacatttccgagtggtgtttcttggattgagcagtacacgaccatccatgggaaatctgcagcattttttgtaattggtgcttccctgggagaaatggctattcctgcagtcattggaattcttcaaggaaaataccctgatttgcctgtagttctgtatacctctttgggagcatcaatagctactggtattttatttcctgtgctatataaattagccacttcacctcttgatcgccagcgaaaagaagacagaaagagtgaggaccagaaagctctgctctctagctccgggctaaatgaatatgaggaagagaatgaagaggaggatgcagaaaaatggaatgaaatggattttgaaatgattgaaacgaatgatacaatgaggcattctataatagagacatctagaagtagtctgacggagcccacagctgaagtctataatcaatacccatcaaatgcactggtgtttgagtcttctccttttaatactggcagtgcccatgtgaagcacttgccagaaaccaggacaaaagggactaacgtttagagaagatggattactcactgacatccttgaataactgccacttctaaggacgccattcagagcagagcattagcagaatttcaccatgctttggggattaaaatttttaggtcc

SEQ ID NO: 1472 - DNA, 1818 bp, Homo sapiens
atatagcgctgggcgactccgcggagctgcacggccatggacgtgggcgccgacgagttcgaggagagcctccctctgctgcaggagctcgtccaggaggccgacttcgtgggtctggacatagagttcacgggccttcgttctaacctgtctgggccccagcagatcagtctttttgatttgccatcggagtggtatctaaagacccgtcagagcgttcagcaatttacagtctgtcagattggattgtctgtgttttccgctattgaaggagaggcaaacaagtatatagcccattcgtgtaacttctatctcttccctacaacgtttgggattttggactcagaattctccttccaggcttccagtgttcagtttttgaatcagtatggcttcaactataacaagtttctcaaaaacggaatcccatatatgaatgaagaacaggagaagaaaattagacacgatatcctgactgggaactggagagttcgcagctctccggataaagaccaaatcaaggtggtgattgacgaagtgacgcggtggctggagctggccaaggaaggcgactggatgactcttcctgggatcactggcttccaggcctttgaggtccaactggtgctgaggcaggccctccccaacatctggacggtgctgaaagatgagggggtggtagtgaagaaagtgagtaaacaacatcgttggtatcttcagaacacctcttgtgaccgagagagctgttggaaggaaaatattcttctctcagcaaggggtttttctgtctttttccaaatgctggtgaaagcccagaagcccttagtgggacataatatgatgatggacctgctgcacctccatgagaagttcttcagacccctcccagaaagctacgatcaatttaagcagaatatccacagcctatttcctgttctcattgataccaagagtgtaacaaaggatatctggaaggagatgaatttcccgagggtgtcgaatctttcggaagtctatgaagtcctgaacagtgacttgaatcccaccaagaattctggaccagagattgttcacgcgagcaggtgtgagaaatatgttgagacaaagtgcccccacgaagccgcgtatgatgccttcctctgtgggtcagttcttttgaaagtggcacacttgcttctacagaagatataccacatcgaccccgtgcccgagtcatcctttcctcagtaccttgacgtgctggctccttacgtgaaccaagtgaacctcatccgagcgggggtcccaaagatcaatttttctggtccagattatcccagtatccgacctcccatcctcatcctcagcgtcaaaaggtggcctggggtcagcgagcagcaagtctaccataagtttcagaatctctgcaagtttgatgtcaggcgactcacaagaagccagttcttactcctgaccaataagtttaaggatgcgcggaacatcctgaaggagtaccgggaccacccgaccctgtgcatctccctgtaccgctactggaggcactccccaaacgtcaactgcctgctccaagtctgtggcatagtgactgcctgggcccttctcgcgttcatccttggaagatctggtacctgagtgcagcgaggcctcctgcggccaccctcgggtccccatgctctctgggaggtgtgctgggtgtgttcgtgtaaatcagattctgtttgcagatggatctgtttggtcttttctagaaattctgttatgtcctgaacgtgaaattctgtcaacactctcaatgataaatcagtccttagatatcgt

SEQ ID NO: 1473 - DNA, 1705 bp, Homo sapiens
aagtttgagtttgtgtgcttactagcaaccactttcagcgtttctgcaaagctagagaagggttcccagtgccgattccgacactgtgaagaggcccttggcagtgacactgtgtgctcattatggagagagaggaaatgtttagatccactttgcagatttagacacatggaaatgcagcaaaactgcagcatttcatgcttctgggaaactcagcctcttggttgtgtgaagatcagctgtatcttttatcacagcaaacctcgaaatatcaatggattatttttgccaccaagtagcaatatcacactacagaaagaaattcaggaaggaattccactccagtcccagagtcaagaacctctgaaacctcaggaaaatatatcacgacccatccaccatcctttagttttaaaaactaattttgaggaagaagaggaagtagatgaacaaaatgatgcttctagtttatggacaaagacccctgaagaaattgaagaaaaaagagcaataaaggagatgtgttataaatctggggaatactacagatttcatactcctccagatattttgtcatcaaaaagcatgacacctacagcagaaaaacagttagaaaagcctttggaaaatggcagtgaattgcaagaaggagatagtcttacagttccgacaaaacttagccaatatgaaaggcaaggtgaaataaaaacatcattgcatgggaaaccaaagactgacattgctgcttttgaaaatggaggaggtgactgttatgttccacagagggtcatatttcttggagtcgatgaaagtgaagctttaactgaagagaaagaaatcaccatatcaaaatgttcaaatactaaagataacaaggacagtcctcatccaaagcattccctaactacccgactagtacctacaacgcatgtattaaatgctactgagaatatcagtatgaagtgcagagaggacccctcttcaatgaatgatgtccagccagtgaagaagcctcattttaaaggtgtgaagaaaagaaaatggatttatgatgaaccacagaactttcctaactctggaatgcagagagcagtacaggccccaagaccccaaaataaaatgagttatcaccgcaataataaaaatcgaaatgcggagaatgcatcctatatccacgttcaaagagatgctgtcaggactgtcgcgttgaatgcaccttcccgcagcaggcccacgcatgggtcctacaataaagtccatgctaacagggaacccaaacccaacctcagtccagacaaatatacgtcaacatcatataatgattcagcctggcgaaaacgaattcctttttcaaaaacatattcaaaaagtgaaaagatatatccagagccaagaagaaatgggagcaagtaaacctggaggttgagagagagaaaaatgagaaaaaattgccagacatcatctgatttacaatcaaaaatgaaaattcaaagaatgagatactcaagtactccatgttatgtagtggatagccaaagatgataaaaatgcaaattctgaaaataagatgcaggaagtacattgtgctctttcaaaactgataaaaatgcaaattaccaacagctgccagtgtatttatgtaggtctggaattcattccgtgcattactccaaacattttaataaaatttaaaagtttgacaatt

SEQ ID NO: 1474 - DNA, 1884 bp, Homo sapiens
cgagaggctctgaggctgccagagtggttgtgtctgttcctccggtaaggggtgattcgccgaggggcgcggaccagacagacctcgggtcaggcccgggaaccccgagaggagagcccagcccctggtggaggcggcttggcggagattcggagccgtcagcagctcagccagacgtccaggatcccaccccttgcaaaagaccaggccgtggaagccatgttcccaccagccagggggaaggagctgctctcgtttgaggatgtggcgatgtacttcaccagagaggagtggggccacctcaactggggtcagaaggacctctaccgagatgtgatgttggagaactacaggaacatggtcttgctgggtaggacacggcttgaagattgggctttgtctgtgttctgagtgtctgtgcaagcccttagtcccttatctgcaattccagaatcagaaaaagcggtgaaaaccgaaaggtttttttataactcgtgtggctacaagccctgaccagacatcaccacagtgaaacctgacttcatcctataggaaaccatttattgtctttatttttccaacttggtgtgcatatctgtatacccaacttcagaaataacagtgtaggccaggtgcggtggctcacacctgtaatcccagcactttgggattccgaggcgggtggatcacgtgaggtcagtagtttgagaccagcctggccaatatggtgaaacccagctctacttaagatgcgaaaattagcctggtgtggtggtgcacgcttgtagtcccagttacttgggaggctgaggcaggagaatcgcttgaacccgggaggcagaggttgcattgagccgagatcatgccgctgcattccagcctgggtgacagagcgagactccgtctcaaaacaaaacaaaacaacaacaaaaataacagtgtatttgagggcaccactccaaaccctactggggatgatacgttatgtaaaatatttacaccaggtcacctttctgaaatgggaaaaattctgactcctgaaacacatctggtcctaagggtttcacataagggactggggacagtgaatagtcgtgttgtgttagggctcagaccgagacacttcatgcattcttcactctcacctcgtgttcctcatctgtaagacctccaggagttgagaattatggtagatttacattccaaaggctcacttcttatgctcttgaaagtctttttctttcttttctctggaaatgggtaacttcttggtgtgtaacattagtgggtgctcaggaaatgattttcaaccaacttcatttctgaaccttcactgcttccattcttttcaggagcctaccctgtcctagtccactgtagtctcccactgtgggagttgccttgctaaatagttttctttccggggtcacatgtttaacccttgcactgacactcttagcacagagtcttgaccacctctgtgggactgtccacccacctctggatttttataattttaattttccctttaaaagcattacaggagcatacataagtacatggaaggcatagaaaaggaggagaagaggaaagtgttcatgggtaacactgttaatattttggaaggtttcctgccagtctttttttcctatgcctttacaaaagtagctgagcatattctatgtgcaatcctgtaatctgttttaaatgtaacattattgtatcagcatttccccacataatcagtaaacgagcataatataattccattgtgtggtccataaaaatatttcattgttttcccatgtggggacattgagcttgcctttgtttgttcgttggtttgcttgtgtatttataatgtttgaatagatgtttgagtat

SEQ ID NO: 1475 - DNA, 2125 bp, Homo sapiens
actatgaactgcacaaagatggcgctccccataagtgaggctgggcagagccccgctgtgcacccccatctccacctccgcatgtcatttctgaagcctcgccactcagtagtaggaggaataggccagtaccagcaagagagcccctttctgctgctgcatccctccagtgtcctctattgacagttgaacctggtggcagttgcagatgagaaatgcttacagctcattttttgctgagcaagaaatgagagatgagtttagagctgagaggcattcaactgctaccagatgggatgcagggaacccatgactcccaggaaattggccaagtccctgagaggacagttggtggcattctcggagacaggacccttgaggaaaaactctagagcaaagcagaggaacggtgtcagcattttgaaaatgctgagctgaatgacactgagaaatgcccagtgcaatgataaacgggcagatagtttctcaggggcctggggcctggatgggggctgggctggagtgagagagaggcaggtctccagctgtgctatgcacacctcaggttgaagatgctacataggtaaaagcgctgatggttcagcatgattaacaaggtattggggactacatttagactgaggctggtattttgcattgcaatggacaaaaatatcgctgtcacagctgacttggggctcattcattgcacatgcagtgaaggcagctgtgtggcggtggggccacagggcaggtagcatggatggagagaggattctgaataactttgactctgcaggtttttcataaggaagggctgaacaaaagcagccaagggggccagagaaagagaaagtagacagtgtgagattagaggagatgggcaagttctagtgaagatgcaatggcccatagtgtcacagaagacaaagactgcaaagaggcccttagcgtcagtgacccagaggcctgtgctgaggcctgcgctgacttgtggctggtaaagtttcagtggaggtggaggcagagattactgtgggccaaggaatgggggcaggagaggaaacagctggtgacaatctgtggtcacatttgcctgtgaatgagaggagaaaggatgagagtaactgtggagaggtgtgaggctgaggcagggttttacttttactgggagaaggagcatattgatggtgatgagattgcgaagggtggcagatggaggttacatactgtcatgagtgtgagcgagggagagaagactgcaaggggcttgcccagagccggcagtcagggatggcttagcacgtttgctcaccagctgggaggcctataaatgtcatttggatgccttccagggattagccaggggacacagatggatttagtaaggatgataacagatagttctctttttaagcaaggtcacatggaagtgcatggtgtgtgtgtggtgtgcatgtgtgtgtgtgctgtgcacgtgtgtgtgtgtgttaatagctaccagagcccaggtttcaaactgaaatcacttgcaaaaggcatcagtcaccagcttctacttgcacatgaaatgcatagtccccactcccagcttttcagagtgccacacatctggaagcagcctcctgatgctcccagctccttttgggttgtggatttgtttattttgcatttatagttttgccaagtttttggcaaattttttgttgatttacatttaactttatcagtctgttcagggtttccttccctagcttgttctcagatgtggccaagcatcactcttcaccaggagaagacactaaagtaaaagaaccatcaacacaagtgacatgtcatagcaggagctgacacagcctcaccagcccatgctcggccagactagggagcatcggccgcttgttccatcctgtgcttgtctgcctgcctctctgtcatgagacgcattcgaagagtcctgggcccaaaagcaactcacagtccaggaagacgtccaggccttgggtgacgctcagtctcataaagacggagaatggtggcctcctccacaggaatggtgctcatcattagccatgacaagcttcaatgttcaaaatgcctttgcaaaagaaatactggacaaatt

SEQ ID NO: 1476 - DNA, 2527 bp, Homo sapiens
gctcccgcgccgcgcccggccgccttcatgtgaagcgccggccctccgccccttccctccccttccttccctccctccctccctgtcccctcctcctcctcttcctcctccggcgcccgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccggtgagtgctccctggtccgcccgcgtcccgggggagatccgtgcggacgggacgccggagcagagccactcgggccgcgtccctgtgggtcccgcgaccgttgtaagctacaaaccggaaagtgagccggcggatagcttcctcctctaagcgattagaaatggaagtgctgtgaccgctgattatttggtgaccgtgttgactttacagttaggacttgagctactcacgcatcgtgttagcatcagagatcagaaatccagaacagataatcatgccatatttgttctgtttttatttgaaagaattctcacatctcgaacaggatattttgttttgctttagttttggcatctgtacaactggcacggaatcattttcctttcaaatgtgttttagacgagtttaatttacctaactacactaaatgggctttaattttgtttctgtttggggagctattaaaactagctaactttgtacttatagtttacttcttgaacatggaattgtcagatggcactggaattctcagggaatagaacttttaaaagcattcagactgcataaatctgtttaattacatgctttggcaactggtacaaaaatgtttgataaaatacagaggagatgaatcatgttgcacgtaaatctgactacagcaaaatgtacttgtttcttattccactttgctagttgtaaaatcaggaatgtagcctttaaacttttgttggtgtttgctttcgagcatatttttgctttctcaatttagattttcttaatattttgttcaaatattagagttagggtagtttgttttgttttgttgtggaaagtgattcatatgccagtttgcctcctctaaagacagacaagatattggctaccatgatattaatgccttgttttgatgaatcgactggaaccttattgaacactctttattacagaactcgtaccctttattggaagtgtcatagacccttctgaaatatgatgacatatatggaataacttctgtttaaagatgcacagaggcaaatacactgcttgaagtccttggaccccagatttacaatctagctgtaaatcaatctcccagttttcagataagccttagatattagatacttcactcaaagtatggatcaagaaattgtattaatgtgctattggttcatttaattgttaaatactaaaatagtctataatgtaaaagcttgaaattttgaatgtacatgttcaagaccttttgggtgagatctgataaaactagtatctttcaggtttccacttagaaatgtgtttgagaagttgttttgtaacttttacttaagtcctttaaagcctccaatctgactctttatttaaatacagtcctaagtacagtattggcttactttaggtttcttaaaataggcttagcattacaaatacatttataatgttttattgtttaaattcaagtgcatattcaaaagaattttaaaaattaagaacaagagaagaatcacactatagtttaatgacatataggatttaagattgtataagagatcctatcaattagacagtaaataagtgcatcttttttgagacaaatgcagtaggcaaatgttgacattcaccagggcacagtcaatccctgacaatttcagaagttttgttgccaatactgatttatgtgggcagattctgtagtctgctgctccttctctcatggattaccttcttgttcctacagttgcacctattctacacaagagtggcattcatttgtatccaggaaagctagaacaagtagtcttttaatcttggctatattatcacagattcgacttaggatatgttgcatctgtatttttgttttaaataacaactcaagttccttctcagagttgggcatctatgtattttgtttattatgtacaaatgacctgaagacagcattttacccacttgataagttctcaaatagtctttgtttcttagtgccgtccatatcctgaataaagataccgtgttttctttcctt

SEQ ID NO: 1477 - DNA, 2635 bp, Homo sapiens
atatatatacacacacagagagagagagcgcaagcaagcaccacattttattggcttgcttatttggttttacatttacattataatccactggaagaaaggacatcaggatgttagctgtttatttctgaatggtagaaattaaaatattttcatttttttctctttatgttgatcagatgttctacaatgagtatatttaacttttatgttcagaataaaatcagttatttaagaagagagaggaggagtggtttctgggaaacaaaaaacaaggttgttctcctgcaatttgttcattctctgttcccatcagagctctcgtgttgaaagggattaaggagatgttggtgtcttttttttccttcctctggattgtgaggaactgaagtctttaaatgaatcagcagttcattccttgaagttagtcttgaagacatcagtattttcccatttcatggtctgtcattttgtattagaggagagtaagacactgtataaatggtattttgcaacaaagtataaacctttgggttgtatgttttctgttgctttatagtttaaaatggaatggacaggaacgtttttagaaatatgcaaatacatgctctcagtggataggcttacactttggcaaaagtaacctaaatccaagcggtcatgaaccgttgagaattgtctcttctctggagacactgagctggaacctggtctcgctgtgcagtgggtggcaggcagcctctgccttttgattaatcatgtgcagctgtctccacacactgcagagacgctttctgcattttgtctctattgcgctctcgaaaatttggcaaaataatgcatttcatttgcaggtggaagtgagttggtcatctacatttgtggataaagttattgtcatgagactcatttcttcaaagcatttcacagatacgatgaatgacagagtgcattccttcctcaacgacattggctttgtttgcctcctcagttaaatcaaggtgtgaaacaaaccaggagaaaaagaaagattatttaaaatgaggccatcagtatcaggaatgagaagaacagctgcttgcaaactccagcactgtgtggcgttgtttacaggacagaaatcttgcttctgtaagttgtggaaagttaacgtgatgttaaccttgtcggaccttgtttttgttctgcacccctcctttgcttaggagactacctaggtggagaagcgtactgggccggcggcctgcacctctacaccccattacctttccggccaggccagggtggctttggagaacttttccgaacacacttctttctcaacgcaagaaacctctgcaacctcaactatggtaaaacttgcgctattcaagaaaccattgtagtacagttgttttcatgtttaaaagcacagtacacaaagaggtgtctgtctttttttttttttttgagatggagtctcgctctattgccaggctggagtgcagtggcgcaatctcggctcactgcaacctccaccttctgggttcaagtgactctcttgcctcagcctcccgagtagctgggactacaggcgcgtgccatcacgcccggctaattttttgtatttttagtagagacgagatttcaccatgttggccaggatggtctcgatctcttgacctcgtgatccacaccccccttggattcccaaagtgctgggattacaggtgtgagccaccgtgccaggccatgtctgtctttttagattacatagtcattaaagttagagactgtgccttacttgaaaaaaattcttacaacagctaacataatgcccagcattaagtggttggttgagcgaatgaagcatacaagaaaaataatcatctaatgcccttacgaagaaaaatctgtttgtctatttaataaacaagtcatgatggccacagagctgagtaggattgggtgccttcctcagggagttcaggtccagaagagactcccagcagatgcctgggtgctaggggtgcctggaaagcttcctagaaggcatggaagtctccaagctgagactcagagtggggcttcccaggtggtcaggggatggggaaaagtcattctggatgtgagtaagtgtggctccaagtcctctcttgacctgggtcctaatctcacttcatgcatcctccctaatctctaggcctggctttaaaaacaactgcagggcccagccagggggagccagggcttgtctgggagagctgggagagcttggaaggacgggcacgcactgttgctcacaggtctttctcttttcaggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactc

SEQ ID NO: 1478 - DNA, 1830 bp, Homo sapiens
agccaggcttcggaatcactgagagaggagggggcagcgccaacgcccagcacctgccgccggtgggggactgacttcggcggaacggaaaactggagttgtttccctgggccagtgcaccgaggctgaagtctataagcctggagagaccatcagcagtaatctgcaaatggctacactggtgtgggttaagaacttagatgattccgatgttcactgtaacattggaagactctggaactctgtggaaaagtcttcacagctcctctgaatccgaaatgaccaccctgcccccactgcccatgacacgcccgaagcttacagccttagccagacagaagctgccttgctcctccagaaaaattccaaggtctcaattgatcaaagaaaaagatgacatagatcattatctagaggtaaatttcaaaggattatcaaaagaggaagttgctgcttataggaactcctacaagaagaatatctgtgtggacatgctgcgagatggttatcataagtccttcaccgagctcttcgctctgatggagcggtgggatgccctgagggaggctgcgagagtcaggtccctcttctggctgcagaagcccctggaggagcagcctgataaactggattacctgtaccattacctgaccagggctgaggacgctgagaggaaagaatccttcgaagatgtacataataacttgtatgctctggcctgttacttcaataattctgaagacaagtgggtaaggaaccacttctatgaacgatgttttaagattgctcagctgatcaaaattgactgtgggaagaaagaagccgaggcacacatgcatatgggtcttctctacgaggaagatggtcagcttctggaagctgctgagcattatgaagcattccatcaattgacacaggggcggatatggaaggatgagacaggccgctctctcaacttgttggcctgtgagagtctcctgaggacttacagatttctctcagacaaaatgctagaaaataaagaatacaaacaggccatcaaaattctaataaaagcttctgaaatagccaaagaaggaagtgacaaaaagatggaagcggaagcctcttactacttgggcttagcacacttagctgctgaggaatatgaaacagcattaacagtccttgacacttactgtaaaatctccacagacctggatgatgatctcagtctggggagaggctatgaagccatagccaaggtcctgcagagccaaggagagatgacagaagcaattaaatacttgaaaaaatttgtgaaaattgcaagaaacaattttcaaagcctagatttggtgagagcaagtacaatgcttggggacatctacaatgaaaaaggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatatagagtctgcagatctcaccagcctcaactacctgctgtcatggaaggagagcagaggtaacattgaacctgatccagttactgaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactctttt

SEQ ID NO: 1479 - DNA, 2820 bp, Homo sapiens
cggtgacggccctgctcgggaggccctccagtctctgagccagcggcttcgggtgcaggagcaggagatggaactggtaaaggcagccctggcagaagcccttcgcctgctgcggctgcaggtgcccccttcctccctgcagggctctggcacaccagctcctccgggggacagcagtcttgcagcccccccaggactgccacccacgtgcaccccttccttggtgagccgaggcacccagacggagacagaggtggagctcaagtcatcccctggaccccctggcctgagcaatggacccccagcccctcagggggccagcgaagagcctagcgggacccaatctgaaggagggggcagcagcagcagtggtgctggctcccctggccccccggggatcctcaggcccttgcagcccccacagcgtgctgacacgccgcgaagaaattcttcctcctcctcatccccctcagagcggcctcggcagaagctctccaggaaggcaatctcctccgccaacctgttagtgcggtccgggagcacagagagccgtgggggaaaagaccccctctccagccctgggggccctggatctcggaggagcaattacaatttggaaggcatctcagtgaagatgttccttcgagggcgccccattaccatgtacatcccgtctggcatccgcagccttgaggagctgccgagtggcccaccgccagagaccctcagccttgactgggtttatgggtacaggggtcgtgactcccgctctaatctgtttgtgttgcgctctggggaggtggtctactttatcgcctgtgtggtggtgctgtaccggcctggaggaggcccagggggtcctggaggtggcggccagagacattaccgggggcacacagactgcgttcgatgccttgctgttcaccctgatggcgttcgggtagcctcgggacagacagctggagtggataaggatggaaagcccctgcagcctgtggttcacatctgggactcagagacgctgttgaaactgcaggagattggactgggggccttcgagcggggtgttggggccctggccttttcagctgcggatcagggtgcctttctttgtgtggtggataattccaatgagcacatgctgtcggtgtgggactgcagccggggaatgaagctggctgagatcaagagtacaaatgactcagtcctggccgttggcttcaaccctcgtgacagcagctgcatcgtcaccagtgggaaatctcacgtccacttctggaattggagtggtggagtaggggttcctgggaatgggacccttacccggaaacagggtgtctttgggaaatacaagaaacccaagtttatcccttgctttgtgttccttccggatggagacattctcactggagactcagaggggaacattctcacctgggggcggagcccttcagattccaagaccccaggcaggggtggcgccaaagagacctatgggattgtggcccaggctcacgctcatgaaggttctatcttcgccttgtgtctccggagggacgggacagtgctgagtggtggcgggcgggaccgccggctggtacagtgggggcccgggttggtggccctccaggaggctgagattcccgagcacttcggggccgtgcgagccattgctgaagggcttggctctgagctgctggtgggaaccacgaagaatgcattgctgaggggagacctggcccagggcttctcccctgtaatccagggccacactgatgagctctgggggctctgcacacacccctcccagaaccgcttcctcacctgcggccacgaccggcagctctgcctgtgggatggggagagccatgcactggcctggagcatcgacctcaaggagactggtctctgtgctgacttccacccgagtggggcagttgtggccgtaggactgaacacggggaggtggttggttttggacacagagaccagagagatcgtgtctgatgtcattgatggcaatgagcagctctcagtggtccggtacagcccagatgggttgtacctggccattggttcccatgacaacgtgatctacatctatagtgtttccagtgatggtgccaaatccagccgctttggccgctgtatgggtcactccagcttcatcactcatcttgactggtccaaggatgggaatttcatcatgtccaattctggggactatgagattctttactgggacgtggctggaggctgcaagcagctgaagaatcgctatgagagccgagaccgggaatgggctacctacacctgtgtgctgggctttcacgtctacgtacccgtgcgctcgtgccaaggcgccgagccgcatgtacgggggccacggcagccacgtgaccagcgtccgattcacgcacgacgactcgcacctcgtctcgctgggcggcaaggacgccagcatcttccagtggcgagtgctgggcgctgggggcgcggggccggcgcccgccacgccctctcgaaccccctccctgtcccccgcctcctccctcgacgtttgatcgctgcctggcgggaccgactggcccggcggcgtggccccgccccgccctgcccttccctggcccaatcccccacgactaggggccgactctttcctggactgacttcgagacattcccgatcgcgcattttcctggagggcgcgaacggcgcccctgcacacactgtttagacccgctggctgagccgggcagccccagcctaggccttgactcccgctgcctgctgaggggcaataaaccagaaccaaagtcg

SEQ ID NO: 1480 - DNA, 2727 bp, Homo sapiens
gagccctacattctgctgctgctgcagagtgatgatttttaacagaccagaacttacacatctaaatgagtgttgttgttcagtgaagtcaccttaggacaatgatttaaataacaccgcgatttctcaagaagtttggaacttctcttatggttgagttcaaagccattttatgttatatgtggcccaaacaagttttattagtacaattaaatctttattgaggacttttgatggaccacatagtgaacttggactgggaatcaaaagaatggtaaggcagggtgtctgccttcactgtgcctgcagtctggctgagatgcacatgtgagccacactagcacaagccagcatgcactggcctgtcacaagagagtgcacaagggtctggatccctgaccctgatgaggtatggcgctcagctgagttaaccaaggactacaaagaaggagacaagagcctacagctcagactggaggatgaaacgattctggaatacccaattgatgtacaacgcaaccagctgcccttcttacggaatccagatatcttggtgggagaaaatgacctgactgcccttagctatcttcatgagcctgcagttttgcataatttgaaggtccgtttcctggagtccaaccatatctacacttactgtggtatcgtacttgttgccattaatccttatgaacagttgccaatctatggacaagatgtcatctatgcctacagtggccaaaacatgggagacatggacccccacatctttgctgtggcagaagaagcctacaagcagatggccagagatgagaagaatcagtccatcatagtcagtggggagtctggagccgggaagacggtatcagccaagtatgccatgcgctatttcgccaccgttggtggctcggccagtgaaaccaacatcgaagagaaggtgctggcatccagtcccatcatggaggccattggaaatgccaagaccacccgcaatgacaacagcagccgttttggcaagtacatccagattggctttgacaaaaggtaccacatcatcggggccaacatgaggacttacctcttggagaagtccagagtggtcttccaggcagatgatgagaggaattaccacatcttttaccagctctgtgctgctgccggtcttccagaatttaaagagcttgcactaacaagtgcagaggactttttctatacatcacagggaggagacacttccatcgagggtgtggacgatgctgaggactttgagaagactcgacaagccttcacactcctcggagtgaaagagtcccatcagatgagcatttttaagataattgcttctatcttgcaccttggaagtgtggcgattcaggctgagcgtgatggtgattcctgtagtatatcaccccaggatgtatacctaagcaacttctgccgactgctaggggtggagcacagtcagatggagcactggctgtgtcatcgcaagctggtcaccacctcggagacctacgtcaagaccatgtccctgcagcaggtgatcaatgcgcgcaacgccctggcgaagcacatctatgcccagttgttcggctggattgtggagcacatcaacaaggccctgcacacctccctcaagcagcactccttcatcggggtcctggacatctatgggtttgagacatttgaggtaaacagctttgagcagttctgtatcaactatgcaaatgaaaagctccagcagcagttcaactcgcatgttttcaaactggagcaagaagaatacatgaaggaacagatcccttggaccctgattgatttttatgataaccaaccttgtatcgacctcattgaagccaagctgggtatcttggacctgttggatgaagaatgtaaggtccccaaaggaactgaccagaactgggctcagaagctctatgaccggcactccagcagccagcacttccagaagccccgcatgtccaacacggccttcatcatcgtccactttgcagacaaggtggagtacctctctgatggttttctggagaaaaacagagacacggtgtatgaagagcagatcaatatcctgaaggccggcaagttcccactagtggctgacttgtttcatgatgacaaggaccctgttcctgccaccacccctgggaaggggtcatcttcgaagatcagcgtccgttctgccagaccccccatgaaagtctccaacaaggagcacaagaaaaccgttggccaccagttccgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcccgttttgtttccatttaatccatcttctctaaccatggactcaatccacatcccagcgtgtctcaatctggaattcctcaatgaagtctggagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatgg

SEQ ID NO: 1481 - DNA, 1573 bp, Homo sapiens
ttattttttctattaaaaacaaaaagtcacacattcaacaaggtgtgccgtgtgggtctctcagccttgcccctcctgctcctctacgctgcctcaggcccccagccctgtggcttccacctcagctctagaagcctgctccctctgcagggggtggtggtgtcttcccagccctgtcccatgtgtccctccacccattttcctgcattctgtctgtccttttcctccttggagcctgggccagctcaaggtgggcacgggggcccagacagtactctccagttctggggctccccgagtgaggagggaacgggaagtcggtgccttggtttcagctgatttggggggaaatgccttaatttcactctcctcccttctccagcctcaggggaggatctggaggatccactactgtctttaagatgcagagtggaggggaggtgggcacccaccctgcgattctccaccctttccccttctttcgtcctcaccatctctgcagacccctctcctcctccttcctcttggtctcagcactgatgggaggctggtgcccaagctgtggcctgcagtctgtgaggagggctgtcttgcctcacactcctcacagcctacttccccttccccggggctgagagggtgaaagtgtgtggggaaggagaggactggtttcctgggttctcaggggccaggaggagtaacagaaccaggtctgctccccaccttactcggatggcctccctgcccctctgctggcacagcctgggcaaggggagaaggtggtccctgcagaggggctccaggctggtgagagcccccctgctgtcaggaccagattttcccagccatccagcatgctgcggggagaaggggcagaggctcacctccctcctggggccttttgttttggatcctggggatggtgagaatggaggttctagaaggggtaaggccagaacccagggatccaggagtcggctctcagctggagcttccataccttctgggctccctttgctgaccaccagcccaagggagctaagaccaggagggggctgggcgctgtcccttctctttcccaggagccctgccaggggctgtgggcctacaaggcttccaggggatgccatccagcctgtaggaaaccaaagatgggaagtggctcctagggggctgactcttccttcctcctcctccccagtaccacatatactttctctccttctatctccagggccccaccaatctgtttacatatttattatcctatgggggcctgagcaggattgagggagccaggggaggggcaggagtcccagcaccatcggttcatagtgtgcttgtgtgtttgttttagatcctcctgggggatggggatggggccaggctcagtgtactaggcctctctgtgctgagccccaggctcccggccccttacccactctctccctgtggctggtctggttctcatgtaaacccactccttgctttgtctccctggatatggatttcagttaagtattttgtaacccgttacactgtgtgtccttgtgtaaataaacttgtttctggc

SEQ ID NO: 1482 - DNA, 1627 bp, Homo sapiens
aaaaagcaactgagcaaggaggttggataggttgtgtggaggacagatgataactttgttttggaacacttcctccttcacaggctcatgctctctctctcacctgccgccatgtaagatgtgcctgcttctccttctgccatgattgtaagtttcctgaggcctccccagccgtgcaaacctgtgccacttgaagaatggatgatgatgattttggtggttttgaggctgcggagacttttgatggtggaagtggtgaaacccaaacaacatctcctgctattccttgggctgcctttcctgcagggaaacatgcaattttcattgtgagctgccttccagagtttatggtagaacttcactgacgttgctgatgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagagagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaaccc

SEQ ID NO: 1483 - DNA, 2556 bp, Homo sapiens
acgaccaacagctgagaacgcggcgagtatggaagctgcgtcttaggagcctgggaaagcacttcgacgagaatagtttggtttcgtacacaggaaaatgtctaatcgacaggagaagtatgaagctcagaatatagtcaattcaacagaagagagtgatgatgcttttgatactgtcactattccagttccctcagaagagcctcaagagtcagatcaaactgaagagcatgaatctggaatagaacaattcagtgagagccatgcaatacatgttgaggagcagagtgaccaaagcttttcaagcctggaaccagacaatgaacaactcatggaagaggttatatcaccaagacaagtttcatatactccgcaacatcatgaaaagcaatatgcaatgcagaggccaaatgatgatagtttggcatttctggataaaataaagtctgtaaaggaatctttgcaagaatcagtggaagattctctagcaacagtaaaagttgtacttattccagtgggccaggaaattgtaataccttttaaggttgataccattcttaaatatcttaaggaccatttttcacacttattaggtatcccacattctgtactgcagataagatactcaggaaaaattcttaaaaataatgagactctagtacaacatggagttaagccacaggaaattgtacaagtggaaatcttttctacaaatccagatctgtatccagtcagaagaatagatggattaactgatgtctctcaaatcataactgtcactgtccaaactggacttgatcaataccagcaggtacctgttgagattgtcaaatctgactttcacaaaccatctcttggtggattcagacataaagtaacaggagtagagtatcacaatgctggaacacaaactgtacctaaaaggattcccgaaagactcagtatattttgtagggatacgcagacagtttttcagaaaaaaaatctccaacaaactacaaatacaacatccacacagatgactaacattggtgtatatgtatcaaatatgactgataaactggtaacaccaggaaagtatttttcagcagcagaataccatgctcaaagactaaaggcggtgacagtgatacagacttactacaggcaatggcatgctaaaatcttcgtagagaatttaagaagacagaaaagcttaagactggaatgggaaacacagcaagaactaaggaagataagagaaaaagaagaatggataaaattggactatcaccggaggcataatcctaaaacaaatgaagattttgaatttctttataatgcattagaattctggcggcaagaagaacttacacgtattaaccaatcttttactggagctgaaaggaaagctgctctgtgtgaacttctggaaaaagagactcagataattgcttccattgggagacatagatacattgcttatatggcaaatcaggaagcagcaatacaagcttttttggataagtgttcagctccaaaaatatggagaacccctaatggcaaaacaattgagatggatacgcagttcaccatcagagccagagagctgcaaaatatctataagtgcattatgctgaaaaatatctcccaagatgagaggctggatgtgctgttaactcttaaacacactgtaaaggaacatgaatgtaaactaactcaggaaattctagaattgattgacagagaggttgaccttatgatgagaggagtcaaacatcataaccttgaaggactcagaaaaagaattgcgacactcttttttcattatatcaaaacacctctgtttaatcctgaagttgcaaaataccttaaggtccctcaagacccattgaaattttataagaagatttacttttgccacagttgccagctttatttgccttctacagaattttctgtatcatccacctcacgccgcatataccggtgtcgtaactgcattaaccttcagaatgaggctcaaaaacgagaatcatttttgaagtacaaatgtttacttcaacagctctactatacagaagctgattatgaagatgattctaaaattgctttcttgatgcagctacaagacattcagtacctgacagagaacatctgggcgtcccagtcagtcctcagtgcttgcgacaatctcagtgatctggtcatggtcagatggaataaatccctggagtggtccccctggaactgcattcttcttaccaaagatgaagcagctgctcatctcaagctaacaagtattgaagagggatatgaacgctcatttattcacaagatcaaacacaaacatatcctggctaagaactatttttctcaggttccagtgctggcttcatttatacttgatgatggtgaaattgatgagatcagatggaagtatcactcagacacaacacctaagattatagaatcccagaggcctcctcattaggtgatccaggagtatttgtttgatgatcggcattttgttcactgctaatagggtaatacagaggtcacagagtatggaaatgg

SEQ ID NO: 1484 - DNA, 1943 bp, Homo sapiens
ttctgcccccacaccggatatttctgcttcagagaagaagtataagcttcctaagtttggaaggttacataataaaagaaatgtgtgcaaggcaggattgaaacaagagcattgccaagatgttcatttgcctacagaaactatgttgtcccaggaaacacttccactcaagattcatggttggaaatcaacagaggacctgatgacatttttggatgatgatccagagctgcctttactagcaacacctccttccattgtctctccaatcacttgcttgtcagaagcagaagaagtttgtaatctttcgggtgcagatgctgtgcctactctctcagaaaatagtccttctgggcagagagatgtgagtttggacaagagatcagatggtatctttacaaatactgtcacagaaaacctcttggaaacacctttagaaaagcaatcagctgcagaaggtcttaaaacattgacaattttaccagcatgttggtcaagtaaagaggagtttatcagccccgacttaagggtatcaaagtcagattctactttccataaccaggcctctgtagaaacactctgtctctctccctcattcaaaatatttgaccgagtgaaggagattgtaatcaacaaggcctaccagaaaccagcacaatccagcattcagatggatgataaaatcctcaagacaaccacacgggtttcaactgcttctgagggagcatcttccttttctcctttatccatgtcatctcctgatttagcctctccagagaagtcagctcatctcttatcaccaattctggccggaccttccttctggactctgtcccatcaacagttgtcttctacctcctttaaagatgaagataagacagccaagctgcatcactcctttgcttctaggggcccagtgtcttctgatgtagaggaaaatgatagcctcaatctactgggaattcttccaaataactctgattctgctaaaaagaatataagtcacatttctagtagtcactggggggagttttccacccaaaatgtagaccagttcatccctctgtcctgttctggttttcagtcaaccaaagacttcccccaggaacctgaagcaaagaattccattagtgttcttttaagggaggtaaaacgtgcgatcgctagattacatgaagatctgagcacagtgatccaagaacttaatgtcatcaataacatcttgatgagcatgagtctgaatagttcacaaataggccagtcttcccaggtcccccagtcttctgaggggagctcagatcagatctaatcatcacaatatctatttttgatagaactcgtgtggttccacttccccaagacttacgttagcattgtataaattcatattattatggcaaaaaaggggatggtttaatttttccttgtcaggtttattagcaagtatctttcaaactaatactttcatttgggtggtttattttttaaaagggaaagatgtcacctttgataatttcagatttagatattagttcatttgaaacagaagagaatttcattctttcatgctctgtacctcaaatgggttaagcattagtgaaaattgtggtaagacctcaaactgcaaatgactattcaagagcttttggataaggaggcaggaagaagctctttatctttcaactgtatggagcttgttaacaagcctctgaggtgacctaggaggattgagtttgggggtatacatttcacacattcttttgcaagttttaggttctgcaaccaagggccagaaatcttttctttcttccagatgctagtgttaggagttaaatggaaacaagaaggacatggggcaaatgtttttactgtcaatgtatattgcaaggtgaattcaaatgcatccttttattctacttcagaaaataaatttgatatttttc

SEQ ID NO: 1485 - DNA, 1822 bp, Homo sapiens
ctcaacgtccgcctgcaggttcatattgagatccattgaaggccctcccagactgacgaaggcgtgacctcaggcccaccgcatccaagaacacgaagcatgagggacagaagagggcccctcggcacctgcctggcacaagtgcagcaggccggaggaggtgactcggacaaactatcatgcagccttaagaaaagaatgccggagggcccttggcctgcagatgcaccctcctggatgaataagcctgtggttgatggaaattcacaaagtgaggcattatcactggaaatgagaaaggatccgagcggggctggcctctggcttcacagtggcggcccagtgcttccatatgtgagagaatcagtaagaagaaatccagcctcagcagccactccgagcacagccgtgggtttgttccctgctccaacagagtgttttgctcgggtgtcctgcagtggtgttgaagctctggggcagcgagactggctgggaggagggcccagggccactgacggccacagaggacagtgccccaaaggagagcctcgggtgtcacgactgccacgccatcaaaaactgccggaaatgggaagttttcaggatgacccaccaagtgcttttcccaagggtctgggctctgagttggaacccgcttgcctgcactccatcctgtctgcaacgctgcacatgtatcccgaagtgctcctgagtgaggagacaaaacgcattttccttgatcgtttaaagcccatgttttcaaagcaaacaatagaattcaagaaaatgcttaaaagcacctcagatggtctgcagataacactggggttactggctctgcaaccttttgaattagcaaatacattatgccatagttaaggtacaagcagaacaataccaatagattaattttaagagttgtcttagaatgatttcttccgcattaagtctggatgcaaactgtgcagcccttagttcctgctgtagttttgtacgacctggcagacttaaagtaaattgagtttaaattcaaagccagttgatgcggaaggaacttttttggcatgtgttaaattgtgctttaaaagacatataaagaattgggaaacatttcaggagacggtcatagcctgtataaataccagattagaacatacggatttaccatgaagttctgtcttcaacatccattctaaagggctactgtcccaaatcctgtgtgtccttttgacttgtctgatcacccaatggaagtggatacttgtaaagtctacaccactgtacttggcgttaaatcttgctgaattcgtggtaagctgttaccatgtctacattttgtagaatgattttggtctgcagcaaaattcgatttcacttctcatacccctttccttccacttgaaatgcaatttagacagaggccctgtggtgaaagttgcaatattaagtttacctttagaagatcccttctcaaactcagaaccctagcagtgttaccttaaacaaaaatgagctcgagaaaaaagtagctcagttacagagaagcaaatcgagttatttcccacataaaaagtttcccagattctaagaattgcagtatcctgtaccctaaaatttttcaaggtgactcctgttgtcgtctgttgataactttaataaaggtcatttaaggacataagtttttaaagactcccaaagtgaaacttaaacattttcgggattatcgattgcatatatcagtttatgctgtgtgctgaattactatgccatgtgctattttagtgtttggggaaaatgaaaaataaaatttgttctttagctt

SEQ ID NO: 1486 - DNA, 2384 bp, Homo sapiens
agaaggagctttcaattatactgtgatggctttgagcgactcttcagagctgacctgcagtacaactttcagttcctgcaccatctcttccctccagtgtggaactgaatacttgatttcagttttagcaagtaatgatgctggatctagcaaatcatcttcagcaatgaccctgaaaactgttgcttgtgcacccggaagagtgacgatccaagaagatccccctggccacctgtctgtggcttggtccaatgtagatctgggtgactactatgtggtctttgtgaagagtgatgatggcttggaagtacactgcaacacatctctcactcagtgcaacttcttatctgagtgtggcttcacttattttattagtgtttttgcctataacaaggcagggcaaagtcctttgggtgacatattcaattataccacagctccctgttgtcctagtgacattaaccccgtgctggtgtccagtgacagagttgagattgtctggtctcctgtccgtggtgccgaactgtatgaaaccaaggctgtagatgggtacaacatggttgagtgcaatgacactactcctgcgtgcaccctttcggctctagagtgtgacaccaagtacaacatcacagtgtattcattcaatgaagtccgaggcagcaatatgtcatgtactccccagttcataaccacagctccttgcagtcctgaaataaaaaatgtttcaagggatgcattctccatgattaatgtgcactggcgatccactaatgatgatgctacttacacggtgactgcccaaggggagaaaggactgtatcagtgcagcagcacaggagagtcctgcaccatgcggggcttgccctgtggctcagtgttctctgtcactgctgtggccgaaacacaggcaggacggagcctgcccagctacagtgtgcccctggaaacagtgccatgctgtccaaccggtctgacagtaactcaaatcacccagtcagtaatcaacgtgagctggactattgggagagtggctcaaacccatgttgcagttctggagtcacacactggacagtctaagtgtcacactcatcaaaaccactgcctcctagggtgcatcacatgtggcatcaattacacagtgacattaaaagcaattagtgccaccgggttgactgcagattgctcctaccaaagttatttctctggtgcctgctgccctttgggggtgaaattatataggctgggccctaatggcatccggatctactggcaagcctccaggggctctgccaattacagcactgacctctatggctccaaaggcattttcacgtgcaccccgagtgctggcctcagtttctgtgatgtcactgagataccctgtggggatgtatacactgtgatggtctcaccagttgctaaaacaggattgaagcttactttctgtccaaaaaaaatatattcagtaacttgctctggaagtacacttggaatggtgatttatagagggaagagaaatgaagaatgacaaagtgagccccagataaaaacaaaaacttgaccaaagttgtctcatttgttagtgattagagatggaaaagatctactagaatgtagaataaaaatgcctctaggataggaaaagctcctttggcctttagaagaacaactctgactctgcttcctgagggcaaggtcaggtgtgtcctcacctgcacagcagttggagatctgctatgtgaggactctggagagaaatgaatccagaaagtcccctggacggctgctagcctgagttggcacactgtgagaaccctggaaacaagaaagttctgcttagcagaaattctgagatttcacatccacacacaccacagacttcaacacatccacttcatgagtgttttacaacagcacttgtctgcagccccctcaggggctggaaatgttcactcccagaaagtcaagccacccacatgcagacagcacttatcccaagacaaacctccagcaggacttcagtataggttggaaagcagtagctgccagggcaacctgagataacaaacgccctcatcgcaagttaggagcaaagctgagctgcttgcagggttcgctgagccaaagcatcaggtggcgtgacatctatgggagcatctgggaaagcagagctgccagcctgttgctagaagggttgcagttatgctttctgcatgagagaagatgtcaaatggagagcctcaaactgtggccgactgacatgcgtgcatcttttgggggaggaccatccatcttattggccatatcccccactcatattgtaattacttttttcatctttggagggggaaggcaatgaaatataacataaatctctcatacct

SEQ ID NO: 1487 - DNA, 2328 bp, Homo sapiens
gagctttgaactttctttgttttagaaaattgcattgatatagtgttactctcttgtgatattgtgttgatatgacattactctcttaggagacagtaattttctaaaacaaagtcatattctctcaagttttcctcccctaacttggacaatccctacctaatctccagggatagactcctatcatatttccaaactattaattatagcagaaactagatgtcttttgggattagccttttaaaaatagagcattccaacccttacaggtcaaaagccctggatttcaagaatctgtctctgctatgagtctcaagagcctattttgtaactcagaagccaaggacaacaaatgctaccatacttattctgagtcttcctggtcagaaaccaagaagatagtcattgcaacaaaaatacacagctttcagacattctcttcctgctactcagattgtcacgggatacttggggtgttgcttcaccagctggaaacctctgtggctggtggtaccttctgcctgagtattgctcatgcctggtgggctcgctttgcccactcatcctggaaggctgcactcggctcatgctatcagcctggattccatacctgccaagggcaagccaggctcggatcagtgaggggtgtgtgggcaagtgagcatggggttcagccacagcgcacaggcaggcacactggctgctgcagcagggtgggcagcttcaggcactgcagctgaaccagatgtactacatgcagcttctgttgtgggcacccatgcctggacaaggggaatgcagtggtgcctggaaacttggagatgccaggaaccacagagcctcaaagacagtatcatcatagccctaacttggggagcccctaggtctgggctaccctaagggcggcaactcttttctccttcccgtcgctcacaacatggtgagtggcaggtcatgtttcagccctgtttgtgttatagccctttcagtcctgccattcagcaggtcctgagttcttgtcccacatccaggaagaatgaggtacatggacaactggagggtaaacaaggtggagagaagcttcattgagtgacaggacagctttcaatagacccaaagtgggtagctcctttccgcaggcaggttgcagccctcagcggagagaccaagcatgggtagctgccatctgcaggcaagttgtcccaacatctctgtgagtatggctgagtggtggatggggcggaatggagagagagtcctttatgggcttcagaaggaaggaagtgcattgtgcatgctgattagtccatgggcagccataggcaggcctggaaaaagcaccataagttcttactccaagccatggactccagccagaactgacagcccagaccccatactttaggtcatctctggcttgaaggtggggcttcactgtgcacccacccttttctatgcagaagtctgtcttcctcctgctgctatcatattgtccatagtgcccacgctgctcatgctgaggagtgcctgcaggcccgacaagctgccgtcaaccctgcctcagcctccctcccatgctgatcagtgcataaagtccaagggggccaagggccagggtttggcatgtcagcgtcaccccaaacatgcgcacccacaggcaggtcagaagagcacccgggcttgccctcaactttgctctgaaatcagagtgggcaccaggcacagggagaagctaggcagtgggagtaggcacttctgagcccgcgaggctgagggggctcagaggtccccaggagcacagggtgcccacgtccgcagctgtggctgggtagctgcagcagtgcctcggagggcagggctcccaccctgccaattcagaagggggcagggctccccctgttcccagccctagctgcacctccccaacttcagcccatgtcttcacagcagccactcccaacgggctgccactgccaacaagatgacctattttgccaatattcatcaactggaacatatttcacaccacagtgttgataaaggaatatgccaataagatggatgctttcatttatgatgaaaataattattacagagaagagtctgtataatggcagctataacaactggatctacttgacaaggtggatgtaacatttcaaactattgaaaaggatgctttgaattaatataaaataaagaatggggctggaaataacccatctaccattttactgaatgaaaaaatcattactattctgtatatactgtgaagctagtaaattgagacataaaatattttttgtgaattaaaaaataagtcaaatc

SEQ ID NO: 1488 - DNA, 2054 bp, Homo sapiens
agcgcgaagactccccagggaggatggagccgtcaaccgcagaaaggccagagcaagagatggccctgcccagaaatgtgtccgtcccccctcctctccccgtgggcgcagagcaggatcgcacccccctcctcctccctggcccagagagggcacgaggccctgcctgccccgggcggccagacccgcaaggacgcgcagtgaggctcacgtgcccacccggcgcccctcacgagcgcggtgcgcctcgcttgcccgtaggcccgggtccggaagttcggccccaaactgctgcagctgttggccgagtggaccgagaccttcccaagggacttccaggaagagtcgactatcgggcaccttaaggacgtcgtgggccgcatcgccccctgtgacgaggcataccggaagaggatgcatcagctcctacaggctctgcaccagaagctggcggctctgcgccaggggccagaaggtctggtgggtgccgacaagcccatctcctacaggaccaagccaccagcctccatccacagggagctccttggtgtctgcagcgacccctacacactggcccagcagctgacccacgtggaactggagcggctgcggcacatcgggcctgaggagtttgtccaggcctttgtgaacaaggaccctctggccagcacaaagccctgcttcagtgacaagaccagcaacctggaggcttatgtgaaatggttcaacaggctgtgctacctggtggcaactgagatctgcatgccagccaagaagaagcagagggcccaggtgattgagttcttcatcgacgtggcccgcgagtgcttcaacatcggcaacttcaactccctcatggccatcatctccggcatgaacatgagccctgtctccaggctgaagaagacctgggccaaagtgaggacggccaagtttttcatcctcgagcaccagatggacccaacggggaatttctgcaactacaggacagccctgcgcggggcggcccaccgctccctgacggcccacagcagccgagagaagattgtcattcctttcttcagcctgctcatcaaagacatctacttcctgaatgagggctgcgccaaccgccttcccaatggacacgtcaactttgagaaattcctggagctggccaagcaggtgggggagttcatcacctggaaacaagtggagtgtcccttcgagcaagacgccagcatcacccactacctgtacaccgcccccatcttcagtgaggatggtctttatttggcttcttatgaaagtgagagcccagagaaccaaacagaaaaagaaagatggaaagctctaagatcttctattttggggaagacatgaaagcgctgagctgagggacgaggaagagctggagcccgcagaagccgtccacagccctgcctcagtggcccagtgggcagaggccagggagtgcctcactattttgcaaatgccgaccctgtggcctgctgcccgccccccgccccccacagtggccatacgggcacaggagaccttttatgggactttggccctggcaggacccagggcctccagacgtgcgggcggcacatgccttggggacatcctgccttcaggaccgtggggcctggtcagtctgtccatcctcggcaaggacacaacactgccccagagggtgggaccactgcaagctcgagaccttgcttggtgacatgtgccactttggccaccacccacagtctgtcaccacgtggcttgggaacttctggagccacagcaggcatcacggtgtgacgtgagatgcctgcgccagccccgagcccactggcagccactgccattccacccatggtccctcaccctgccctgccgacgagcttgtctctgcagccccaggtacccccttcctggatgctgctggccccaggagatagctttccggtgacagctgtggaacgcgtcagcaggacaaactggacacatggagttacagtgtgtacacggcagtcccgccacccagcccccttgtaaactctagtcactataaacac

SEQ ID NO: 1489 - DNA, 1571 bp, Homo sapiens
cttttcccccttctcaccggccaggatgcagacatgatggcaggagctggagcagccacctgaggacccagagctcaaagccacatgttgagaagggcagagataactgtatccactctggactgctgacctttgaactattatgttatttccagggaaatgcaaaccaaaggatgtggtctctgatctaatccttagagaatgtgaccatgaagacacttttcctacctggtaaacaaaagataatgagaaaagtgaggttggaagttggtttactgagccaggagctataacaggtgctggagcaggggtgtgatctgaatgaccagagggaaggactgatggaattggatggtcaaaaggggcaggaattggagagacgtctacaaagcttccaacaccatggccctgggggtgacctcctcggtaccctgcctgcccctccccaacatcctactcatggccagtgtcaaatggcaccaggggcagaaccagacatggaacagaccatccatagcccccaacatcttcctgaagagttgaggacagtcactgagaagatttattacctaaagctccatcctgaccatcctgagactgtcttccacttctggatccgactggttcaaattctgcaaaaggggctgtccatcaccaccaaagaccctaggattcttgtcacgcactgcctggtacccaagaactgcagcagcccctcaggagattcgaagttagtacagaagaaactccaagcctcccagcccagcgagagtctcattcagctaatgaccaagggggagagtgaagccctgtctcagatttttgccgacttacaccagcagaaccagttgaggagcagcagaaaggtggagaccaacaagaacagctcagggaaagattcttcccgtgaagacagcatcccttgcacctgtgacctacgttggagggcttcattcacgtacggagagtgggaaagagagaacccctccggcctgcagcccctctcactactcagcactctggcagcctccaccgggccacagctggccccacccataggaaattctatttgagccacccttccgcactggggagaatctatgcaagcctcgtcaacaccactttgcagcattcagctgctgagggattatcgggatggagagtaggagaaaactgcaaccaaggaagaatagagtcatctcacggtgacagcagagcctttccagctgtacataaccacgtcctcgccactgcacctcggcatatgccacctccatgccactgccagagctggcctagcaagatgtgctctcagaatggccgggcccaagagatgaaggaaaggagtgaaagggaagtaggaccagagaagtggaaggaagcaaaatggaggtgatgagaaaggtggtgggagaaagtcagcagatgagagacacaaagagaagtggtaataggaaacggaagagacttggtagacgagataaggaggacaagagaagggacacacccctgagagatgctcaccaagcttctatttatctaatttaaaacttgaaagtaaagccataaac

SEQ ID NO: 1490 - DNA, 1945 bp, Homo sapiens
agcaagcagtcctcccggcaccgtcggaagcgcagttgcagcagccgtcggacaagcggcccgagcagccacggacaagcagtccgggccccgccactgggcattgcagagagacagagagagagaggaaggctcactggctttgagctctctgggtacagtgtctgagtggaggcaaagtgcggttccttcaagatgtctgtgttgaagaagaacaggagaaaagactccgacactccccaggaaccttcggagaaggccaaagagcagcaggcggaggcagagctccggaagctaaggcagcagttcaggaagatggtggaaagccggaagtcttttaagttccgaaaccagcagaagattgcgagtcagtacaaggagatcaagaccctgaagacagagcaggatgagatcaccctactgttgagtctcatgaaatcctcgaggaacatgaatcggagtgagaagaactacatggagctgcgactcctgctccaaactaaggaggactatgaggcattgattaaatccctgaaagtgctgttggctgaactggatgagaagattcttcagatggaaaaaaaaatcgcaaaccaaaaacagattttcgcaaaaatgcaggaggccaataacccccggaaactgcagaaacagattcacattttggaaacccgtttgaatctcgtcactgttcactttgacaagatgctgaccactaatgccaagctccggaaggagattgaagacctacgatttgagaaggctgcttatgacaatgtctaccagcagctccagcactgcctgttgatggagaagaaaaccatgaacttggccattgagcaatcttctcaggcctatgagcagagggtggaggccatggctcgaatggctgccatgaaagaccgccagaagaaggacacctctcagtacaacctggagatccgagagctggagcgtctctatgcccatgagagcaagctcaagtccttcctgctcgtcaagctgaatgatcgcaatgaattcgaggagcaggccaaaagggaggaagctctcaaggcaaagaagcatgtcaagaagaacaggggagagagttttgagagctatgaggtggcccacctccggctgctgaagctggctgagagtgggaacctaaaccagctcattgaagattttctggccaaggaggagaagaattttgctcggttcacgtatgtcacggagctcaacaacgacatggagatgatgcacaagaggacccaacgaatccaggacgagatcatcctcttgcgatcccagcagaaattgtcccacgatgacaaccactctgtcctgagacagctggaggataaactgaggaagaccacggaggaggcagatatgtatgagagcaagtacggggaggtcagcaagaccttggatctattgaagaactcagtggagaaactgttcaagaagataaactgtgacgccaccaagatcctggtgcagttaggggagacggggaaagtcactgacatcaaccttccgcagtattttgccatcattgaaaagaagaccaacgacctgctgctgttggagacctacaggcgcatcctggaagtggaaggggcagaggctgagatcccgccacccttcatcaaccctttctggggtggctctgccctcctcaagcccccagaacccatcaaagtcatccccccagttctgggggctgaccccttcagcgacaggttggatgatgtggaacagcccctggaccacagcagccttcggcagctggttctcgacaattatatcctgaaggagaatcggagtaaggaagtgcgcggagacagcctgcctgagaaggtggatgacttcagatccaggaagaaagtaaccatgtgaggtgcatgcatggggccacctttgcaacataaccgaaagaataaatgttttgttctgt

SEQ ID NO: 1491 - DNA, 1833 bp, Homo sapiens
aatcaggcccctgggacgggacgcctctgtcctagccgtgagtgccccgcctgcccctagcggtccctggcgtcccggttcctgtcgcgctcacctgcgccggtagcgaagaaatcgccccgggacatggactcagtggtctttgaggatgtggctgtggacttcaccctggaggagtgggctttgctggattctgctcagagggacctctacagagatgtgatgctggagacctttcagaacctggcctcagtagatgatgaaactcaatttaaggccagtgggtcagtttctcagcaggatatttatggagagaaaatacccaaggaatctaaaatagccacgttcaccagaaatgtttcctgggcctctgttttaggaaaaatttgggacagtcttagcatcgaagatcaaaccacaaaccaggggagaaatctcagaaatcatgggttggagagactctgtgaaagtaatgatcaatgtggagaagccctcagccagattccacatcttaatctgtacaagaaaattccacctggagtaaaacagtatgaatacaacacgtacggaaaagtcttcatgcatcgccgcacatccctcaagagtcccatcacagttcacactggacacaaaccatatcagtgccaggaatgtgggcaggcctacagttgtcgttcacacctaagaatgcatgtgagaacccacaatggagagagaccctatgtgtgtaaattatgtgggaaaacctttcctcgtacttcctccctcaatcggcatgtaaggattcacactgctgagaaaacctacgaatgtaagcaatgtgggaaagcctttattgacttctcaagtcttactagtcatctcagaagtcacaccggagagaagccatataagtgtaaggaatgtgggaaagctttcagttattcctcaacgtttcgaagacacacaataacacacactggcgagaagccatataaatgtaaggaatgtgcggaagcctttagttattcctcaacttttcgaagacatatgatttcacacactggagagaagccacataaatgtaaagaatgtggggaggccttcagttattcttcggcttttcgaagacacatgataacacacactggagagaaaccctacgaatgcaaacaatgtgggaaaaccttcatttatctccagtcctttcgaagacatgaaaggattcacactggagagaaaccctacgaatgcaaacagtgtgggaagaccttcatttatccccagtcctttcgaagacatgaaaggactcatggtggagagaaaccctatgaatgcaaccagtgcgggaaagcattcagtcacccctcctcctttcgaggacacatgagggtgcacactggagagaaaccctatgagtgcaagcaatgtgggaaaactttcaattggcccatatctttacgaaaacatatgagaacacatactagagagaaactctataaatgcaagcagtgtgggaaggtcttcaaatggccatcatctttaccaatacatatgagactgcacactggagagaaaccttatcaatgtaagcattgtgggaaagcattcaattgttcctcatccttaaggcgacatgtgagaatacacactacagaaaaacagtataagtgtaatgtaggacatcctcctgcaaatgaattcatgtgcagtgcttcagaaaagtcacaccaggagagagatctgatcaaagttgtaaatatggtgttgcctttatgagttccttatcctgaaagtggacactcaaggagtgtgtctgtagttcatttgcaaataaacatttagttgaaaaat

SEQ ID NO: 1492 - DNA, 2016 bp, Homo sapiens
aaaaaggaccatcgggttggggtgaggctaggcgtttctgacctctcactctccttgggcgggtcttgctatgggttaagtaggtgacattcccaggtcactggtgttgtgtaccaaggaggattatggttgcttctgctgagtcatgcaggttgtcagggaagtgggggaaagctggcagtcacaggcctcacccagctcccctgcaaaacgaagggccggtctcactcccaccatgcccaccacaacagcccccagaccatttccaggtggagagcgataggggcttgaaaacctgccccaaactatccgcctcccagctgccaaagaagagggtttagttcgtgccgccgctgtggagtctgcacactggatttgcaccctcccctgagttctggccaggaggcttcttaccctgttcaaattgttacacagttcagctagagatttgcttctccctgtggagttttagcccttgctcctacccattggatccccgtggtgccagacaggaatgggctgctgggggacccagtgagctcccagggccttgctgctgcttcctctacgcctgtattttgcttggctttccaaattgactcagcgccagataaagttggaaacttctcctgcaaacagaccttcagcttcccccgtgagggagaagaggtcagtgctggtcatcttgtggatcctggcctttctggcggggaacaccctctatgtgctttatacattcagctcccagcagctgtacaacagcctcatattcctgaagcccaacctggagatgctggacttctttgacctgctatggattgtggggatcgcagactttgttctgaagtacatcaccatcgccctcaagtgcctcatcgtggccctgcccaagatcatcctggctgtcaagtccaagggaaagttctatctggtcatcgaggagctgagccagctgttccgatcccttgtccccatccagctgtggtacaaatacatcatgggtgacgactcctccaacagctacttcctgggcggggtcctgatcgttctctacagcctctgcaagtccttcgacatctgtggacgtgtgggcggagttaggaaagccctgaagcttctctgtacctctcagaactatggagtccgagccaccgggcagcagtgcacagaagctggtgacatctgcgccatctgtcaggccgagttccgagagcctctgattctcctgtgccagcacgtgttctgtgaggagtgcctctgcctgtggctggaccgtgagcgcacctgcccgctctgccgctcggtcgccgtggacaccctgcgctgctggaaggacggcgccacgtccgcacacttccaggtgtactaggaccgaacactgaggacacccagaaggacgccaaggattcaggacattcgcccctgtgtgccaccaaaccgggactttccccttccccttggcttggcatccctggctctctcctggtacccagcaagacgtctgttccagggcagtgtagcatctttcaagctccgttactatggcgatggccatgatgttacaatcccacttgcctgaataatcaagtgggaaggggaagcagagggaaatggggccatgtgaatgcagctgctctgttctccctaccctgaggaaaaaccaaagggaagcaacaggaacttctgcaactggtttttatcggaaagatcatcctgcctgcagatgctgttgaaggggcacaagaaattggagctggagaagattgatgaaagtgcaggtgtgtaaggaaatagaacagtctgctgggagtcagacctggaattctgattccaaactctttattactttgggaagtcactcagcctccccgtagccatctccagggtgacggaacccagtgtattacctgctggaaccaaggaaactaacaatgtaggttactagtgaataccccaatggtttctccaattatgcccatgccaccaaaacaataaaacaaaattctctaacactgc

SEQ ID NO: 1493 - DNA, 1738 bp, Homo sapiens
agaacacagtttaaggggtgcgcgcggaagtgggaaccagccggtggccgctgcccggcgccagaacgtctaccattcagcccgggcgtgcgcggggcggggaagaggctggagtagagaagcgagcgcccgcgagtgcgtggccggtccgcgagcgcgtgtggtgtctgccttgtgagcactgcgggttcgctggaccccgcggccagggccgcgccccgcaccgcagctgtcggattacccaccgttcggttttccgctgtggctgaacacagcggctctgcccttgccagtctccatctcacctcggggatcggcaaatgcacacgtcatggattctccggatgctccaacccgcggactccaatgggcgccccaagacgcccccagacccagcgcggcgccccaagcacatgggaccctctcaaggcaactcgccgcgcagtcagcggccgactagcaggtccggatgttcctgcgctctggcggcctggacttcgcgccctcgctaagcgggcgcgtctgccaggcgctgctgccaccagcaccaggagcgtgttcgggggcctccgggaggtggaaacgggatgtgggggtcatcctgcccgctcctgacaactttttttcctacgtttccctgcagacccagagcagcgaggtcacggtgtccgcggcctcagcaggaaggaccccgcgatggttcttcacaattcacccccgcgaacaacgcacccgagcctgcgcgcacggagggctgccgcgcgtggaactgagcgggtcctgggttggtttgcggtcctcttccctccgcccactcacatccctgccgggtgcgtccgcgctcacctgtcagtgcggcgggtcctcggggcctgcgctttcgacgcgtggcgctgagtgcggccgcggccagagccgccggggctcggcgcggggtcagcgggaccgagagtgacgcggcggccgtgcactgggtcgcccggtccgcggaaggcgcaccgagtgccaggcatcgcgccgtctcccgtttaaatgccggcggcagagcgcggcgcccggggccgcgcctctccattggccaggcgccgccgccgccgccagacccgctatccgccccctttcccggtactgcccccgccccccgcacccctcctgcttccccgcggggtcccctctccgcccgcctcgcctctttgtctgctccccccgcccgggccggctgggagaggtcaccccagggaaccgcgcctggaatgcacagcaaatcacattttccgctcccgttggagagggaagagcgggaggaaatccccccggctggcggcccctcattccttctctgccccaggtctgggctttccctgtcggccgcccggcatcgcctgcgttggtcccgcgctcagtagcggagactgcgctgggaagagcgagatctccgtgggatcgtgccagattcggccattcttcccctctggagggaacgggactgcgggatgctctggtcgagcggccgtcgtggctccccggcggccccgcccgaggcccccaacttcgagggcgctgaccccggcgcccccgttaacctggcgggctcgctggccgccagcaggagcctgtcgccaacatgacaccctcctctcctcgcccgccaagggttctttcagcccagatgccggcggcctcccctgtgagtgtacagaggggagtcacgggaggagaataaaactaaaagaccgtc

SEQ ID NO: 1494 - DNA, 1867 bp, Homo sapiens
gtgttgtggagaaataagaggacctgctcctccaatttaaagtcagtttggccaatgaacacaagcagatttgcagatcaccatgacctcttaacagaaaccaaaaggccaatagatacagtcatctctcagcaagctttttatagtgatgaatctgtgtcagcaatggaaaagcaatacctgcgtaacagtaatctcacaccacaacaaaaaatagatgaacttcatcatggatttactggtttagatcttgaagaacaatggatgtacccctcacgaagtgatcattctaactgtcacaatattcagacaaatgatacagctaagacaacattccaagaatatccacttatcaaaaactgttttacaccccaaactggtctgtctgatatcatgaaagaatcaggagttgatatctaccattatggaagagacagaatatgtactaaaggtcttgaagcaccactacagcaaaaaagggcagagatgtttctttctcaatttaatagatacactgaaaatgtagattattgtagatacccagagtatgttcatcctaataaggctaagcttaataaatgttcaaattttagtgtccaagatagcaaaaaattagccaatggcacacctgaaacaccaactgtagaagcagacacctacacaaagttatttcaggttaagccagcgaatcagaaaaaaatggaggagacaatccctgatcagcagaatttcacatttccaaaaactacgccacatctgacagagaaacagtttgcaaaggaagcagtattcactgctgattttggcttaacatcagaatatggactaaaacctcacacagcttgtcccgctaatgattttgctaacgtcacagaaaagcaacagtttgctaaacctgatcccccacattctgagtattttaaatcagtgaatttattatcaaactcagcaacatcttcaggaggtatcaatttaaacagaccaacttggatgaatgttcaaacaaaaaataacactcctattccttatcgaaatcaaggtaacttgatgaaattaaatagtcatttaagtgcagcttcaaaaggttctaaccattcttcagatttcccccaactatcatccacaaacttaaccccaaatagcaatttatttcagaaatattgccaagaaaacccttcagcattttctagttttgattttagttacagtagtgcagaaagaatccaatctgtcaatcacatagaaggactaacaaagcctggagaagaaaatctcttcaaattggttacggataaaaaaataaagcagccaaatggattttgtgataactattcagctcagaagtatgggataattgaaaatgtaaacaaacataattttcaagccaagccccagagtggacattatgatcctgaggaaggtccaaagcatttagatggcttatcacaaaatacataccaagatctactggagtcacagggtcattctaatagccacagaacgagaggtggagacaatagccgtgtgaatcgcacacaagtgtcatgcttttctaataattatatgatgggagatttaaggcataatcagtgttttcaacaacttggttcaaatgggtttcccctaagatccacccacccatttggccattcagttgttccactgttggattcctatgacttactttcttatgatgacttaagccatttgtacccttattttaatatgatgtatggtgataattctttttctggtctcatgccaacttttggatttcaaagaccaattaaaacccgtagtggaccagccagtgaacttcatattcgtctagaagagtgctgtgaacaatggagagcattagaaaaag

SEQ ID NO: 1495 - DNA, 2414 bp, Homo sapiens
acagtagtgaatcgtagcatgttagagttagaaggttcagtgttgatggagttattgaagaaatgatggagtaagagactcttttctaagcaactcaagtttgcagtgattcaggcctacttctgaagagacagccttttatctcaatgaatgacacagaaaaaccagcagatactccctctgaggaagaggactttggtgatccaaggacatatgacccagatttcaaggggcctgttgccaacaggagttgtacagatgttctgtgctgtatgatcttcctactgtgtattattggctacattgttttaggacttgtggcctgggtacatggggaccccagaagagcagcctatcctacagacagccagggccacttttgtggccagaagggcactcccaatgagaacaagaccattttgttttactttaacctgttacgctgtaccagtccctccgtattgctaaacctacagtgccctaccacacagatctgtgtctccaagtgcccagaaaaatttttaacctatgtggaaatgcaacttttgtacacaaaagacaaaagctactgggaagactaccgtcagttctgtaagaccactgctaagcctgtgaagtctctcacacagcttttactggatgatgattgtccaacagcgatttttcccagcaaaccttttctccagagatgtttccctgacttctctaccaaaaatggcactttaacaataggaagtaagatgatgtttcaagatggaaatggagggacaagaagtgttgtagaactcgggattgctgcaaatggtatcaataaacttcttgatgcaaagtcacttggattgaaagtgtttgaagactatgcaagaacttggtattggattctcattggcctgacgattgccatggtccttagttggatatttttgatacttctgaggttcatagctggatgcctcttctgggtcttcatgattggtgtgattggaattataggttatggaatatggcactgttaccagcagtacaccaatcttcaggaacgcccaagttctgtattaactatctatgacatcgggattcagactaacataagcatgtactttgaactgcaacaaacatggttcacatttatgataatactctgcatcattgaagtgattgtcatcctcatgctgatcttcctcaggaatcgaatccgagtcgccattatcctgctgaaggaaggaagcaaagccattggatatgttcctagtacattagtctatccagctttaactttcattttgctctcaatctgcatttgctactgggtcgtgacagcagttttcttggcgacatcgggggtacctgtatacaaagtcatagctccaggggggcattgtatacatgaaaatcaaacctgtgacccagagatttttaatacaactgaaattgccaaagcttgccctggggctctgtgtaactttgctttctatggtggaaagagcttgtaccatcagtacatccctaccttccatgtatacaacttatttgtctttctctggcttataaacttcgtcattgcattaggtcagtgcgcccttgctggtgcattcgctacttattactgggccatgaaaaaacctgatgacatcccacgatatccaccttttactgcatttggacgagccatacgatatcacacaggatccctagcatttggatctttaattattgcattaattcaaatgtttaaaattgtactagaatacttggaccaccgtcttaaacgtacccagaacacattgtctaaattcctacagtgctgcctgagatgctgcttctggtgtttggaaaatgcaataaagtttttaaacagaaatgcctatattatgattgcaatatatggcagaaacttctgcaggtcagcaaaagatgctttcaatctgctgatgagaaatgttttgaaagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttcttggaagatttagaaagaaatgatggttctactgcaagaccttattatgtgagtcaacctttgctgaagattttccaggaggaaaatccacaaactaggaagcagtagaagagcaaactggtcgtcctacagctgtgtgttaccttttctccatctgctgtgtctgtgcaacatttgtttcataagtgctttgtgtttagcaacactgtattcacgaccttg

SEQ ID NO: 1496 - DNA, 1592 bp, Homo sapiens
atttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggagcctgctgcggaggcgaagccaggcagcgcagcctctgcaaggggaggcgcgcgaggcggcgcgggagcgcgcggagcgggtgcgcagaagactggaggaggcggagcgccacaaggaggacttggtgaggaagagtcctagaatggggctggacccagggtggggtgaggcagggcgggcggaagggggcgggatccgggggtggggtgaggtaggaccggcggagaggtcggcaccgccccaggaccccgtccgcaggagcagcacagcaggcagctgcaggagcagtgggaggagctgtcgagtcaggtacgtgcaggagatgggagggcctgtctcttggttcctctcggaagtcctgcccttgtcctcgcccttgttgtctccccgtccctgtctcccctgacactcgttcctccagaagcccggtaaaccccgcccttacaagccccgcccctagctcttctactacggaggggaaccgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtaagtctcccaacccaccgccaggacgcctccccgaggcctcagtccgcactctcacccgctccaggaggtgcaggtgaaggtgatggaggctgcggaggagctggacgcctggcagagtggccgggaactgtaagggagttgggcctgcgggcgcggcggggcactgtggggccgggctgggctcccacctgcatgcctgtccccgcaggtgtgacgggcagcttcgcggagtgcagtacagcaccgagtcgctcatggaggagatggccagggcggaccgagagacgcggctgttcggcggccctcgcgcgctggccatcaggtgagccgggcggtgggcgcggccgcggtcccccacctgcccgcctttcgccccgcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcacctggctttatttctggtgcactcctctcctgagagtgtagaccaaggttgcctaataaactcaagggatg

SEQ ID NO: 1497 - DNA, 2272 bp, Homo sapiens
aacaggtgccgcagccgcagctgcgcccgcagcgcgcgcggaccgcagggataaggtcttcttcttctccgggtttttttggagatgaggaaagtgaggcccaaagaagatttatgttcaggaccatttagtctgagatgcctacatagaagagtgacagcagctagactaaatgtttaactgctgaactagttcctcaggtatcctggctctagagattgctatgggagattggatgactgttacagatccagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagccgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagattggctttctcctgccaagtgttttacacaagaaatctcttttgggtatccatcattcatccacggtcagtaggtgtggtgtcagaagacagtgcaaccaagactatatttgctgtttaaaaaagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaacgtacaaatcaaaaatggagtgtggcgtcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaat

SEQ ID NO: 1498 - DNA, 1723 bp, Homo sapiens
agcgcgtgcgcactggcctgtcagcggccggtggaccatggaggccgcaaggcccttcgcccgggagtggagggcccagtccctacccctggcagtagggggcgttttgaagctgcggctctgtgagctgtggctactgctactgggttctagtttgaacgccagatttttgccagacgaggaggacgtagactttatcaacgagtacgtgaacctccacaatgagctgcggggcgacgtcattccccgagggtctaacttgcgcttcatgacttgggatgtagctttatcacggactgctagagcatggggaaaaaaatgtttgtttacgcataatatttatttacaagatgtacaaatggtccatcctaaattttatggtattggtgaaaatatgtgggtcggccctgaaaatgaatttactgcaagtattgctatcagaagttggcatgcagagaagaaaatgtacaattttgaaaatggcagttgctctggagactgttctaattatattcagcttgtttgggaccactcttacaaagttggttgtgctgttactccatgttcaaaaattggacatattatacatgcagcaattttcatatgcaactatgcgccaggaggaacactgacgagaagaccttatgaaccaggaatattttgtactcgatgtggcagacgtgacaaatgcacagattttctatgcagtaatgcagatcgtgactaagccacatattaccgattttggtatccaaaatgggaaatgccccggccagttgtgtgtgatccactgtgcacattcattttattattgagaatattatgttttatcctgtgtgtcataactgttttgatagtacagtctcagtttccaaatatcttgttggaacaacaaatgatatttacccctgaggaatctgaagcagggaatgaagaggaggaaaaagaggaagagaagaaagagaaagaggaaatggaaatggaaataatggaaatggaggaggaaaaagaagagagagaggaggaggaggaggaaacacaaaaagaaaagatggaggaagaggaaaaataagagtagaaagaggaggaaaaagatgtatcaccaatataaaccaaaagtgtaatacaaaaaaagacagaaaaaaaaaaaaaagtaaaacactgagttttaacaagaaagaaaatatgcaaaccaccattggaatgttttttattcccttctctcctatacttattcaatcaatttaaatttgtaaaacaaagaaacaaaaaacatgtaaggtgggctctttgacactaagaacagataaagacatgacaggaaaaacactgaaaaacatttgaccagtctaattaatcttaagatttcaccatgttattctaataaagtagggaattttcattttctaaacatgtttccatctctgtgttttaaatagtaaggtgcttaagatcattccaagttcataacaaccattgaataaaatttgtatttttttgtttttactgttactgtcatagtttttattggtggtagtggtattttcatgtgatattaaggtatctaatattattatttgtctttgtggtttttggaatagtttaagtggtacctgtacatcctgctaggatgcaaacttattatttataattaatgttcaatatttcattaaagacttgctgtaattttctgccaccaagggctaataaatgccataatttt

SEQ ID NO: 1499 - DNA, 1876 bp, Homo sapiens
aacttgttgagtgctcagaatccgtgaggtgcattctctcattctagcaaggcaccagcgacatcgcagactatgcttggttatatactgtattgaatgtccttccaatgtcacatttgtgcttatcacacacatagcctgactagacaggaattctggcaactgctccagcagaactatggcactgagctaggtttaaatgctgaggagatggaaaacttgtcactgtcgattgaggatgtgcggccaagaagtccaggaagaagcagcttggatgactctggggagagagatgaaaaattatccaagtcaatcagttttaccagtgaatcaattagtcgggtttcagaaacagagtcattcgatggaaattcatcaaaaggaggattaggcaaagaggagtcccaaaatgagaaacagaccaaaaagagtctcttaccaactttggaaaagaagttaactagagtgccatcaaagtcactggacttgaataaaaatgaatatctttctctggacaaaagcagcacttcagattctgttgatgaagaaaatgttcctgagaaagatcttcatggaagactttttatcaaccgtatttttcatatcagtgctgacagaatgtttgaattgctctttaccagttcacgctttatgcagaaatttgccagttctagaaatataatagatgtagtatctaccccttggactgcagaacttggaggtgatcagctgagaacgatgacctacactatagtccttaatagtccacttactggaaaatgcactgctgccactgaaaagcagacactgtataaagaaagtcgggaagcacgattttatttggtagattcagaagtactgacacatgatgtcccctaccatgattacttctataccgtgaacagatactgtatcatccgatcttcaaaacagaaatgcaggctaagagtttccacagatttgaaatacagaaaacagccatggggccttgtcaaatctttaattgaaaagaattcctggagttctttggaggactatttcaaacagcttgaatcagatttgttaattgaagaatctgtattaaatcaggccattgaagaccctggaaaacttactggcctacgaaggagaaggcgaaccttcaaccgaacagcagaaacagttcctaaactttcctctcagcattcctctggagatgtgggcttaggtgccaaaggggatattacaggaaagaaaaaggaaatggaaaactataacgtcactcttattgtggtaatgagtatttttgtgttgttattagttttgttgaatgtgacactgtttctgaagctgtcaaagatagaacatgctgctcagtccttttaccgtctccgcctccaagaagagaaatctttaaatttagcctctgatatggtgtcaagagcagaaactattcagaagaataaagatcaggcccatcgtttaaagggagtgctccgagactccatagtgatgcttgaacagctgaagagctcactcattatgcttcagaaaacgtttgatctactaaataagaataagactggcatggctgttgaaagctagtgatctgaaggactaaaaccgcagagatacttggaacttaaagaaaatacctggaagaaaaccagacgaatgaaggattttggcatagaacatttctatgttttttcattattgagatttctaatatgaacatttctttcagtaacatttatttgataattagtttctgctggccttaataatccatcctttcacttcttatagatatttttaagctgtgaatttcttcagtgaaccatgaaatatattatagaactgaatttctctgatacaaaaagaaaatgacacaccc

SEQ ID NO: 1500 - DNA, 1694 bp, Homo sapiens
attgctctaaaaggcctctgtgccctgactgatcctccctccctgtcaactcctaatctttttattgtctccatagttttgccttttccagaatgttgtaatcatacagtatgtagtctttttgaattggcttctttcacttagcaatgtgcatttaagtttcctaagctgttgatcatgagactgagtccctttttatacttcaacagacatgagaacggcctcaaggaagactaaccatctgcaatactagaagccatggctgagggatcagtgatgttcagtgatgtgtccatagacttctctcaggaggagtgggactgcctggaccctgttcagagggacttatacagagatgtgatgttggagaactacggcaatctggtttcaatgggactttacactcctaagcctcaagtgatctccttattggaacaagggaaagagccctggatggttggcagagagcttacaagaggcctgtgttcagatctggaatcgatgtgtgaaaccaagttattatctctaaagaaggaagtttatgaaatagaattatgccagagggagataatgggacttacaaagcatggccttgagtactccagttttggagatgttttggaatatagaagccaccttgcaaaacaactgggatatccaaatgggcattttagtcaagaaatattcactcctgaatacatgcccacatttattcaacagacattccttactctccatcaaataattaataatgaagacagaccctatgaatgtaagaaatgtggaaaggcctttagtcagaactcacaatttattcaacatcagagaattcatattggtgaaaaatcttatgaatgtaaagagtgtgggaaattctttagttgtggttcacatgttactcggcatctgaaaattcatactggcgaaaaaccctttgaatgtaaggaatgtggaaaggccttcagttgtagctcatacctttctcaacatcagagaatccataccggtaagaaaccctatgaatgtaaggaatgtgggaaggcctttagttattgctcaaatcttattgaccatcagcgaattcacactggtgaaaaaccttatgaatgtaaagtatgtgggaaagcctttactaagagctcacaactttttcagcatgcacgaattcatacaggtgagaaaccctatgaatgtaaggaatgtggcaaagcctttacccagagctcaaagcttgttcaacatcagagaattcatactggtgagaaaccctatgagtgcaaggaatgtggcaaagcctttagtagtggctcagcacttactaatcatcagagaattcacactggtgagaaaccctatgattgtaaggaatgtggaaaggcttttactcagagctcacagcttcgtcaacatcagagaattcacgctggtgagaaaccctttgaatgtcttgaatgtgggaaggcctttactcagaactcacaacttttccagcatcagagaattcatacagatgaaaaaccatatgaatgtaatgaatgtggaaaggcctttaataaatgctcaaaccttactcgacatctgagaattcacactggtgaaaagccctataactgtaaggaatgtgggaaggcttttagtagtggctcggatctcattcgtcatcagggaattcatactaataaataataaaaatt

SEQ ID NO: 1501 - DNA, 2835 bp, Homo sapiens
agtgagggtcgcctcggcggcgagcagcacagcgggaacatggcgcccggaactggcgagcgcgcctagctggcgggaccgttagctcgaggcggacgcggcccggacccggtggatgtggagcagtcgccgctgccggcgcccaagccgaccccagggccgacccccgcaaggagctgaaggaggtgggggccccagtcgccgcgggcgtcggcgccgtcaaagaagatggccacggagacagcagtgtggtcagagtggtggagctggtcatcggcgagagctgctccatgtctgtctgctgagtgctagagcctgtggcccactggcttgcctcactgtggttgatggtggcggtgacagagactgcagcacgaccagagtggcttttctggctttgcccacccagctgctccatgccaggaggaggaggagacacctagagcctgcgacaccacgacttgcctcactgcgggtgggtggcagcgacagagactgcagtgcgccagagcgatcctgcccggcctgtacatcggcaacttcaaagatgccagagacgcggaacaattgagcaagaacaaggtgacacatattctgtctgtccacgatagtgccaggcctatgttggagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctgggtaaatataaggagcaagggcgcacagagccccagcccggcgccaggcggtggagcagttttccagcactggctccgctgacctacgataattatacgacggagacctaacgcaagcgacctgctgccttccttcccactgcttgtcttcagtgtgcccggctgggcaggggtgtggtggtggtggccgatgaggacaggaaagggagatagccagggcgaggtggggcgagggctccttcccccaagcaacaccgcccagccctgctccaggcccctgcactccgcccacccctaccctggctgcacctgagcttgctgcccccggggatgttgcccagtggctgtgcactgctctgtgcacgtgcgtgtgtgtgagtgcacttgtgtgtgggtgactaagtggatgcatgtgtgtgcctgtgtgagtgagggtatgtgcacctaagtgtgtacatgtgtgtatgttgtgaaagcgtctgtgcacatgaatgtttgtgtgagtgtgaactctttcttactgctggaagtcacagaattcatattgctgcccgggttggtgtggccacctttccctttgtccaagactccacatggaaggcatttgagctcgacctccgaaaagctacccagcaaagagcagtctgtgcctctgagcagaccgtgagaactcaggggacgagtggctaagagcatggcctctcccagaacccacccagggtggtgtggtgggggcaacaggggccagactcctctagagggagggtggctctggggccctggaaaacgtgagagactgccctgagctggtccagtgggccagcactttataccaactcagcatttaagggaagtatcttagattgcctccatctcaatgtgaatgcaccaggctgagggttccctagcgccttgagtcaaggccacttttcagcccatcgagccctgagttctacttggtgtttgttctctggagctgattgcacttgagctctgtggtgggcaggcgcactttagcctaagttgggtgccccagggcaccccctcctctctgctccttgccagcttcattcactcccagcctctcgctgtcctcactttgcaggggctcctcctcaacatttgcatgcacctgcaagaattgggaagaaagagcatttattaggcactgtagcaatttgcattttaaaatgcctgagcatttattaagcttcttggtattcacttgggtttgataattgatctgagctacctcattgaatgtttttggaaaggtgttttttggtatgcaagtcagctttgcctcacagttgaaaatgttcggtcatgattgcttttgaaaccaaaagggaaggtaccgatatcattgagctatttaaagttgccagtttgggctccagtaatgctttctggtgggtaaaattccacattcaggccacgagagcatctacagtttgtactctggggctgcaggcatcctgggacgctgtacgcaattcagtggtctagtcctttataccgactcagattccttaagcatgcagagtcactcgaatgaaaaaacatactcgacctctccctaaaaagatgttgcaacccagtttctctgaattccaccacaaaaagagaccctgaataagaagagcagttttcctgtgcatatagagggtgtgtcaaaggtgagctttttggggaccgggaaaaacaaagttgcctgattccgcgcaggtgcacaggccccggatgtacacccggaaaggggagtgtggctgtagaatcatccatccgtctacagctaaaacaatttgccaataaagtacatgtttttcctaagcc

SEQ ID NO: 1502 - DNA, 2870 bp, Homo sapiens
cttagtttttatatagtccaactcatgtactctgcttccgtcattaagaattcatagtgggagaaataggctgttgccttttctctagaatgcatggggcaaggctgtttgtttgtttgtttgtttgctttagacagtcttgctatgttgcccaggctggagtgcagtggcacaatcacagctcactgcaacctctgtctcccgggttcaggagattcttctgcctcagcctcccgagtagctgggattacaggcacatggcaacatgcccctggctaatttttgtatttttagtagagatggagtttcgccatgttggccaggctggtcttggactcctgacctcaagtgatctgcctgccttggccttccaaagtgctgggattacaggactgagccaccacgcctggccagggcgttttcttaaaaaagtgattgaaatctgctcatgccctgtgccacgtgggtctcacgcaggtctgttctctgctccaggtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcacgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggaccccccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttgggtttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaagaaaaaaaaaaaaaaacgttcccagaattcagtttccaaaatctctttttaaagggtttacacacacacacacacacacacacacacacacacacacacacacacacgatcattaaaaagtgtatgctctttaagaagaaaagtaaaatatctcaaaggacggtttcaccaccgtcctttattgaatcaatttttctacatttcagagcaagtgtagattctgagggactcctatttgccaaaaagacaaaactagcaaaaaaaaaaac

SEQ ID NO: 1503 - DNA, 2168 bp, Homo sapiens
cagtaagttccacacccagggacccagacaaggagcatctggaaaacaagctgcaaatccatctggccaggaaggtaggggagatcaaagagggctggatccccatgcctgtgcgtcgctcctggctcatggccaaatgtgctgttcccaagtctgacacccacaggaaacctgggaagctggcatcctggaggggtgggaaagcccacgtgaacacctcccaggagctttccttcctccatccctgcacccagcagatactggaagtacatcttgtaaggttctgtgtgaggcacagctggggtacagacctccagtccctggagcccataaatgtctggtcaggtgaggctcaggccccgcccttcccacaatccacctttaccccctgggcctcctgggtatctcgggttgaatctgtacccaaggttcccattttcctgggaaaacgtcctcagaatggtccaggagacaacagaacaacaagcaagtcagtcccgaccgtgagtggccctctcgctgccccaccgcctgagcaggagggagtccagaggcccccgagagggtcccagtcagctgatacccatgggcgatcagaggcctttccgactggacacaagggcagggggtgttctcagcccccaacatgcagccttgtgggcagaacctggcagagcaggactgtcctggaatccgggaaacccaaacccagactagaggggagtatgggttcagaaatggctgggaacgaggcatggcttgagagtgagagcatgtccccaggagacccctgtagtagcagagccctgcaagtgctcagcatagggtcccagtgggcaagggctgaagatgccctgcaggcactgaaagtgggggagaagcccccaacttgggaagtcaccttgggagccagtgtgagggcaagttcgggaagtgttcaggaggatctgaggagcacaggggctctggggaccactggtaacccctcagcgtcttcagtctgtgttgctcaggatccagagcagctgcacctgaaagcgcaggtggtcagtgagattgcgctcatagtgcaggtggactcagaggagcagctgccaggccgtgccccgggcatcctcctccaggacggcgccacaggcctgtgccttccaggccgccacatggacatgctcactgccgcagacaggctgcccactcaagcccctctgtccacctcccagagtgtgtctggtaagaacatgacagcttcccaggggccatgtgccttcctatggaagggaggggacagtccagggcagcaggagcctgggagcccaaaagcaaaggccccacagaagagtcagaagacgctgggctgtgcggacaagggcgaggcccacaggaggcccagaacaggggagcagggacacaggtccaagggacccaggacctctgaagccagtgggaggagccaccctgcccaagccagggaaataggagacaaacaagaaaggaaatacaaccagcttcagctggagaagggacagacaccaccagaaagccacttccagagaaagatcagtcaccatccacagggtctacaccccaggaaaggaggcacacggtgggaagatgtcctgcagaaaggcaagcctggggcagatgctttccagagctgggggtctggcccaccaaggcagtttatggactgcatggctgacaaagcctggaccatcagcagagttgtgggacaaatcctggtggacaaactggggcttcagtggggacgaggtccctcagaggtcaatcgccacaaaggtgacttccgcgcccaggagaatgtgccttcctgctgccacaggggtcactgccaccaagaacgtagcagagagatgagagctctggcctgcagccctaaagccacccccaagggccaccactgtcctgtcaaaaacaggggcatcagagacagagacagcagttgggccccacctcccagggagcctgtgtccccagctggtccccaccaccacaggccaagaatggcaagcacctcgggcggcccccatccacagctgcaggaactgatgtctgcacagaggtgtcttgcctcctgaactagaccagtcttcttgcatgtctcctgggggagacagggggttctactcaaataaaactgatgcctacac

SEQ ID NO: 1504 - DNA, 2301 bp, Homo sapiens
gttgtttctaggtcacagtctctgtgaaggggcaggaagtgcgcttggagaagatgacacccccgaaatcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggattgccatttcctaaatccggtgtggtctccaggttggagcaaggagagccatggatcccagatctgctgggctctaaggagaaagaacttccaagtggcagccacataggagacagacgagtgcatgctgatctgttaccatccaagaaagatagaagaagctgggtggaacaggatcactggagctttgaagatgagaaggtggcaggtgtgcactggggctatgaagagaccagaacgctcctcgcaattctcagccagactgagttttatgaggctctcagaaactgccataggaacagccaagtgtatggggctgtggctgagcggctcagggaatatggcttcctccggaccctggaacagtgtcggaccaagttcaaaggtctccagaagagctatcggaaagtcaagagcggccacccacctgagacctgccccttctttgaagagatggaagccctgatgagtgctcaggtcattgccctgcccagtaatggcctggaagcagcagcctctcactctggcctggtaggcagcgatgctgagactgaagagccagggcagaggggctggcagcatgaggagggagcagaagaggctgtggctcaggagtctgacagtgatgacatggatctagaggcgaccccccaggaccccaactcagctgcacctgttgtgttcagaagcccaggtggtgtacactggggctatgaagagaccaagacttaccttgcaattcttagtgagacccagttttatgaagccctccggaactgtcaccgcaacagccagctgtatggagcagtggctgagaggttatgggaatatggctttcttaggaccccagaacagtgtcggaccaagtttaaaagcctgcaaaccagctatcggaaagttaagaatggccaggcaccagagacctgtcccttctttgaagagatggatgctttggtgagtgtccgggttgctgccccacccaatgatggccaggaagagactgcttcttgccccgtccaggggaccagtgaggctgaagctcagaagcaagctgaggaagcagacgaggccacagaggaagattctgatgatgatgaagaggatactgagatacccccaggggctgtcataacccgtgctccagtgttattccaaagcccccgtggttttgaagctggatttgagaatgaagataattcaaaacgggatatttctgaggaagtacaactgcataggacattacttgcaagatctgaaaggaaaattccccggtatcttcatcagggtaaaggcaatgagagtgactgtagatcaggaagacagtgggcaaagacctcaggggagaaaagaggaaaactgacactcccggagaagagcttaagtgaagtcctaagtcaacagagaccttgcttgggagagagaccctataaatatctcaaatacagcaaaagctttggtccaaactcccttctcatgcatcaggtatcccaccaggtggaaaatccatataaatgtgctgattgtgggaaaagcttcagtcggagtgcacgactcattagacaccggagaatccacactggagagaaaccttataaatgtcttgactgtggaaaaagtttccgtgacagttcaaatttcatcacccataggagaatccacacaggagagaaaccttatcaatgtggtgagtgtgggaaatgcttcaatcagagctcaagccttatcattcaccagagaacccacacaggagaaaagccctatcaatgtgaagagtgtggaaaaagcttcaataacagttctcattttagtgcacatcggaggatacacacaggagagagaccccatgtgtgtcctgactgtggaaagagtttcagtaagagttctgacttacgtgcacatcatagaacccacacaggagagaaaccctatgggtgtcatgactgtggtaagtgcttcagtaaaagctctgcccttaataagcacggagaaatccatgcacgggaaaagcttctgacacagtcagctcccaagtaagcccctgaggatatataacggaaagaggctcaataaatgtattgtttag

SEQ ID NO: 1505 - DNA, 2163 bp, Homo sapiens
catcagcatcgtggggcagagcaacgaccgtggagacggcggcatctacattggctccatcatgaagggcggggctgtggccgctgacggccgcatcgagcccggcgacatgttgctgcaggtgaatgacgtgaactttgagaacatgagcaatgacgatgccgtgcgggtgctgcgggagatcgtttcccagacggggcccatcagcctcactgtggccaagtgctgggacccaacgccccgaagctacttcaccgtcccacgggctgacccggtgcggcccatcgaccccgccgcctggctgtcccacacggcggcactgacaggagccctgccccgctacggtacgagtccctgctccagcgccgtcacgcgcaccagctcctcctcactaaccagctccgtgcctggtgctccacagctggaagaggcgccgctgacggtgaagagtgacatgagcgccgtcgtccgggtcatgcagctgccagactcgggactggagatccgcgaccgcatgtggctcaagatcaccatcgccaatgccgtcatcggggcggacgtggtggactggctgtacacacacgtggagggcttcaaggagcggcgggaggcccggaagtacgccagcagcttgctgaagcacggcttcctgcggcacacggtcaacaagatcaccttctccgagcagtgctactacgtcttcggggatctctgcagcaatctcgccaccctgaacctcaacagtggctccagtgggacttcggatcaggacacgctggccccgctgccccacccggctgccccctggcctctgggtcagggctacccctaccagtacccgggacccccaccctgcttcccgcctgcctaccaggacccgggctttagctatggcagcggcagcaccgggagtcagcagagtgaagggagcaaaagcagtgggtccacccggagcagccgccgggccccggtccgtgagaaggagcgtcgggcggcgggagctgggggcagtggcagtgaatcggatcacacggcaccgagtggggtggggagcagctggcgagagcgtccggccggccagctcagccgtggcagcagcccacgcagtcaggcctcggctaccgccccggggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgccccagccctgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccacgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacagggagggaggtcttggggagatgggcagtcaggtggcccgtccttggtgagtgcacacactgcgcgcacacatcgcggccttcctggcttctctggcccccacgtgtctgtgctgtagatactgtatcaaagtcccagcgtttagatggttaacatagagctgcttctgtgtaaatgctgcttattttaaacactaaaaagcgtttaattttatggg

SEQ ID NO: 1506 - DNA, 2631 bp, Homo sapiens
gcttcccctcactcctcgggccttgctcttcccccaggtgcccactgccctccctgctgtgtaccactttcttgctgcctgtgaaggtatttgtcctcactcttgtgctgctccttcaatgatagaactttgggactttctcatccagcagcaccagcctgaaaaagcagtggcttgcaccaccacacacatacctggtctcagatataagctccatgagaacagccaccttgtttaccttgttcatggatacagaacagtgcctagtgctcaataaatgaacagtgagtgaataagtgagtgttgagtcatctaagtgagcttagatgaactgacaatgagactgtgcacaatgaagagaaaggaggactcttgaggaattccaccagcttgaagatggctgaagaaagatgacagaaagcaatcagagggatggagggcaaactaagaaagcagagtcaagagtaggaagattgggaagtggtagacaacattaggaaatactgcagaaaaacctaaaaggatgagaattaggaaagacactattgaatttggtctttggggctgaaaaaaaaggcagctgcagaaaagaaattggagtggaaccccatttgcacagaaattatggagtaattaggacaccaggcagaaagtttggcaatgaatggaaggagagatgacagccttgggcattcgctcgcagaacgcaaggacattcattcttaattcagtagaaaagtgtcgtgttgttactgtctcaagtggaagcgccctctcactccttcattgtcctaagagaacaaaaggggccttgaatttcatgactgccccagtgatgcttctgagagcttgagctttggaatcagactgcccacattcaaaccccagttcttcctattgctggctgtgtgatttggggaaaattacttgattccctaagttttctcatctgtgaaatggggattcactcagttagtgaatattattcagctcctaccatgtgcagacactgttctagtgggggattcagcataccagcagtaaatggatctctgtacaatgccaaaaacatgaagccaactattcatagtatttttaagtgatatcctggtgctgcttccaggaagatggagtagatatacttttccctattgctcccactaagtacaactaaaaccctggacattatgtataaacatgcataagaagatgctgaaaggtggtaagaaagcagactggccagggactttgcgatccaaggaacaacctggtgatgaggttcctgtaccccagacttgggataaaggagctggcaacccagaaatgccaacgggagcaaataaaaaatccccaacaaaagcctgtttctctagacaaaagactaggacaggggcagcctaacaaaacagaaaactcttagtaacaacttactccagctaaatagcacagaaaaacctatggtccactcccacccacaccacccaagggtgtgggagtccaggctatcacaaggggcctcgcctccactggtgtggtatcgcaaaagccacagggagctggttctttcatccccatctgacaaaaggctcccacccccatggtgtcagcggagaccacactgggagcctgaacttccacccactcacagctgtaacaaggcagtccctccacctccctgctggggtggtgtcagaggaggccaagtggagagtcaggactttcaccatagcccagtgacaatgaagccacctccctatggtgtcagtggaggccataaggaacagtaacgaggtctagtgggaatccagaactgccaccctgcccagcagtaaccaggagcccctcccctccgtgtggacagaggccaagtgctgaagctggactttgctccccctagccctgctaggtggctattagaacagccagctaaaactggtttcaccaagacagatttaggaagacagtgccccgggcaggaaaatgaaggcacggagaggttaaatataataacttgctagtggtcaatcagtaggcagtagaggagccagcatataaacccaagctgcccagctgcagaaccacattcttgtcccatatgctatgcctctcaaaaaaggaggccctctccttgggacacaaaggtaataaaaatgcctgccctgagctgtgtctctgtctaggtacacagttcatgagtgaaggagctcctggagtcatgaataatggaagtccagattggtcaagtaacttgtcccagccccagcccatgcatctggtatgtggttggacaggtttctaactcattacgtaacatcaagaacattttaaactgctttgagacatttgtgaattaagatctcaataaatagtcctccctggcaccagctccatccacattaaatgagacttgaaaatttctttgaatggatattagtttagaaggagctaagttattagttggcctcacattcctcagttgggccctgggcccagcatgccacttctcctggttattatggttcacatctgaggtaacccatcgggaaactggatgggacaacaaactaaaaatattttagtttggacctgtccaaaaccaagagaataaaaacaaaatggatagtcaagatg

SEQ ID NO: 1507 - DNA, 2937 bp, Homo sapiens
acttactgtcataggtcttattaaataggtatctatgtagtcagagcatgtttcatagaaatggagtgttcattaaactgaaacttcatacattgcctctgggcttttggggataggagtatgatacctcccaacttgaaattcccacagataggtgaggtcatagtcatcgggtgatacttaatgagcccatgtttttctttcattggatgtaaactatgctcgatagtgacgagaggctgcgagactgtggaaatgaccctgaggaggaacgggctgggccagcttggcttccatgtgaattttgaaggaattgtcgcagatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacaccacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccaccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggtccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgagactgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaac

SEQ ID NO: 1508 - DNA, 2018 bp, Homo sapiens
atccactcagcacctggttaggaagctaggccaattttcctcccttttgatttcattctgctcctgtctggctgcccagccacatggagagtttgtcaaatggaatttctgtctcttgcggccgccctgccctctgcagagtgctgaacgggcaggcaggatcacccggctcagtgccgcagacatcactctcttgtgataagggccagtgcgcacccttgaaggaggagcctgtcattcttcacagtcaccaggcagctggcggggtctctgtcacccaggctgagtgcagtggtgttatcaaactcactgcagcctcaatctcccaggctcaagcaatcctcccacctcagcctcccaaggagctgggactacaggcatgcatcaccatgcccagctaatttttttgactttttgtagagattaggtcttgctatgttgctcaggctggtcttgaactcctggactcaactgatcctcccgcctcagccacccaaagtgctaaattacaggtgcaaaggaaatctttaaagcaaaatgccaaggaaatactgtttgagtaggactgtaccatttataatcagtttccacagccatcttagggaactctcacctctccctgggtatgccacccacccagtcccccagacaagattctggggatctgctggacacttcttgtctttcaggtgctccaattttaccagccaccatgcagtcctgcctcttgggtgccctaattcttctgggcagtcctgcctcctacccaccccttggttctggttctgcccacttccttcccactccactgctcccaccccaccgccagccactgccacctcctgcctgctggggacactgacatcacctcttggctgcttttctctacccagttgctcttccctctgaccacttcttccctgaagggaccttcctacatcacaattgaaacaattctccttccttgcttacaattgctcactgactcatgtggtattcaagtccaaatccctgagcatgtttttgaactggaaaaatgacagggggcagtggtggtaatcagagcaggcttcctggaggaagtgacaactaggctgaaggatgagtgagtgttcatgccacatgatgtgcaggaaaggcactctgggacagcagcagcagaggaccttcctggagatgtctcccataccctcggtcccccatgcctgtgggattttcaagaggaagcagagctgtggggccatgcttcccattgtgcaatatggatgttctgggaaataccacaggagggtggaagggcaggcgatcgtccacacaggaagggggcatgcagggctggatttgctgagccgagataagcggccccagaggtgctccagagaggaagcccccgagctcgggagcctcatgcgtgcaggcgatagcatgggtttggaatgcacaggtattgaccaaagccaccatgcacagactggacagaaaatggctggtgggggctggctcttggggagcaagacaacatcgtgcagaggagagaagggactctggttctctttctcagggggcccacagagaactcagtggactcatggctgaaaagaaggggtccacactctgtttttaacaccatctatttgtagttgggagactcaccgtgcagccatgaggcagggctgggtgggggccatgccatgcccctggagctgggacacctaagctcagcatgtatctagaaaacaagactggtccagcgtaatggtgcgagatgaaccaattcctctacgtggcaatttgtcacaagcacagccctcaactcacggggtaccagggacccaggaagaagtggacttggcaccaatgaggatgcttctgctgcagatctctaggtgccagctgctactgagatgtgatgttgggcagccgcttctccttttggggacctcagtctccccatctgtgatttttgaatcttaataataacccttctgcctcctaagacagttggaggatcaaatagg

SEQ ID NO: 1509 - DNA, 2468 bp, Homo sapiens
agagcaactagagcaggcagtagagtggggtgggcggggatgaggagggggttgggtggctggtggccctagaggctggccctaaagaatacctggacagcctgccaccctattgctccaaaatgaaaatcctctaacagatgactctggggacgacgacgaggctaccaccccagccgacaagagcgagctgcaccacaccctgaagaatctttccctgaagttagatgacctcagcacgtgcaatgacctcatcgccaagcacggcgctgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaggataccgagtactttgatgccatggaagactccacatccttcatcaccgtgatcaccgaggccaaggaagacagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtaagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgc

SEQ ID NO: 1510 - DNA, 2153 bp, Homo sapiens
agttgcctgaggacagcagtgcagttgacatggatattctctttcctctgcacagtgttattggtacagagctgtgccccagccccattccccagatcatccatttcatcctcttcattgtgttcagcctggtgatcctgatcatcttatgcccctacattcccagggagccatcctcagtgcctcccagagaggaggacagcgagaatgtaaggagccctcagcccacacccagcagagaatgcttctatttttcctgctctcttttccacttttccacatcagccagaggcgctcctgtgatgggaactctcatcatccctctagggacagcagggcaggcaggggttggagtgggcataggatttccaacccaagcccccagaccatctgtggaggtgcacgggaggcgtcagagcaaaaccaaaccccaggactcagcggcgaggacccggtcatgagaggggtgaggtctctgtggaaggacaggccctgagcccgggctcatcagccgccttcctgggcaggcgcctcggggcccagcctctgtgtgaggtgctctgggggctgtgctgagcccctgagagcctcccacctgagactggagtcgcccctggcctcctcggaagcagaatcctccctgccagctcagaggcacctgcagacccaagagtgtgtgtttcccaagcagcggaacagggactgaggatgcccagggcaggcctcacatagaaaacccctccatgctttccagagaaggaaaccagaaaaggttattacgcactttagaaaccagtgaaagagaagcacataggctccatgagctgggcggagaaagtgtgtcattcacgagcactgggtctgcagctgtggggacaggagactgagacccggcctgcaccctctttcttgtctctcaggatcaagctgaagtgggggaatggctcaggatcggaaataaatatatcactttgaaaggtaaggctctgagggtcccagaagcccccagaggtgacagcttcacctgatcctaggaacatgctgcttgtctccaaggaattcattttcagaggcctgaagggaacctcctaggagagaaattggaacccgggatccctctccatgggatgaagccatggggtccaggaagcaggtgttgcccaggaggggaccgtgtgggggaggggaccagtgaccacctggacatgcaggaggggctgcaggtccatgtgggcagctgtttaacatggctgagccctctctaaggccaccctgtcctctctcctcaggaggtggtcgtgacccccatgatggggcgtgtcaggaggcactctataaatgagaaaacgctgcccaccgggcatctggctatcactcctggggccctgtggccttggacagggatgctggggctccagggtctaatccccacgggctcccccggctcctctggcctccatgccgtcatcagtcccgaagacctccatagagtcccttgggtctccatcatccctgagctcctcccaggcatcagagcctctgtgtcccctgaagcacccttcacaccggccacctgcaagcaccctatcaccaaacccgaccagctccacagaatccttggggtatctgtcatccctcagctcctcccagccaccagagcctttgcgtcccctgaagcacccttcacacaagccacatgggcgttcccctccccgacgacggaatcctggctgggtgtcctggtccgactccatgcaggctgattccgaaactgacgccataatatgcccaatgtgcaaggcccctgagcgctcctgtccacacacctggtgggtgccttctagccctcgagtgatccgaggcgttggtcgctgcagtgatcccaacctgggcctctcctggaggcaggaggctgctagagcctggtgccactgcacctcctcacagtacccattcgagcaccctaatcttcccacccacctaccaaaggcttccttctagggagaccccacatgcaggcagatggaggcagggctcacactggcctccagggctgtgcaactggcatattattttgcacataacttggctcaggtttgtgaggtctgatttttaaaatgaagcaacaatcacataaagattttcaaacaaat

SEQ ID NO: 1511 - DNA, 2447 bp, Homo sapiens
tttgtaaaaatgatggctttgagggctaagtgtcaaggctacgtcatatttgtgatttctctgggctctacacgtaaggatgacatggaggagttagccagctacccacttgatcaacacctgatacagcttgggagaatacataaaccagatctgaattatattgcgaagttcttaaagccatttttatactcggtcaggcggggattcaatcagtacccaccaccgatgcttgaggatgcctgtagactcatcaatttaggaggagagaatattcgaaatgatggtttccaatttgttactgagctacaagaggattttttgggagataatggcttcattggccaagaattaaattctgggagagaatcaccttttgtaaagacggaagacaatggaagtgactatttggtttaccttccaagccaaatgtttgagccacaaaaattaatgatcaattatgaaaaagatcaaaaatctgcagaaattgcaagtctcacttctggacatgaaaattatggcagaaaagaagaaccagatcatacttatgaacctggagatgtctctcttcaagaatattacatggatgtggctttcctcatagatgcttcccaaagagtaggaagtgatgagtttaaggaagtaaaagcttttataacctcagtgcttgattactttcacatcgcccccactccactgacctccaccttaggagacagggttgctgtcctgagctactctcctccaggctatatgcctaacactgaagaatgccctgtctacctggaatttgatttggttacttataacagtatacaccaaatgaaacatcatctccaagactctcaacagctcaatggagatgtttttattggccatgccttgcagtggacaattgacaatgtctttgtaggaacccccaatctgaggaaaaacaaagttatctttgtaatatctgctggcgaaaccaactctttagacaaagacgtcttaaggaatgtgtctctgagagccaagtgtcaaggctactccatatttgtgttttcctttggccctaaacacaatgacaaagaattagaagaattagccagccaccctctggatcatcacttggtccaacttggccgaacccacaagccagattggaactatatcatcaggtttgtcaagccatttgtccatttaatcagacgtgccatcaacaaatatcccaccgaagatatgaaagccacatgtgttaacatgacccctcccaacccagagaacggtggcacagaaaacactgtattacttcttcctgggatatatgaaataaagacagaaaatggtgatctgtttgatgaatttgattcccaggcacaacatctccttgtattagggaacaatcatagtaatggttctgaaacagctactgatttgatgcagaagttatatctgctcttttcaactgagaaactggcaatgaaagacaaggaaaaagcacattagaagaaatttcagctctagtggttgataaacagcaagaaaaagaagataaggaaatggaagctacagacatctgaagcatcttacctaagaattcagtaattaatccaatactttcgtcatagtgattcatactctatgtttatagaacatggtgaagatacaaggtcatcataggagaaaagaagatagctccactgacatgtataatcccatgtggttctaaccagaatgtataatcatctgttagaggtactgtggtaaatgacagggacttttcacaaaaacaattggctaatagcatgctaaatttgttctccatctcaaatcttgaggagaagaattttcggagtgaagacatcagtaagaagacctgacaaaccaggaatgatttcatttctcctgagaactggggaaaccgacctataagagttaacttttctttgaaagctctgcacagttcaggcatcaattttgatgatgtatctgcctgtaaaagattgtcattattttcaacacatctgtatctcagattggactcctctaaaagcatttggaattggaatttcctaggaatatcttctactaattcttaaaactggaaagccatgcccatgtcatcggttctggggtgaccctaacatttcatctagcagtgattgtcttctaaaacccacctgtcaggctgctatgacccatagttaatgctttctcttcaccaggacattgacaaaagaatggaattggtgaaaaagaaaaaagtgataagaggctagttttatgaaccatattttttgctgtaatcttttgtttaaattttagcatgctttgctttgtgtatactgaatttttgcagcaaaagaattacggaaaagcacagatactctatatgaccagagatgttcttgggaattacaatgtagcaagagataatttctaaaataaaaacaagtctgacttgg

SEQ ID NO: 1512 - DNA, 1843 bp, Homo sapiens
aaaaactcgaaaaccaaggcgcccagggttgtgtgagggtttccgctctgcgccccgcggggttccatgggtcctgcacagcatcaggcctgagccgccggtccaactgctccaggtcatcagtttgccccatcattggttaaggtggtattctctacattataaagctcgatggagtttgtgacagccctggtgaacctccaagaggagtctagctgtcccatctgtctggagtacttgaaagacccagtgaccatcaactgtgggcacaacttctgtcgctcctgcctcagtgtatcctggaaggatctagatgatacctttccctgtcctgtctgccgtttttgctttccatacaagagcttcaggaggaacccccagctccgtaatttgactgaaattgctaaacaactccagattaggaggagcaagagaaagaggcagaaagagaatgccatgtgtgaaaaacacaaccagtttctgaccctcttctgtgttaaagatctagagatcttatgtacacagtgcagtttctccactaaacaccagaagcactacatttgccctattaagaaagctgcctcttatcacagagaaattctagaaggtagccttgagcccttgaggaataatatagaacgagttgaaaaagtgataattctgcaaggcagcaaatcagtggagctgaaaaagaaggtagaatataagagggaagaaataaattctgagtttgagcaaataagattgtttttacagaatgaacaagagatgattcttaggcagatacaagatgaagagatgaacattttagcaaaactaaatgaaaaccttgtagaactttcagattatgtttccacattaaaacatctactgagggaggtggagggcaagtctgtgcagtcaaacctggaattactgacacaagctaagagtatgcaccacaagtatcaaaacctaaaatgccctgaactcttttcatttagattaacaaaatatggtttcagtcttcctcctcaatattctggcttggacagaattatcaagccatttcaagtagatgtgattctagatctcaacacagcacatcctcaacttcttgtctctgaggatagaaaagctgtgcgatatgaaagaaaaaaacgaaacatttgttatgacccaaggagattttatgtctgccctgctgtcctaggctctcagagatttagttctggccgacattactgggaagtagaagtgggaaacaaacctaaatggatattgggtgtgtgtcaagactgtcttcttaggaactggcaggatcagccatcagttctgggcggattctgggcaattgggcgatacatgaagagtggttatgttgcgtcaggtcctaagacaacccagcttctgccagtagtaaaacccagtaaaattggtatttttctggactatgaattgggtgatctttccttttataatatgaatgataggtctattctctatacttttaacgattgtttcacagaagccgtttggccttatttctatactggaacagattccgaacctcttaaaatctgctcagtatcagattctgaaagataaggaactggtaaatgggtctgtttcagtttttgtaggtaacttagccagtaaatttaatctcatttctggactctttaagttctaccactgaaaaccagagtcgatttttctcctaaatttttggcaactataagatgttcataatgccactttcatatattctatgaatatcaattgtcaggtgctttgatttctaagataaaatattttagaattatgttacttaacatgtccaataaaatgttttcaaattgcc

SEQ ID NO: 1513 - DNA, 1740 bp, Homo sapiens
ctcaacgtcataaggaatcagacggatgcggaaaccgagacgggctggatgggaaactctttccaggaaggctccggggccctcagctggtctccgaccttcccctgcaacctgtgacacctgccattttcccatcttaggcgatggcaacgccacccttccgtttgctccgggcaaaacttcgagagttccctctgactctggagttttttcctcagatccaagagccaactggtcatcaattcgtaatttcccatcggctaagtgcgtgggcattgagctacacgcgagtctctccacctctgcggaatggctacttcggggtaggggaggggccctcccgtggattgtaaggtgtttagcagcaacggacctcttgctgccaggaaagaaaggcgtcgagtcctgtcctgttgggtaggcggaagagagatcaaagggaagacaagaaaaatcctgggaggtttcaggatctaaagttaccatgaagtcgacctaacctcctctggaggtcctcccagtcctcccgtggctggcgatggtgaatcgagtttccgtctccagtttgccaaggcggacaaagccgacacgatgggcctgtccactatcttctttcatatacacaaaatgtcagcttttcctgtttctaactggcaacatcccgcctgatgaccagcttagcaaattagagactctccatgggattccatctgtgtcttagttcgggcttctctaacaccgtaccatacataaactgggtggctgattcacaacagaaattgatttctcacagttccggaggttggaagtccgagatcaaggtgccgacatggtaggtttatggtgagggccttttgttctggttgtagactgccacctcctcattgtatcctcagggggcagaaagagggcgagagagctccccgaggtcccttttataagggcattagtcccattcagactaatgggactaaatccagactctgtgctgagtgttgtggattttttgcatgttcatcctccccgcaggcaactggagatgtattgtccccagagggtacaatagagaatcttccgtcacaagtcagcaaccagcatatgtgagtgacagcatgtgttccactcagaaatgagagtgtattagtccgttttcacgccgctgacaaatacataacatagtccaggacgaaaaagaggtttaattggacttacatttccatatgactggggaggcctcagaatcatggcgggaggcaaaaggcacttcttacaaggcagcagcaagagaaaatgaggaagaagccaaagcagaaacccctgataaacccagcagatagtgagacttattcactgtcaggagaatagcacaggaaagacccacccccatgattcaattacctcctcctaggtccctcccacaacacatgggaattctgggagatacaattcaagttgagatttgggtgagggcacggccaaaccatgtcagaaagggatgaagtgacagcatatcctgatgtgtgtgatggttttatgagttattacctatttcaaaaattattgcaatgtgtaaaaaagaacaaggacttgtactatctgactttaaggcttactataagctattacagacaaggcatcaggagtgacaaatagataaacagactgagttaagagacttgaaactgatccacagctatacggtcaataaatgggttttcaataaaagcagttcaataaaag

SEQ ID NO: 1514 - DNA, 1752 bp, Homo sapiens
tttcctctccggccccacgggcgcgcttccctcctgacggattccgaagcccgccccaccaccgtcaccgcaccagtggcccaggcttcgtgggaccaacagggctaatcctgccccacggatctaatccggatcgggacccggtcccaggggaggcccccacctccccttctattgttctgtggcccaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctggtgactgaggatctcctctctgtgctggctgagctgcaagaggctctatggcattggcccgaggacagccacccaggcctggctggggcctcagatactggtacaggcggctgcctggttgtacatgttgttagctgtgaggaggagttccagcaacagaagttggacctgctttggcggaagttggttgacaaggctccactcagacagaagcacctcatctgtggccctgtgaaagtagctggtgcacctggcactctgatgactgcccctgagtactacgagttccggcatacccaggtgtgcaaggcctcagcactgaagcatggtggggatctggcacaagacccagcctggacagagatctttggtgttctctctgtggccaccatcaagtttgagatgctgagcacagccccacagagtcagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgagggtgagtggttgttgctcttcaacagtatcctcccctttccggatctgctgagccggacagcagtgctggactgcacagccccggggctccacattgctgtacgcacagagatgatatgcaagttcctggtacagctcagcatggatttcagctcctactacaaccgggtacacatcctgggggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgtt

SEQ ID NO: 1515 - DNA, 2601 bp, Homo sapiens
gatacaagcctgggccccagtccctagtcccaaaggggatgcccagagctcagttgcttgaaggcgatgggaaatctcgtcatccctctagggaagggcagggcaggcagggttgagagtgggcagaggattccacccccagctcccagaccatctgtggagtgcctccgggccaccagagcccttgcttcccctaaaatgccctgcaacccagccacatgtggtttttcctccttcaccacagccgcatggtcccctggcctcctctccacctccacccgactccagcctggctggacttcagtgtggctccacaacatgccccgtcccccagagctcccctctacacaaccaggtgctgcctcctccaaccagggtgatctctggcctggggtgctccagcgatcccatctgggacctctattgctggagggaggctgccaccacctggggcctctccacctactcacatggcaaatcccagccacggcatcttcccgaccacacctcagaggcttccttctggggagaccccacacccaagcacatggaggtaggtggctgcacattcatccaccctgacgtgcagaagctgctggagaccctcatcgccaagagagcactgatgaagatgtggcaggagaaagaaagaaaacgggccgaccacccgcacatgacatcactggggaaggagtgggacatcacgaccctaaatcccttctggaacgtgtcaacccagccacagcagctgccccgtcctcagcaagtctctgatgccacaaccgtggggaaccacttacagcagaaacgcagccagcttttctgggacctcccctctctcaatagcgagtccctggcgaccacagtctgggtttctaggaacccttcctcacagaatgcacactctgtaccactggataaagcctccacttctcttccaggtgaacctgaggttgaggcatcctcacagctttcccaggcaccgccccagccccaccacatggcccagccccaacatttcactccagcctggccccagtcccagcccccacctttggctgagatccagacccaggcccacctctcaccccctgtcccaagcctggggtgctcttctccaccccagattaggggctgtggggcatcttaccctacatcccaggagaggacacagtctgtcatccccactggaaaggagtatcttgaatggcccttgaagaagcgaccaaagtggaagagggttttgccctctctcctcaaaaagtctcaggctgttctgagccagcccactgcccaccttccccaagagaggccggcctcctggagccccaagtcagcccccatccttcccggggttgtcaccagccctgagctcccagagcactggtggcaaggaaggaatgccatccaccaggagcagtcctgtggccctcccagcagattgcaggcatctggggacctgctacagcctgatggggaattcccagggaggccccagagtcaggcagaagacacgcagcaggccctcttgccctcccagccttctgactttgcagggaagggcaggaaggatgtgcagaagaccgggttcaggagctccggaaggttctctgacaaggggtgcttagggtccaaactagggccggacccaagccgggatcaaggctcaggaaggacctcagtgaaggctctggacgaagacaaggaggcagaaggtgacttacggaggtcctggaagtaccaatcagtaagttccacacccagggacccagacaaggagcatctggaaaacaagctgcaaatccatctggccaggaaggtaggggagatcaaagagggctggatccccatgcctgtgcgtcgctcctggctcatggccaaatgtgctgttcccaagtctgacacccacaggaaacctgggaagctggcatcctggaggggtgggaaagcccacgtgaacacctcccaggagctttccttcctccatccctgcacccagcagatactggaagtacatcttgtaaggttctgtgtgaggcacagctggggtacagacctccagtccctggagcccataaatgtctggtcaggtgaggctcaggccccgcccttcccacaatccacctttaccccctgggcctcctgggtatctcgggttgaatctgtacccaaggttcccattttcctgggaaaacgtcctcagaatggtccaggagacaacagaacaacaagcaagtcagtcccgaccgtgagtggccctctcgctgccacaggggtcactgccaccaagaacgtagcagagagatgagagctctggcctgcagccctaaagccacccccaagggccaccactgtcctgtcaaaaacaggggcatcagagacagagacagcagttgggccccacctcccagggagcctgtgtccccagctggtccccaccaccacaggccaagaatggcaagcacctcgggcggcccccatccacagctgcaggaactgatgtctgcacagaggtgtcttgcctcctgaactagaccagtcttcttgcatgtctcctgggggagacagggggttctactcaaataaaactgatgcctacac

SEQ ID NO: 1516 - DNA, 1821 bp, Homo sapiens
acccccagcccagacttgctatctctcccagtcactcccatgcaggcccgcagccccacagccccaagcaggcacaggcagaaccccagcaggcaaaccacactcacactccaggcccaagcaccaacatgtcaggtttatttctccttcgctctcaactgagagcggggcatccaaatcataacaaaaccagggcccaagagtgggaagcggccccctgggtgggcctgaaccccaatttcacccttcccccgggcatagggcccaggccaggacgctcacccgaatgtggctgggactccttgtgccctaggcccacggggcggaggcagcaccaacattggggatggtcccccaagaacagaggaggaagcccagcctccggcaggcagtatccacatccacgcccacctgctcaggcctgcagcctccagacctctagcgacaggtctccagagccggccaccaccaggttgccctcagcacagacctgggaagggggaggaacatgaggagtcagggacgatggcgctctggccagctgggcagggcacatggggcaggaccttaccctattgagcccattgtcatgccttcgggtgcaaatggtccttggtgggtctgtgggcacgtgcacctagtgaggggcaatgggcgaggtcaagaggtgtgcccctggctgatggaggtaggggagaggcagggactgtcctggggtgggggctgggcaggagcctcacccggatggtcttgtcagtggatgtggtgtacaaggctcccacggagtactggatcccagtgatgggaaagctgtggcccacatcaaaggactgcaggaggaggatcaggcaacactcagtcgaggctctcccaaggcccgccctcccccacaccaccaggggctcgggtaggaaggaagcccggggggagggacagtcaggggcaggagctccagcagacccggataagctggaagcagccgttgcggttggcgaagacgtgcagcaggccctggttgtcaccagcccagagctggggttcctggtaggacatgcagagcaggtaggagtccagctacgagagggacaagggacgggacagctcaggccgggctgggcctgcaacagtccccatccctccaggcccctggggagggcccacctgcagacgctgcaggacgctgttggctcggcggtccaccaccaccagggtgtggtcctcgctgcctgagatgatgtgccggtcatccgccagcagggtcagcacgggtctggagtgtagttgctggtgcttcaacagggctgggccggcttcatgggtgatgggccggtgaggagggatatcagagcccctcgaaggccccccccagcccatgagagcatcccgggtctccatcctgtctggcaaaaccctcgatctgctcattcccccaccccacagagtgacccatctctcctctcccgcctcaggtaaatccaggcttccacaggagccccaggcctctgcccatccccgtccacatcccatatccctcctccgatcccatctactgttcttagcacagagctgaccaaggtggtctcagtcttgcatccaccctcaggttggcctgaaacatgcctatcccgcagccccgctccagctctgcctggacaaggtacactggcccttcaattaacaaaagtagaatgaataaataggccaggcacagtggctcacacctgtaatctcagaattttgggaggctgatatgggcagatcatccgagcccaggagttcaagatcaccttgggcaacgtggcaagaccccgttctccattt

SEQ ID NO: 1517 - DNA, 1892 bp, Homo sapiens
agactgtcattttgaactttgtctcactctgaaagcagaaaatggccgaaaggttttggcaagcaaccttcttgggagaaatgcaaataccattgatttttcgaggcctctcatggatgaagacatgctcctttttacaagtgtggtcaggttccctgataactctttgtatgatcatgtggttgcagtaccttgcaggaacgggaacgtcattctgagggtagtccacatgcaagtgttctaaagttgacatcactgcttcatcattcacctcattttcccagaacagaagcaccaagaaaattatcaccattattatcatcagagtgcagatccttttttaatagcgagaacatttaaaacctactcttcgaataattttgaaatctacaaaatggcagcatggcccaggagtgtgactggcagtgaaggagctgggaagaccttggatgcaggaaggtcatttaaagcaaaagattaagaagcagcaatgcccctcttgtggcaagagttggcagcgtgcggttggtatgtcaatgcatccaaggtccaagggcctggattgtctgccaaatgcttgggagttgtttgatcaggttgacatgctccaacagcattgtggactgggcccacacctacgctgaggtgaccaatgtctccaactgttggatctgctccaccttccagcagcagctgcggagagtttgccctggaacgcgtatcctgcttctgttaagaactggacatggctagaagcttggggtcccacggacaatgggtgggatgccacagggcgggctttggataggaggcatcacaaaacccatggcaaacctggcccttggctgactcatagtgtccatgatggatggagctggctaatgggagaacacgtggtgcccccattgcaggtatcacaatgtatagagcagcactggggtaaagtcactgtgggatggttgcctactgaggtttgtgcaaacataacatgtgtcaccacaccaagggtgcagtggaacaagcggccttacgaaggccaggcccccatggactttgtgccccctgggagtttatgggtctgtggggacacaggatggccatatctcccagccaactggactggacattgtacctggggttggccctatgtgcctgccactgggcttcccacattgcctagtcgccacataactgggagccactgtgttcctgctttttcccagtgcagcaggccctctagtggttctatcccttagcaatgactatccctggagcaggcgtcattactatagaaaagcaagttgcagcctttgcagaccacacagctcggtcccgagttgccctccttttgttaactgatgaagttgatcagatcaggaaggtggtgctgcaaaaccagatggccttagacatagtcgcagctgcccaaggtggcacctgtgcccttgtagggacacaaggttgtacatttatccctgacaaccactggaatataatggcagcttcacaaggggtgtcataggagattaaggtgattgagcaccttactgatgaccccctgcagagatggtgggcgtctttgggatctggcctacaatgggctctcataatcataggtagcatagcaggaatattagtggtaggttgttgctgtctgtgttgttgctgtggcctatgggtccagggtgctgccacatgtgcatgggtccccaccaagaggattccctggcctagagggtggagtgtaaggaacatggctgtgtgcaggcaagcaggcataggccaaggtaaacagcctagatgactcagtgggattggggcacaagtgcacagtcccatatcttatataatcatagccgtgtaggcacaacataaagaagctccccacctgg

SEQ ID NO: 1518 - DNA, 2231 bp, Homo sapiens
acgacgtgagcctggtcggctgggcgggaaaccctgtcgtgcgtcgtggcaggtgagcggtgatgaagaaagggcggaagctcccgcttgagggtagacgccacggcctccgctcccgcgcgttgttgtcctgccttaccgcgcttggaaactctgacttgcgagccctggtcagagaggagcctggaggggccacctaagctctgcacaaggaattcatccaactctgtagacaaaatataaggaaaaagaatatagacaagcatggaaagtgaagacacaaagaaaacacaagaaatgaagactgacctgaacttattattggagtgtctaaagtatcaaatggacaatgctttttcacaaaaggaagctttggtcactattcattcaatttgtcaacaaaacagtaatgcaagtgtttattttcgggaaattggtggtttgatgtttgtaaaaaatcttgcaaagtcaagtgaacatagcatggtaaaagaagcagccttatatacattaggagctattgcagagaaaaatgtttactgtcagcagactttgtgtacttcagagttgtttgaagacttaacttggttcttatctaatgattcaaacataaatttgaaaagaatgtctgtttatgttattttggttctggtttcaaataataggaccggacaaacacttgtgagagaaacaggttgtattacagttctgtcacggttattcaggacagttatttcaaaacatgagttggatttgtcagataaaaatgttttccagagttatcagttgtggtcttcagtgtgtagtactctgtgtgtctgtgtcaacaatcctcaaaatgatgagaatcaaatgttttgctgttccctttttccacatgctaatgaatggctaaaaaattgcacgacacctgagataattcgccctatttgctcatttattggactcactcttgcaaataacacatatgttcagaaatacttcgtatctgtgggcggactggatgtattgtctcaagttctcatgcagctggaatctgattcacatgagactctttccagtgctaaacttgcagtggttgtgacgaagactgtggatgcatgcattgctgataatcctacttttgggatagtactctccaagtaccacattgtttctaaacttctggcattactgcttcatgaaagtctggattcaggagaaaaatttagcatcatgcttactcttggtcattgcacagaggattgtgctgagaaattatctctaagtctaggagaatatccttttgatgaaaatgaaacacagcaattaaaggacataagtgtgaaggagaataatcttgaagagcactggaggaaagcaaaggaaattctacacagaatagaacagcttgaaagagaaggaaatgaggaagaaatacaaagagaaaactatcaggataacatttcatctatgaacataagtattcagaatacatggaaacatctccatgcagatcggattggtcgaggtagcaaagcagaagatgaggataaaagccattctagacagttacagagttataagtcccatggagtcatgtctaaagcatgtacaaatgatgaccaaatgaagacaccgttaaagagcgcaaatccagtccatgcttgttacagggagagtgagcaaaataagactttatataaagccaagtcaagctgcaatcaaaacttacatgaagaaactacttttgaaaagaattttgtttctcaatcaagatccatttacattatgttcagatataataaataaagaagtagtcagttttctagcaactcccagttgttccgaaatgttgacgtataggtgctcaggttgcatagcagtagaaaaatccctgaatagccgaaactttagcaagctcttgcactcttgcccataccaatgtgatcgtcacaaagtcattgtggaagctgaagacagatataaaagtgaactaaggaaatcacttatctgtaacaaaaaaattctgctgaccccacgtagaagacaacgactcagtaatgaatctactacccctggaggaataagtgaatatatttaatttttaaatgaacttaaatttcatatatttctgagaaagaacagctgagtggttgttctcagtcttattattaatggatcttaaatgataaaccttgcctctgatgagggtcagaccttctaataaaagagactttcctcttcccttc

SEQ ID NO: 1519 - DNA, 2324 bp, Homo sapiens
ataagcttctgaacaatgatgaggatggtggcatttgacattcggtcaagggatggagcaggaaagcttgagatacacaacccatatctttaaggcactttccatctggtagagaaacggaaatgtatgcacatagcggcacatgcgatggcaacagaacccagggcctgtgccaggcctaccaaggagtgagctgatgcggctgagagttttggaatgtgaggctgggatgacaagcctggggcctggctcttctgtgctcagtgaggactgctccagcctcagccccaactcccagcaaagcccaggtgtggggagcaggggaggtgagacagagatgaggagggacagaaatgtggtttcacacctgacccagcaattcctgcagctgggaagcatggcgactcagaaagccgatgcctgcccgaggcttcggcttcttgtcccgcgttttggagaccatatctggagaggcacagtgtgaggggcatggggaggcaggagtaggactgcagcagagaggggttttgcaaccagcctctggctggtcagcacaggagtgtcaggttctttgctgtggggctgctggggatgagagaggcaggaagaacccctgtgaagaacagtgagaagggtaggggccaggggcctgcagggtgatggcaggctttgaagggtgtgaaaggctgccacagctgaggcccggctatacccaggagggagcaagcagcctgatgcctgggctggcctggcccattcacctcttgtggcccaacctgagaaccttcttactgtgggtgagctgggccttgtctagcccctgcctctgcgcccccatcactggcctcaaaagcacaggttctctcttttcttgcacggtgaggaggcagagagtggtgcaggctgggtgtgcgggtctgtgtgtcagggggttattggtgagaatctggggagaggcgcctggatagctctgattctacccacctaggaggtctgagaccctcccaactcctccccgactcccagcctcagtgttgtcgctgaaaccctcttgagctgatggtgcctacgcagggtcaaatgcattcttctcaccggcctcggccccaacgtgtcatgtaacctcgtgttagtcactcaacctctttggccttgtgcttccacgtctgtaaaatgagaagttgcctccgcccacacctttgcccctccccaccgccaacccacacttgccccagacagagctggcaacaaaagcagactgcggagtgggagggactgccatggcgtgggcctggaaggaggagagaggcaatgcctgcggccagaccttcgctcccctcagagcagccctgaaaatattcccggctggtctttgcctctccacggtcacagcagcctcgtgatgaagatggcagggggaattctacagagaggacaggacttccttccatcttctcctgctcatagctgctgcctgggatccactcatccccttcttctctccttggcctcactctgcagtgggggtgctcactgactccagggttcagccactgtctgcatgctaatgagctaaggagtcccacacctccaccaccagcccagcactcaactccatgggccccagggctgggccccagggcgggaagggatgtggtcctccccctgaacacagtgcatggtgcctcctggggctgcgcagggaggaggccttgcccggacctctctcctgggcaccaggaacctctggccaactgcctacaggacatctccacctggatgtcctacaggccctcaaactcaacctgacccccgcccaagcacctcagctcctttcccttttcataatggtatcattctcccagggactcagtcttcacacctttgccctttttgatgccccttctgcctttctctcacttctactgtcttcccaagtcctgtcggtcctgtcccatgctgtcccttttctccatcttttctgcccctggatcacgtgtcttattttctagtgatcaaacatgtttacagcatgtgttagatggctggctctgctctaagtgccttacaaatcctaactctcctcattctcacaaccttcagtttacagaggatgaaactgaggcacagagaagtcaagcgtcttgtgcagggccaggattgggacccacgcagcctgctccagagccgggctctgaccctccacaagagccatcactaaagttccacttaccgctgcaccttcaatctcttcctctctctatccctcccacatgttcacagacaaaatcttcttccttatttaataaaacaatataatgacc

SEQ ID NO: 1520 - DNA, 2054 bp, Homo sapiens
gatggagcccagcatgctgtcttggctaattgtcattttgactcagtagcaaactcaccaggtgccagtgatgatgcagttagctgctcagtgatgctggaagtccttcgcgtcttgtcaacatcttcagaagccttgcatcatgctgtcatatttctctttaatggtgctgaggaaaatgtcttgcaagccagtcatggtttcattactcagcacccctgggctagcttgattcgtgcattcattaacctagaggcagcaggtgtaggagggaaagaacttgtattccaaacaggtcctgaaaatccttggttggttcaagcttatgtttcagcagctaaacacccttttgcttctgtggtggctcaggaggtttttcagagtggaatcattccttcagatactgactttcgtatctacagggattttgggaacattccaggaatagacttagcttttattgagaatggatacatttatcacaccaagtatgacacagcggacagaattctaacagattccattcagagagcaggtgacaacattttagcagttcttaagcatctagctacatctgatatgctggctgctgcttctaagtatcgacatggaaacatggtcttctttgatgtgctgggcctgtttgtcattgcctacccctctcgtattggctcaatcataaactacatggtggtaatgggtgttgttttgtacctgggcaaaaaatttttgcagcccaaacataagactggtaactacaagaaggacttcttgtgtggacttggcatcactttgatcagctggttcactagccttgttaccgttctcattatagcagtgttcatctctcttattggacagtctctctcatggtataaccacttctatgtctccgtttgtctgtatggaactgcaactgtagccaaaataatacttatacatactcttgcgaaaagattttattacatgaatgccagtgcccagtatctgggagaagtattttttgacatttcactgtttgtccattgctgttttcttgttaccctcacttaccaaggactttgctcggcgtttattagtgctgtctgggtagcattcccattgctcacaaagctctgtgtgcataaggacttcaagcagcatgattaacttcatctaccttgccaagagcacaaaaaaaaccatgctaactttaactttggtatgtgcaattacattcctccttgtttgcagtggaacattttttccatatagctctaatcctgctaatccgaagccaaagagagtgtttcttcagcatatgactagaacattccatgacttggaaggaaatgcagttaaacgggactctggaatatggatcaatgggtttgattatactggaatttctcacataacccctcacattcctgagatcaatgatagtatccgagctcactgtgaggagaatgcacctctttgtggttttccttggtatcttccagtgcactttctgatcaggaaaaactggtatcttcctgccccagaagtttctccaagaaatcctcctcatttccgactcatatccaaagaacagacaccttgggattctataaaattgacttttgaagcaacaggaccaagccatatgtccttctatgttcgagcccacaaagggtcaacactttctcagtggtctcttggcaatggcaccccagtcacaagtaaaggaggagactactttgtcttttactcccatggactccaggcctctgcatggcagttctggatagaagtgcaggtttcagaagaacatcctgaaggaatggtcaccgtggccattgctgcccactatctgtctggggaagacaagagatcccctcaactggatgctctgaaggaaaagttcccagattggacatttccctctgcctgggtgtgcacctacgatctctttgtattttaatcttgtggatgagctctaagtacatgcccagtggatactccatgtgacatggtttctccctatgttacgtggatgtttgtaacgtaagtcaatgaattttaatgatcat

SEQ ID NO: 1521 - DNA, 1880 bp, Homo sapiens
ttatacctcagggtgctgaccctcttgacacccctgtagaagttgtataaaaccaattatgtccccaactagactataaaacccatgagagccaggaccatccttactgtttaatgacatgctgacctctttctgtagttcagacatggtactaagcaacatgatgcaaggattatttgataccagcatacacagtataatcaagaggagtattagtctacaaatttcagagtatatggctgccttaagtaaccatggtccagccatcattactgaatttcagataaaggccaaacagaacatatttaagttaagaagagtccaattaaaaatcataccacctattggccaggcacagtggcatacatctgtatgtagttccagctactcgggagattgaggcgggagaatcacttgagccccagaggtcgaggctgtagtgacccgtgattgtgccactatactccagcctgggtgacagagcgagaccctgtctcaaaaaaaaagctgaggggcgggggtggaaataacttattaacaagtcagacctacagtttcctttcttctctagtttgagtatttctagactccagatataaatatttcttctggccgagcacagtggctcacacctataatcctgacagtttgagaggctgaggcaggaggatcatttgagaacaatagttcaagaccagcctgggcaacatagtgagaccccatctctacaaaaaaatctaaaattagctgggcatggtgaggcacatctgtagtcctagctactcagaaggctgaggaagcaagatcgctagagtccaggagctcaaggttatagtgagctatggtcacgttactacactccaacctgggcaacagcgcaagaccctgtctccaaaaaaataaataaatatttcttccatcttcataggaactctccggagtcctttctgtattgttgtgattttgcttctggagctgtggagctcgtaaagtcacactcgtcctacagagcaacccagtgttttgcctttgttcatgatgtatgtgatgatggcttaccttacccttttccagatgggatcctggatgtcattctccttgtctttgtgctctcttctattcatcctgacaggatgcaaggtgttgtaaaccgactgtccaagttactgaaacctgggggaatgctgttatttcgagactatggaagatatgataagactcagcttcgttttaaaaagggacattgtttatctgaaaatttttatgttcgaggagatggtaccagagcatatttctttacaaaaggggaagtccacagtatgttctgcaaagccagtttagatgaaaagcaaaatctggttgatcgccgcttacaagttaataggaaaaaacaagtgaaaatgcaccgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcccttttctgtgctttgaaaacttgatatgctcaagcttgtttgaatttattacatctaaccattttgcttgttccttgatttttataagcattcaattaagttagtattatgtcaagtaattttgagaaaatgtaacttgacattttttgcaagtaaaaaaaattgtttatttgtttaggcttagtaaaccagttcccaaacac

SEQ ID NO: 1522 - DNA, 2225 bp, Homo sapiens
gtgttgctgcggagaggtacttggatgcattttacaggttagcctcacttgagctgttgtcctgcaagtaaagtgtatttttggtgattgaaagttggagaactttcatttcagctgagtggtgtagttgaattggttcctgtagccgctgtccctaaacccaggccgacgttaccgccttgtgtcctgactgctagctttcgacgggaccgtctttgagggactcatgtaaagtctctcccttaatgctcagttcttagaagaccgaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtgctccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacgtgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatccccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagacctg

SEQ ID NO: 1523 - DNA, 2161 bp, Homo sapiens
gcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcagaaggatgaggaagttgtcttttgcttctcctcattccaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaaccttttttttacagagcctaattaataacttaatgactgtgtacatagcaatgtgtgtgtatgtatatgtctgtgagctattaatgttattaattttcataaaagctggaaagc

SEQ ID NO: 1524 - DNA, 2169 bp, Homo sapiens
agtaacaaagaattccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgagggggtccagaaagcaatcatggaccttgtagatgagtttaaagatgaatttcccaccatcctaagattatcacagtctaatcaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgagaattgtagaaaagccttttctgagcctgtgctttcggagcctatgtttgctgaaggtgaaatcgaagcaaaaccttataggtcattgccggagaagccagacatttcagattaccccaagcttcttgctaataagcagagtaataacatccaagttttacattctgtgtttgaccaatcagctgaaatgaatgagcaaatctgaatacaggcattcaaagaacattggctcactgaataggagactttacatctctcatggctgggcagcagctgtgtctggcttccttacttcaagatctgccttgatcacagatcacttaacagtggttaagtttcttattttcaagttcagcaggggcaaactatacacggtcgtccatcaaaatcctggggaagagaataactcatttaatattctgacatgtcaaatgttcttgatagactctgaagagtctgctgcagaagaaccaggttaaaaaaacagtaggtctaaggggttggggtgacaagattctgcatgtctaagaagctcccatgtgacaccaaagttgctggtctatggacaacagtttgaggagcaaggtcttcaagctctcattatggactgaaactggagaaaattctatggaactattatcagctcacacatataaaaactggtcactgagatgacagctgagctgaaatgcccaaaatgcaaatgaactagacatgccaacagcttggggaagagaattccatactgaaagaagagcaaatacaaaagcctgaaggaaagaaaagtcttggtgaatgtgttccagaagactggaacataatatgcaagattggtaaacaggcaggagccaggttgtgcagtgctgtgtatggattttactctaagagcaaaggaaagccactgaagagtataaagcaggaaagtgtgaattgatttctttttgaaagaatgcccccggctctgtggagaatggattatagcaaaacaacaatggatgcccagaaatcagaaagctaggggtccatgaaaaaggtggtggcttgccgcagggggttgatgctgtaggggataaaaagtaataataacagtagcagtagtagctacaattatattgtgttaactatgtgccaggcactattcaaaggctacatttatttattaactcctttaatcctccatgttactaaaaaggtattattttaattttatagtacagagaagttgggttgatgaacttgaatgaagatgctacagaaaaataaataaagatgactcccaagttttaggtttgtgcagctaggtgaactgtagtgccaaagactgtgaggagaaaggccaagaaatgaatggtatttttgcagaatggaaaatcaagagctatatatattttacacatattgagtttaaggtatctcagagacatccaagtagagatgtcaagtcaacaaccagatatatgagactaaagtcaagaatttctagagagaaaaactggggagtttccaggtcatagaattctatggactcacttggagaggaagtgtagataaggaagaaggtctaagacaattcctgaaacacttcaacatttagaggtcaggtggaagagaggttgtagagaggcaagatcagtagagtgtccaatctattgctaatcaaatgaaattcattcacagcttt

SEQ ID NO: 1525 - DNA, 1773 bp, Homo sapiens
ggtttccgctcggggcgggcgatagagacagcgcgtcgcgcctttagcttctttcccagactccggcccagctcctgcgatctccacagcagcctctgaggccgcccccagagagcatcaggatggctgaggaaaagggtggaaagcaagtcctggaagaatctgcatttgaagaaatggaaagagattttcagggagttctccatgaactttctggagacaaaagtttggaaaaatttcggattgaatatgagaggcttcatgctgtcatgaaaaagtcttatgacaatgaaaagcgtctgatggccaaatgcagagagctaaatgcagagattgtagtgaattctgcgaaggtcgccactgcccttaagctctctcaggatgatcagaccaccattgcatccctaaagaaggaaattgaaaaggcctggaagatggtggactcagcctatgacaaagagcagaaggccaaggagacgattcttgctctgaaagaggaaatagtgaacctgaccaaactagtggagcaggggtctggactgtcaatggaccagcatagcaacatccgagatttactgaggttcaaagaagaagtgacaaaggagagagaccagctcttatcagaagtggtaaaattacgagaatccctagctcagaccactgaacagcagcaggaaacagagcgatcaaaagaggaggctgaacatgccatcagtcagttccaacaagaaatccagcaacgtcagaacgaagcttcccgggagttccggaagaaggaaaaactagagaaagagctcaagcagattcaggcagacatggacagcaggcagacagaaataaaagccctgcagcagtatgtgcagaagagcaaggaggagcttcagaagctggagcagcagctgaaggagcagaagatattgaatgagagagctgcaaaggaactcgagcaatttcagatgagaaatgctaaacttcagcaagagaatgaacagcacagtttggtctgtgagcagctatcccaggaaaaccaacagaaggcgttggagctcaaagccaaagaggaagaagtccatcaaatgcgccttgacatcgggaagctcaacaaaatcagagaacaaattcataagaaattgcaccacaccgaagatcaaaaggcagaagtcgaacagcacaaagaaaccctaaaaaatcagattgtgggattagagagagaggtagaggcttcaaagaaacaagcagaacttgacagaaaggcaatggacgagcttctaagagaaagggacatactaaataagaacatgcttaaggcggtcaatgcgacccagaagcagacagacttggtaaagctccatgaacaagccaagaggaacctggagggagaaatccagaactacaaggatgaggctcagaagcagagaaagatcatctttcatctggaaaaggagcgtgaccggtacatcaaccaagccagtgaccttacgcaaaaggtccttatgaacatggaagacataaaagttcgtgaaacacagatttttgactacaggaaaaaaatagctgaatcagagattaaattaaaacagcaacagaacctatatgaagctgtgagatcagacagaaatctgtatagcaaaaatctggttgaggctcaggatgaaataacagatatgaagagaaagttaaagattatgatccatcaggtagatgagctgaaagaagacatctctgccaaagagtccgcacttgtgaagctgcacctggaacagcagcgaatag

SEQ ID NO: 1526 - DNA, 3201 bp, Homo sapiens
atatgatgatccgggggcctctttgtatttggtgcctacttaccatgtactggggggcttgaggcaggaaggaccaggagcacctgggactcagaatttgagcttgtctttttgcccttgggcttcctgccctggagtcctcaggcttcttttctggagcagcaagtgtccagggacagctggggccttatctagaggcaccaggtccttgggtctttgactgccctgagctcagtagccccacccctcagcctacagccactaaaccccagaacctgggcccttccctgcccccattcctgcggccttcattgctgcatccggtggaggcccagctgggggccggtgctggagttacctctgctccatgccattgcagatggacagatggttccattataaacttcatctcctgggcaccaggcaaacctcggcctgtcggcaaggacaagaagtgcgtgtacatgacagccagccgaggctagactcagcgaggggtggacctgtctccatggtccagaagacttgaattcggagctggacacaggccctgagcctctgcccagactcctctcagggcatgaggctgagtgtgctgccagccatgccctgccctgctctgccctgggggtgactgccctcccctcccctttccgcagaggactggggggaccagaggtgcctgacagccttgccctacatctgcaagcgcagcaacgtcaccaaagaaacgcagcccccagacctgccaactacagccctggggggctgcccctctgactggatccagttcctcaacaagtgttttcaggtccagggccaggaaccccagagccgggtgaagtggtcagaggcacagttctcctgtgaacagcaagaggcccagctggtcaccatcacaaaccccttagagcaagcattcatcacagccagcctgcccaatgtgacctttgacctttggattggcctccatgcctcgcagagggacttccagtgggtggagcaggagcctttgatgtatgccaactgggcacctggggagccctctggccctagccctgctcccagtggcaacaaaccgaccagctgtgcggtggtcctgcacagcccctcagcccacttcactggccgctgggacgatcggagctgcacggaggagacccatggcttcatctgccagaagggcacggggctctcggcggtactcctgggtctcagaggagccgctgaactacgtgggctggcaggacggggagccgcagcagccggggggctgtacctacgtagatgtggacggggcctggcgcaccaccagctgtgacaccaagctgcagggggctgtgtgtggggttagcagtgggccccctcctccccgaagaataagctaccatggcagctgtccccagggactggcagactccgcgtggattcccttccgggagcactgctattctttccacatggagctgctgctgggccacaaggaggcgcgacagcgctgccagagagcgggtggggccgtcctgtctatcctggatgagatggagaatgtgtttgtctgggagcacctgcagagctatgagggccagagtcggggcgcctggctgggcatgaacttcaaccccaaaggaggcactctggtctggcaggacaacacagctgtgaactactccaactgggggcccccgggcttgggccccagcatgctgagccacaacagctgctactggattcagagcaacagcgggctatggcgccccggcgcttgcaccaacatcaccatgggtgtcgtctgcaagcttcctcgtgctgagcagagcagcttctccccatcagcgcttccagagaacccagcggccctggtggtggtgctgatggcggtgctgctgctcctggccttgctgaccgcagccctcatcctttaccggaggcgccagagcatcgagcgcggggcctttgagggtgcccgctacagccgcagcagctccagccccaccgaggccactgagaagaacatcctggtgtcagacatggaaatgaatgagcaacaagaatagagccaggcgcgtgggcagggccagggcgggaggagctggggagctggggccctgggtcagtctggccccccaccagctgcctgtccagttggcctatggaagggtgcccttgggagtcgctgttgggagccggagctgggcagagcctgggctggtggggtgccaccctcccacaagggctgggctgagacccagctgagtgcagcgtggcgtttccctttctgggggggcctgaggtcttgtcacctggtcctgtgcccccacaggaaccagaggtaggatgggagggggaacgagagcctctttctccccagagcccccggcccaggcctgttgatccgcgccccaggacccccttctttgcagagcccgaggagcctcccctgtcccctcgggcagatctgttgtgtctctcttcccacctggcagcctcagctctgtgcccctcaccctgctccctctcgccccttctctcccaccccttccttctgagccgggccctggggattggggagccctcttgttcctgatgagggtcagctgagggggctgagcatccatcactcctgtgcctgctggggtggctgtggggcgtggcaggaggggcctaggtgggttgggcctgagaaccagggcacgggtgtggtgtctgctgggctggagataagactggggagagacaccccaacctcccagggtgggagctgggccgggctgggatgtcatctcctgccgggcgggggagggctctgcccctggaagagtcccctgtggggaccaaaataagttccctaacatctccagctcctggctctggtttggagcaaggggaagggttgccagagtcctgggggccccagaggagcaggagtctgggagggcccagagttcaccctctagtggatccaggaggagcagcacccgagccctggagtggcccagtacccttccaagaggccacagtcccagccaggacaaagtatgcggcccatcctggtgcgacagcgtgggacaatgtgaacatggactcgaagacatggccctttctctgtagttgattttttaaatgtgccattattgtttttaaaaaaaaaggaaaaaagaaaagcaaacaaataaaacacctttaagaggcttgaaagag

SEQ ID NO: 1527 - DNA, 2991 bp, Homo sapiens
aatttatcattaaaagccaaaattgtttttattaaacatagcaattaagtctgggagcttgactaaccacagaatagattcaacacacactgagggagatggtaagaaaaactcacttatgtgagccaaacattgcatgtagttgtaccaaccagctaaacacgataagctacaaagaactatggttttcactgctctcaaaacactattaagatttccaagttttaaccttatttcaagattatttataggtgattccccaattgggaaagtaatttctggatttcttctcccctaaaatagatccagaaaaattaaaaaactttattccagtaagaaagtttgggatgtactgcctcaggccctgtcctaaggaaattatcaggcctggagggtgggtgctatcaactgcctgccaccatgttaccttcaggcatccagaagcttccctgtgccagatggagccaccaatgtggggaggagagcacaaagggcagagaatccacagaaaccatacctgcagggagcaaacaccatcacaccccactgctgtcaatgcaaacacatttacctaattcatcttttgatctccctgatgcaaaaaaggaccggctcagttcatagccaccgaagaagaagaaatagcctggtacttctcgaagtaaagtgcttgagagtccatggtagaaccccaaggggccatctttcctaagaatacttttgatgacagaccacactgtactgggaggagacacagagagatagcacggttacagcaggtgggaaggaagaaaagacaagggcatttgcaaccaattaacagatctgatcaagcactagtaaggaagaagctgattttgtaaatgaagagccaggaattaagactcaacggcatccttctgtgggaaggaaatttatttacagtaaggaattatctaaactcagcaaacataaaatggcattgtattgcccagtcccttatcgctgtgattcctatttcctcaatctttctggtgtgtttttgggaaatttgttcaggtgtttacaggatctgtttttagtgcagagaaatgagtgaaggagtaaatgttgtctgaagacaagacaaattctgagaacaagttatatagctcctgttatgcagaagcaccaagaatttatttctcagagcaccagggatgcgggagaatttcttctaagcagccctgctcctgtagcagccagaacacaggacactctttgtctgactccccttcatgattgagggcaaccagggcaggtttatccctgctaagaacaggccaagaaatcacatactcagtgcaacttagtgaatccctctctcctcactttgttctcagcaagaaggagacttggcttggacagatgaaggatcaagtcccaagccggcacttcacgagctccgtggggcagagcaccagtgcagcaaaggcagaggcgaaggaaccggcggctgcattctgcagatcactgaaagcacacaagcagacagttacccctcagtttcttcattcctttggcactcaccacacaggcagcactttggtgataaagcagggctaaggaagcaagaaagtggaggggcgggcagagccagatccagtggtttcactcatgcaagacagaagtcactgtctatcctgtggctggaggggctactttgctcagaagacacaggtcttccccagaatctcacgtggctgcttactgtttccctgtcttctctccccattttgtcctttgctaaggaaactgaactgaattccaggtcttctctaatagagtgtctctccttcaacagggaacaaaactacagttgcctgtagtttttgcttctgttcagtctccatcatggcatgccatactctcctggtttgtgccctgcttgtttctttactgccttcctgcctgccctttctgtgctggaggctcatcccattcatgctcagccctcctcgctgtctacactgtcttcttgggcaatcgtatctagtcccaagcctttttaaaaaacaagctctacccatcatggtggaattcctgtctataaaagggcacaccttcagacctccaggcacctccagagaacagtgctgtgcacaagaaaccgaattcagttgtgtgggacctgcagctgcaatcaggtttcaaactcctactgaaataactaagactgccctttgcaatcttgaagcttatataataattttaagtggtataaaataaatcaacattcaaagcagggatagctaaacatcccagtggtttccaaattctgtttagtctctatataataaatacccaaggcaagaccaacaaagaggcaaagtctgatgttttgggaagatttggacagagaaaggtgggttcccttgcatcttcgcagacatttccgacccttcctaaaactcctcaagttcatctggctcagacaacctcttccaatactctgctttttgctaatgaaagaaaagctaaatcttggatcataagcagcatctacagtttcagtgcagcatgtctgctgacgagaggtagcactgccagctgcatctgaacagcattctcctggagaaaactgaaacagaagggcggttcattctcagtggtggatgatgagcaggtctcctctgtggtgtgcatatgtggtttctaagttttatatgatgacaatgtataacttcataaataaaaggaaagcagttatttttaaaaaaggaaatgttcttccacataaggcaccagtaaaattgtgaccatacaacagtagattttttttaatttttatttttttgtagagatgaggatcttgctgtgttgcccaggctggttttgaactctcagcctcaagccattttcctgcctttgcctcccaaagtgctgggattacaggcgtgagccaccatgtcttgccagttttgtggggtttttttaaacaaataaaaaaagtgtgtgtccttgactcacctc

SEQ ID NO: 1528 - DNA, 1607 bp, Homo sapiens
ctctctgtccgagcagcagcagcagcagcgggaggacgaggacgactacgaggctgcctactgggcatccatgaggtcgttctacgagaagaacccgagctgctcgcgcccctggccgcccaaacccaagaacgccatcaccattgctctctcatcctgcgcgctcttcaacatggtggacggcaggaaaatctacgagcaagagggtctggaaaagtacatggagtatcagctcaccaatgagaacgtcatcctgaccccgggcccggcgttccgcttcgtcaaggcactacagtatgtcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcagggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggttaggttccatcgcagcttatggctttaataaaaaattcagtagttaggggcagggaggagaaataaagtggtgatagtctggtgttacagaagccacttcttttggctctctaggataattagataggtatttcagaaaattggaccttaaaactttgcttctttggaaaggttttctcctgattttttggaaaaccttttgaaccctcaagttaccatcaaactacttctctttgaactaccaatactgttgaatgccattacacctatctctgtgtaagtcataatgatgactctttaggataagtttagaacttgaatatttgcatgcttaaggcactgttttagaagcttacttagttttataaacactgctcatttttggatgtttgtagataacaatgaattgttacccatcagcattgtagaatagtgtcttcaaaggtagaaggagtatggttaagcacactcttgaaaactggagctttgtattctgtgactgctatggctagctttgtaaccaaagcaaaatgagaatttcactctacctgcatgagtataacaattttgatactgctcatttagaaataaatcatctggttgttc

SEQ ID NO: 1529 - DNA, 2442 bp, Homo sapiens
cttctcctccctcagactcaggagtccagaccccagccccttctccctcacacccaggagtccaggcctccagcccccgctccctcagacccaggagtccaggccccagatcctcctccctcagtcctaggagtccgggccccagcccctcctccctcagactcaggagttcaggccccagatcctcctccctcagacccaggaataccccccagctcctcttccctcagacccaggagtccaggtccccagcccctcctccctcagacccagtggtccagagtcccagccctctcagcttcaagtcccttgagggtggggtttgggggaagcttgctgagttctgtgttcctccaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggtggtccaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggcggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttacc

SEQ ID NO: 1530 - DNA, 2337 bp, Homo sapiens
cagtaccggcctcctccagcagggggcgctgtgggatccgccgctgtccgggacgaaccagcaagccgctctcggtccacacacgctctgtctgcctgccccgagtcccccgggaggccgcggggtttggggaagtgtttctaggagacggcgctcaccggctgcacctgcgccgttgacgccaccggggccggcagacagacccgcggcgctggctggtggagggagttcccgcttgctctctgtcgctgtcaccgccctgtttctgtagccgtatggtacgcctgtgagaccggctgccggctgacgtctccttgcgatggagcatatccggacgaccaaggtcgaacaagtaaaattacttgaccgattcagtaccagcaacaagtcattaacaggaacactgtatcttacggctacacatctattatttatcgactctcatcaaaaagaaacctggatattacaccaccatattgcctcagtagagaaacttgctttgactacttctggatgcccccttgtgatacagtgcaagaacttcagaactgtgcatttcattgttcccagagaaagagattgccatgatatttacaactctttgctacaactgtcaaaacaagcaaaatatgaagatctctatgcattttcttataatcccaaacaaaatgattcagaacgactacaaggctggcagctcattgatctcgctgaggaatataagaggatgggagtgccaaactcacactggcagttgtctgatgccaaccgggactacaagatttgtgaaacttaccccagagaactttatgttccccggatagcaagcaaaccaataattgttggtagttccaagttccggagcaagggaagattcccagttctttcctactatcatcaagataaggaggctgccatttgtcgatgtagtcagccactctctggattcagtgccaggtgcctggaggatgaacatttgcttcaagccattagtaaagccaatccagtcaatcgctatatgtacgtcatggataccaggccaaaactgaatgcaatggccaacagagcagctggaaaaggttatgaaaatgaagacaactattccaatattagatttcagtttgttggaattgaaaatattcatgtcatgaggtccagccttcagaaattattggaagtcaatggcactaaagggctttctgtcaatgatttctactccggtttggagagctcgggatggcttcgccatatcaaagctgttatggatgctgcagtcttcttggccaaagcaataacagttgaaaatgcaagtgtgttggtgcattgttccgatggttgggataggacttcccaggtttgttccctgggttctcttttattggattcctactacaggacaatcaaaggattcatggttttaatagaaaaggattggatctcttttggacataaattttcagagaggtgtggccagttggatggtgacccaaaggaagtctcaccagtgtttactcagttcttggaatgtgtgtggcatttgaccgaacagtttccacaagcctttgaattcagtgaagcatttcttcttcagatccatgagcatattgattcatgccagtttggaaacttccttggaaattgtcagaaggaaagagaagagctcaagttgaaggagaagacttattccctgtggccatttcttttggaagaccaaaagaagtacttaaatcctctctacagttccgaatctcacagatttacagttttggagccaaatacagtatctttcaattttaagttttggaggaacatgtaccatcagtttgatcgaacactgcatcctaggcagtctgtatttaatataattatgaatatgaatgagcaaaataaacaattagagaaagatattaaagacctagaatctctaacctcttactcatccttcaagatcatcgtaggccaatgaatccttgaatttgtggtcaacaagaggtcttctgtaggctgaagtcagggctgagtggtctgcttgtgatctcctaggaattcaagtaaatccatgtacttcttgaacatagctcatagcagaggactgagccgtgaaaatgcttacatgcctgcctcctctgacacattataagctccctgaggacggggaccaaggcttatttcatcgttgtatcctcagcatctgaccaatagcaggcactaagtcattactgaaaagaactgagcatgacacccaagggaacagatgaggtggaggtaggacaaggaagactgaggagtctccatggaaccttccagggagagacagtcaataaactctcatcagtc

SEQ ID NO: 1531 - DNA, 2679 bp, Homo sapiens
gacatcagcaagccccctgccgcgagcttggagaggcaccccagccccatctggcactcaaggaaatcagctcagagaggttgagtaactcgggaaggccacacagccagtgacgaagctgtgattcacacaggcctgggtgactccagcatggctttcctctccaggacgtcaccggtggcagctgcttccttccagagccggcaggaggccagaggctccatcctgcttcagagctgccagctgcccccgcaatggctgagcaccgaagcatggacgggagaatggaagcagccacacgggggggctctcacctccagatcgcctgggcctgtggctccccagaggccctgccacctgaagggatggcagcacagacccactcagcacaacgctgcctgcaaacagggccaggctgcagcccagacgccccccaggccggggccaccatcagcaccaccaccaccacccaaggaggggcaccaggaggggctggtggagctgcccgcctcgttccgggagctgctcaccttcttctgcaccaatgccaccatccacggcgccatccgcctggtctgctcccgcgggaaccgcctcaagacgacgtcctgggggctgctgtccctgggagccctggtcgcgctctgctggcagctggggctcctctttgagcgtcactggcaccgcccggtcctcatggccgtctctgtgcactcggagcgcaagctgctcccgctggtcaccctgtgtgacgggaacccacgtcggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagtcactcgggcagccgggtcagagtggggttcagactgtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccgacagttccggaccttccactaccccacctacggcagctgctacacggtcgatggcgtctggacagctcagcgccccggcatcacccacggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcctctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgctaggcagccgccggctccgcagggcgtggttctcctggcccagagccagccctgcctcaggggcgtccagcatcaagccagaggccagtcagatgcccccgcctgcaggcggcacgtcagatgacccggagcccagcaggcctcatctcccacgggtgatgcttccaggggttctggcgggagtctcagccgaagagagctgggctgggccccagccccttgagactctggacacctgaaccagacctgccagggctgtgcgatctcttggcctggtccttgcagctgtggcagcagcaggctccccagcggcccagggtgggccagaccagcagcccaggaagcagcacacgcggccgtggggaggcaggcaccgggcatgtcggcgcctctggtcaaaccacctacactgcctggggtgggtctcaaggaggcccggggcggaggggggttcccgcgtgcacacgagtgcggctggacgtgccgacacgcggtgacgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttgactcc

SEQ ID NO: 1532 - DNA, 2403 bp, Homo sapiens
acccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacggcaggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcgggcggatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttg

SEQ ID NO: 1533 - DNA, 2745 bp, Homo sapiens
gtaatgagggccacagcaggaaggggaacataaaatgagtccctgagttcttgacccttctctttcccctgctctccagtcagtttgagacttacacttggggtagaatccagattttccaccctggtcccctcactcactctgtgcagcttataaagtgcttttcttggccctagaaaacattctgcttcctttagtaaatgtgtgcagaatatttcatgaagtcacattattttcctctttggccgactttccctcttggatcacagtcagggagaaagtcagctgaggtgaggcaacttttcagtgtgaccttaaatgtggatgaaagtgatggccccgaggagcacaattgttaacttactggcatttgggtcccattagggacataagcaaataatgaaagttttctgcaaaaggattatgctgtcaccattcacagcagtaggaacagagagtttagggaaaggcctgtgcccagcctaggatggcaagctatccacctccaactccacaccatctgcaccaacgtgaactgtgaaagatttcaggcctgggactaatgttaaatgttcccttaactcctcatctccacatcactggacgggggtagtggtagaagggccaccccaccaccaccacaacacacaaagcttctacccccttagtatcgccccggaccctccttctcccggtcctggtttctgtttcatggtattcatcctcctctggcctcttcatggcatcctccagctgccactctggctgcttctcaccctacgccaggggtcaggagccatgaaagtccgtgagtgataccagccaggtgggaggtgatagggagtggtggggcatgtgactgactgggcatctggtgccccatgaaaagcagaagcccctgctcaactccaggccgtttctatgagaggagtgcaggcccagtgttcccgagtatctcattttccacgagaagttggaaaacctgacttttcatgtgatgtgacatttcctagcgtttaaatatttgagaagtaattaaaattatttcaaaacacactaggtaggccaaataaaatgtgtctgggacctagggctggtatcagttctagtctgtctctgtcactttccacaatctaacctgccctcccagcttcagtggttactcaaatttcaatgtctctgagcgttagatggccagccctggcctgcaccccagatttaccctagaattcatctgcatgtgggtgcccacacacctccaatgcaaagcggagcccatcagcctcccagatttggcagactgtaggatctcattcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatagccttatggggagtgagagagagggcacgagaacccaaagggaatagagattctccaggaatttcctctatgggaccttcccagcatcagccttagaacaagaaccttaccttcaaggagcaagtgaagaactctgtgaaggatggaactttcagatatcaactatttagagtccagagggagccatggcactagaaatagttgataatgaaatgagattttatgaagtataccgctccacctatgagcgtctgtctctgtgggcttgggatgttaacaggagccaaaaggagggaaagtgtgaagaataaagtagatctgagaaattctgagccaatcaggcttcttaattcaagagacaaaccaagacgttctgtcaactgtgctgtgctcttctttaagccaatgaaccccaattcctggcagtctacaagaagtctcttaatgctaatgaagaatttaaaggtctttttaaggaaatgaagggctttccaaatagaatgatttactctgaagaaacaaacaatggtatctctgaaactcacaacctaaagcccaatcttgaaaatatgttgtgcaccaagacgactgcttcagcttcttctcttatccttactttctttaatagatatttattaaactgtccagtgaaaaggtgccacaatgcccagtattgtaaacaacaggtttgcattcatgaagctttcattcattctggagtctactaatttacctgaatggtgtttgcattctgtgaaatgcctctccacgttgcatatgtcacacttttgtctgcacataactcttttttcacaagaagggtcactgccacaacagcacagtcagcgggtgaattacgggtgcctgctgcctgcctacctgggtaatctgatcttgtctgtatcgccgtgtgctcatcactgaagaattgcaggccactcatgtcagtgaccagatttgtggcttataaacattagcagtttatttatgttttaagatgcaaagatgtgtgtttgatattcactttaataattagaaatggatcttgtaaacagggcatatatcaaagatgaccttataatatgtacccgaatatacagttcaagaattttgtctgactggaaataaatgcattttgtagc

SEQ ID NO: 1534 - DNA, 2942 bp, Homo sapiens
agttggaacctggtgtttggcagttaccagaggagctgtgcctgggcagagggtacccaggagacaccctggtgcccttaacctccaaagcaggcaacattgtgtgtccaggcctgtggaccagaaacacaggatgttttgtgactgacagagtgatccaaaatggagaaggatgaccccccacagttggtgactcccacatcagtgaaagccatcatcctgaggattgaggctgcccagctaactcgggctcaagaggatatttctacccagctctcagacattttggacaatgtcaattgtgtcatcaaccgcttccaggaagaattaggatatgatttaaaagaaaatgccaaatctcagcagagagatccaaagggcaagaagagattcatcttgctggaaaaaattgcctccttctccaaagatgctatgatgaaggagaagcacctgtatgacattctccgctggctgggtgactggggtgacactctgacctatgagattgggcccaggaagagtgaagaggaagcagcagctctggacgaatggattgaagtgacggagaaagtgttaccgctgtccctcattgccaccaaaagaggcatcgagtcactcactgccctttgctccactctcattgaaggacaaaagaaaaggtcacaagtgtccaaacgcaccttctggcagggctggcagggaagaagcccacagacatctccatcccatcctcagccactaagcccagaacagatgctccaggaccagcataccatgaacacgaaggcctcggaggtgacgtccatgctgcaggagctcctggactctaccatgttcagcaagggggaggtcagggccatcaggtacatggccactgtggtggagaacctcaacaaggccttgatcctccaacacaaggagaacaggagcctggagaccaaatacaggcacctgcaaatgcaggcgaccaaagagctcagcagccagaggctgcacttccagcagttcatggaggtccttgagagcaggagggatgctctgctgaagcaggtagagatcttagggggaaggtaccatgaccttctcctgatgaagcaggccttggagttccagctgaagaaggctcagaatgctacaggtcaggcagaagacctggctgaggtttctgttgactccccaggtccctctgagagagagaccctcccaaggaaagaaacagtcatggaggaaagccaacaggaaccgatgaaggaggagcagttgttctcgccacttcccccaagtcccatggccatgatacgggacagtggtgctatagctgcagggcaccagccactttccaccatgactgtgcgctcgagggtcgcagatgtgttcggcagcaaggacactgagagccttgagcctgtgcttttacccttagtagatcgcaggtttcctaagaaatgggaaagaccggtggcagaaagcttaggccacaaagacaaagaccaggaggactacttccagaagggaggactccaaattaagttccactgtagcaagcagctgtctctagagagctccaggcaggtgacctctgagagccaagaggagccctgggaggaggaattcggccgggagatgcggaggcagctgtggctggaggaggaggagatgtggcagcagcggcagaagaagtgggccctgctggagcaggagcatcaggagaagctgcggcagtggaatctggaagacctggccagggagcaacagcggagatgggtccagctagaaaaggagcaggagagcccacggagagagccagagcagctaggggaggatgtggagaggaggatcttcacacccaccagtcgatggagggacttggagaaggcagagctatcattagtgcctgccccaagccggacccaatctgctcaccaaagcaggaggccacacttgcccatgtctcctagtacccagcagcctgccctgggaaagcagagacctatgagttcagtggagtttacctacagaccacggacccgccgagttcccacaaagcccaagaaatctgcctcctttcctgtcactgggacatccatccgaaggctgacctggccctctttgcagatatcccctgcaaatattaagaagaaggtgtaccacatggacatggaggcccagaggaagaacctgcagctcctgagtgaggagtctgagttgaggctgccccactacctgcgcagcaaagcactggagctcaccaccaccaccatggagctgggcgcgctcaggctgcagtacctgtgccataagtacatcttctatagacgcctccagagcctccggcaagaagcgatcaaccatgtacaaatcatgaaagaaacggaggcttcctacaaggcccagaacctctacatcttcctggaaaacattgaccgcctgcagagtctcaggctgcaggcctggacggacaagcagaaggggctggaggagaagcaccgagagtgcctgagcagcatggtgaccatgttccccaagctccagctggagtggaacgttcacctggacatccctgaggtcacctcgccaaagccaaagaaatgcaagtcgcctgcagcctcaccccggcacatccgccccagtggccccacctacaagcagccctttctgtctaggcaccgggcatgtgtgcccctgcagatggcccgccaacaggggaagcagatggaggctgtctggaagaccgaggtggcctcctccagttacgcaatagaaaaaaagacccctgccagccttccccgggaccagctgaggggacacccagatattccccggctgttgacactggacgtgtagtcctcctgccacaaaagcctgaacttcctgaaggcccagtaaggtgcgaggctgatggtcaatgtggattctccccaataaatctctctccaggcttt

SEQ ID NO: 1535 - DNA, 2074 bp, Homo sapiens
gtgcttatgagataaacgacagggtaactgtccacattggtcccagtttatgagggagaagagatcataatctacaaaaatttgcaagacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctagcactggccccgaggacagccaagggccatttcttctcagcttggtggagcagcacttacttactactggaaatgaaaaaaagtagaactcagaataccagacttttcttcctctcgacatagtttggggagaagcagtactagaaactttccaaggagtcttgggtgtgtagccaagaggagccatgagctatggactcctcaagcacgggaagaggaggtgtgtgctgagaacagagaggccctgccctctgtccactagcgagaatccctagctgccccagcccagtctttctccccggcattcacaaactttgcaagcgtggtccagggccttctccagatctgttccaacttggagtgtgaagggcttgagcatacgggggaagagagtctgcagaagttgggggaaaacttttaaaagataccctcattgtgtcaaagagtgtgccaatctatttttgtatcagcattggaagtgcactttcccctggggcgtgtgggtgtgtgaatgtgcaagtgtctgagagatactgcatcagccctagacccccagagccagtcccgccctttacagagcagcccttagcctggggccatgggtcaggctgaccttcaacaattatttctagatgatttctggataagaattgctctctcggtaccagacagtttgacatcctccacccttagaaaatgactgacattgttttgttactgctcctacccaccaaggggataaagaaggcgagttctgagtgttggatgagtcagtcgcgtggaaggacgtggagcgtggcgctctgtaacttcctgccgtctgccaccccgccacgtgtatttaaccctcgcactttctccactgtggagatggctggggcggcgccccacagtgtgtattcctgtcctctatgttagagtgcatcagaagcacatttactgtgctatctatatctctatataaaagtgttttataaaaacccagaataggagcacgacgcatgattggtgtttgaggcgtttgccagctgggacaaactgcgtttggagctgtggttaagctgactaaggaggcggtggctctttcttaacattcccacgtgcccagggctgttcatgcaagattttaatggtgacttgtcctggcttactgggacagtctgtatgaggcatgtcaccacactgtcgcctcatagctgcaagagagaggcaccagctgaagttcccctgactgaagagagcctgtggccatgtaaaaagagaattaaactcttgttgctttttgtat

SEQ ID NO: 1536 - DNA, 2618 bp, Homo sapiens
attgtgggggaggggccggccagccagggcaggcaggggcggcctctctgacgagaaggaggccactgggctgaggccaatgaatgggaaagagccagccacgtggtgagctgggagagggcatcccaggcagtgcaaccagcgcttgcaaaggccctggggctggacagttcttggcggagtctgagggcttgagtctgggggagcctggctgcccagaggtggcagatgacatgaagaagtaaccatgtaagggctggctgtgtatgagagcaagcattgggaaggatgaatgccaactatgttccaggaacttccactgttctcacacacccaggtgagtggtgttcaggtgggtggcacccaggtgagtgacatcccagttgagtggcacccaggtgagtagcatccaggtgagtgacacctaggtgagtgacattcaggttagtggcgtctgtgtgagtggcatcatccaggtgagtagcttccaggtgagtggcacccaggtgagtggcattcgggtgagtggcattatccaggtgacacctgggtgagtggcatccaggtgagtgatatcatccaggtaagtggcacctaggtgacatccaggtgagtgacgacatccaggtgagtgacatcatccaggtaaatggcacccaggtgagtagcattcaggtgagtgacacccaggcgagtggcatccacgtgactagcattgtccaggtgcataacacccaggtgagtggcacccagttgagtggtgcccaagtgagtcacatccaggtaagtggggtccaggtggtggcacccaggcgagtggtgcccaggtgagtgacagccaggtgaatggtgtccaggtgagtggcatcacccaggtgaatggtgtccaggtgagtggcatccaggtaagtggtgtccaggtggtggcacccaggtgagtggtgtccaggtgaggggcatcacccaggtgaatggtgtccaggtgagtggcatccaggtgggtggtaccgtcgacgtgacaatagctaacaattattgggctcattgtggacaggcactgtgccgagcttgacatcactgaactcagttcatcctcgccaggagcttgtgggccgtccctagatcagaatccgaggagaaaggacttccacacggcagccagcgagctggagggcggcctcctgccaccaccaggctccctaacccagtcctggatatctgtgaaagaatgagtggatccccacaggccagctatccccaaacacactcgtttacactgaagcaccaggagatcagaaccttctggaatcttaatatgcgaggactcggtggagaaggcggcactgaagaagagtcgtccctaggccaggctggagggaaactcaagacggcggcctggccctcctgggtggcggaagtgggagcagcaggagccctggcggatccgggaggccagaagagcggaagcttcctcccctctcaggacagccacaaggactttcgggggtcgtggcagctgctccacttccaacttccagatccctctcactttcctcttcccaccaactccaacctgggaccaagcaggggaaagcagctgcagcccagcttgacgcccctgcaaatggagacctgtgcacctggttgtgagcattttaaagggtgtcacacagggcatacccttcggtgcctggattcctttgatgaaagggcaaagccttgaacctaagtcatcttcgagtcctcagcacttcacccagagcctggcacacagtaggagcacagaaaggtttacatccagcaggagttggccctgagctctgagtccagatcattgctcttggctgaagcagcctgtctactcacaaagatgagcatggtccctgccacgaggaaactcgtggtcctgtggactgcggtgtggagggaaagcttgggattctgagcctgataatgcaccattacatccccactcactcgggctgtgtgaacccagcaagtcacaggatcactgggtggtgaaagaaagaaacactcacagaagcgtctgtgcttggagagccatctggtccatcattgtgactgctgctctcattgctatcatgggtgtcaccattgccatcactcaagggcttctctccaggccccgaagccaagctggtgcctggttcctctgggttgggagaggggctgggcatggacaggaggagggaaaagggacctgtgctagcaggtgatgccatccaagacatctgcatcctaatccctggaacctggggttccactaggtgccatggcaaagagggattaaggtggcaggtggagtgaaggttgctaatcagccgaccttaaagtagggagatgatcctgaatgagacaaaagagagaaccagtcatggtgtcatgagaaggactcaaaatgcaactgctgactttgaagattaaggggctacaaaccaaggaacgtggtagtctctgcaaaagacaaggaatagacgctgccttggggccaccagaaggaaccagccctgtcaacaccctaattttagcccagtgaggcctgtgctggacttctgacctccagaactgtaaactaataaatgtgtgttgtttctgcc

SEQ ID NO: 1537 - DNA, 1798 bp, Homo sapiens
aggaaagactgggtacatgtgtgtatggaggcatgggttttagaggataaataggctttggagaagttaaaaggacttgagacactctttgttgtctagtttagggaatgtgtaagaactggcctgactagaaggtcaagtacatgctgggaaatgatggaatcagattatggagatttgactattgagcaacggagtttgttgagtgatttaataaccgtattgggtttttgtacagggaagtaatttaatggaaatagtgtaagaaaattagtttttcatcaatatacgggaagaattaaagtggaaaaacgctgaaaagatagatgcacttgcctaggcccgaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctgggcgtcctgtcactccacctcgaacagctaatccgccgaagaaaagtccttccttcagaagggaaatttctgagggtcaggaaggggaatctgtacctcactccttgaacaccaaggaaggaatattgggaaaccaaaatgaggcacaatcagatgtgttgtgagacaccacctactgtcactgtttatgtaaaatcagggtcaaatagatcacatcagcctaaaaagcccattactctgaagcgtcctatttgtaaagataattggcaagcatttgaaaaaaatacacataataacaacaaatctaaacgccccaaaggaccttgtctggttatacagcgtcaggatatgactgctttctttaaattatttgatgacgatttaattcaagatttcttgtggatggactgctgctgtaaaattgcagacaagtatcttttggctatgacctttgtttatttcaagagggctaaatttactataagtgagcataccaggataaatttctttattgctctgtatctggctaatacagttgaagaagatgaagaagaaaccaagtacgaaatttttccatgggctttagggaaaaactggagaaaattgttccctaatttcttaaagttaagggaccagctctgggatagaattgactatagggctattgtaagcaggcgatgttgtgaggaggttatggccattgcaccaacccattatatctggcaaagagaacgttctgttcatcacagtggagctgtcagaaactacaacagagatgaagttcagctgccccggggacctagtgccacaccagtagattgttcactctgtggtaaaaaaagaagatatgttagactgggattgtcttcatcatcatctttatccagtcatacagcaggggtgacagaaaaacattctcaggactcatacaactcactgtcaatggacataataggtgatccttctcaagcttatactggttctgaaggtatgatttagtaatatgccagaattagatttatgcatgttgtttactg

SEQ ID NO: 1538 - DNA, 1767 bp, Homo sapiens
ataacttacccatccaaacccaaagaatggactcagagaacagtggaagaaagactttttaatgacggtcttgcaagattgggtgtctgatgggcaggcacacccagcagggttacaacaagccatttatcccctggaaatacagatatggatataaatacatataataatcaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccaaagggggctgtgatgaaagagaaggccagctttctcccgcctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcgtcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgatagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgt

SEQ ID NO: 1539 - DNA, 2287 bp, Homo sapiens
atttcccccgggtccggtatttggggtggtctctgtctgccccggttcatctccaccgtctcaccttcaccccatcttgggacgtgaaactttttgaaagtttagaagcgaacttactgtgggctgtcacgtgtgaatatgtgtctagtgcatccttaacctgaggacttcaccagttcgaaattacagttttcaccatcaactaccttatcctttttggtctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgt

SEQ ID NO: 1540 - DNA, 1868 bp, Homo sapiens
aacgtcttcccacctttttctcccctctccgtcttctcccctccttcttccccactgcggtcttcccgcatcctcttctgccgtctccctactgtcttcttcccgcaccttctcccccgcagttttttttccccttccccaccgttttcttctcctcagtctctcccattcctcgcagcacgggttcctgtggcggcagcttttccttccatctccttctctccacccgctggcttccagtctccaccttcccgcctattcccccagcagcgtcttcccgccgctccctcttctcccctccccctcctcaccgtcttctcccggcctattaccgccaaccgttttcttcctcaccccgcacccttttcttcccatgtctgccttagtcttcttcccaccctcttctcctctccccatcgccttcttcccaccctcttctcctctccccatcgccttcttcccaccctcttctcctctcccaatcgtcttctttcccagcctcttctccattttcttgccgcctccatatccccaccttcttctcgcagcagcgtcttcctgccgcgcttttctctcccctcaccatcttctcttcctcttccccaccgtcctctccccacgccctcttctcctctcactgtcttctccccgcgccttccccacaaccgttttgtcccccgttttcttcccctcacaccgttttcttcccatgtcctcccaccgtctcgcagcagcgtctgtcagtcgcaatcttcttcccactttcttctctccccctcccatcgtcttttttccccagcctcttattctccgccatcttcttcccctccccaccttctcgcagcagcgacttcctgccgcgtttttctctccccgcaccctcttctcccctcttccactccccaccgtcttcgcccccgatcgtcgtcttgcccacccccttctcgcgctctccaactgcctttcacctagaagcgctccacgcgtgcgcccggctgtgtccctgcgcctggtgtgtctgtgcgcccaggcagccccatgagctgggcccctgagctccgccccaacagccaacaggagacccaggagagtcgctgccagggccatcacggctgccgccgcccccgcccccgccgctacctcagaactgaacagtgttggctgcgggcgaaagacactggggcccggaagactgcggggagagggggaggaggggacggagagggtgggaaagaccttggaaagtgggatggggagaaaggtggggaagaagacagtggggagaaagtgcagggagaagacagtatggtagagaagacagtggaggaaaacggtgaggagaaaggagggtggaaaagaagacgatgaggacaaggccgggcgcggtggctcacgcctgtaatcccagcactttgggaggctgatgcgggcggatcacaaggtcaggagttcgagacctgcctgaccaacatgctgaaacccagtctctactaaaaatacaaaaattagctgggcgtgatggcgagcgcctgtaatccagctactccagcgcctgaggcaggagaatcgcttgagccccggaggcggaggttgcagtgagctgagaactcaccattgcactccagcctggatgacagagaaggtcatgggaacatacagagacctacagggaagacggccatgggacaagggaggcagagtctggagtacgctgcctacagtcacggaatgccaaggacagctggaaaccaccagaagctaagaaggagattttacctgaaagcctctcaaagaaatcaatcatactcacacctcctttttgaatttctggcctcgtgaatggtgaaaaaataaatttctgtcgtctt

SEQ ID NO: 1541 - DNA, 2211 bp, Homo sapiens
aacgaaaagaagtttatttagctcacagttctggaagctgggaagttcaagattgagcagctgcttctagtgagggcctcatgctgcatccaaacatccaaatggagaaacagaaggaaaactgggcatgtgcaaaatgggcaaaacaagaggcaaacctcgctttatgacaacccactctcatgggaactatacctttcccaagaaagacattaatccatcttaataacctattcactcttaaaggcaccacctcccaccaccacatttggggaccaagccacaacatgagttttgttggggacaaactatattcaaaccatagtaacgagggaatagcattataggagtccagtgaaagctctgtctttgcccccaacatggggaagccaatgctgaaaagcagggagggattgggaaagaaatacctgatctctctctccacctgccctctggttgcctgctgttgcctcccactgaacaaacagtggaagcagccagcaagggagactgggtaatgcagtctgtggagaccagtcccccaaagctcagagcaaggctgagaagagcagggagcaggttgggatgtgagggcaacagagaaatcagcacaggtcctggcggagataccagattccagagtttggagctcaaacctgatccttgaaactggttaccagaatcagcatatgaccataggatgcctgggtctgctcagagcattggagaggaggtgaggcaaggcagggcttcatcccctcagctgtgtaggaaggcaggtgcccatgctctactggtggagaagtcaggctctctgagtctgcagatctgcacgtatcctttccggcactgtcacagctttgccaggggaacatggaactgctgcatctccatagaggggaggatgggggaggctggaagatgcactggaagcaggggtctttgtcttccttcttagtgccttactcttcttttggggactggtgaatgggtgatgcccacatagaccctaaattaagacagaggacagtgcctctatagatagaagacaaagagtgagaagatcattttgttcccactcctccctctgacctttgtctgtgtctaagcccgtatgtgtctctgcaggtgttgggggcaatctggtggcagtgcaggccagccgcatctccaccttcctgcacatgaatggaatgcccggagagaactctgagcaagctcctcgccgctgtcccagtccttgtaccaccttcttcagccctgatgtgaattctcgctcagcccgggtcctcttcctcctcgtggtcccaggacacctggtgttcctctacaccatcagctgtatgcagggcgggcacaccaccctcacactcatcttcatcatcttctatatgacagctgcactgctccaggtgctgattctcctgtacatcgcagactggatggtgcactggatgtggggccggggcctggacccggacaacttctccatcccatacttgactgctctgggggacctgcttggcactgggctcctagcactcagcttccatgttctctggctcataggggaccgagacacggatgtcggagactagcttggtcactcaacattttccccatccctctgcactttctatttgaaatttttcttttgttcccctgtccctcctccaccccacactcccacctctttctaggacttcactttgataccaaattctcattattttcaatgggaatttttatacattgagccaagtttgtatagcaagaatttgggaaacacagatggcctgagataagcagtacaagtaggtttttgagacaatcaccaagtgcagtttcatggtgggtgcctccaggtgatgtggactggagcaggggagttttgtctggaatctggggacatggggtttggctttagcaacctgtcttggccctaatgagaaaccctttgtaagtgggctctggatttttggttttgttttctttttatctgttttgttttatttttggttttggttgaacagagggacagaagaataagtaacactcccaaacacagacatacttttgtagaagtggaccaacttcaaagctctggacaggagacacctgctccaggcccctgtgatcccagttctgttctcttgccctctggacctaagcgttcccactcgcagaaagagtaaggtggactgacttttc

SEQ ID NO: 1542 - DNA, 2099 bp, Homo sapiens
gtgctctgactttaggtcgggtggcttctggggccttctgaggaacatgcacaagctgctacagctactgattgctatgctatgccttgtatgactaagacctcttaccaagaatacgtgtcagaccataaaaccactgccaaggagtgcgggggtggcaatgaaacagcccaacaggaaaaggaagcttaatatggattccaaagagcgtttggatcaggacggacgcttggagcaagctgaagaggaaaagaagcccaaggatagcacaacccctttgagtcacgtcccttcagcggctgcacagggagcatggtcttgggagtggtacttgaaagaacagaaggctgtcgcagcacctgttgagctgttttccaaggatcagtcctttccagagcatgaaaatggttttcagattggaatgagattagaaggcattgatccccgacatccatcggtattctgtgtgctttctgtagcggaggtttgtggttaccgtctaagacttcattttgatggttatttaagttgctatgatttttggaccaatgctggttcccctgacattcatccagtaggatggtgtgaaaagaccaaacatgaactgcacatccctaagggttatagaaaagataaatttgtttggatggattacttgaaggcctgcaaattgcaaaatgctccaaagaaattattcagaaacagaagtcctaatgggccaatgtctaaagaatttcaggttggaatgaagctggaggccgtggacaggaagaacccttccttggtgtgtgtggcgaccatagcagatattgttgaagatcgcttactagtgcattttgacaactgggatgatagttacgattactggtgcgatgttaatagcccttatgtccagccagttggttggtgtcaggagaatggaagaactctgatagcaccccaaggttatcccaatccagaaaatttttcctggacagaatacctggaagctactcaaaccaatgcagttcctgccaaagtttttaaaatgaggttgcctcatggttttctgccaaatatgaaacttgaagttgtggataaacggaaccccaggttaattcgtgttgctacgattgtagatgttgatgaccaaagagtaaaggttcattttgatggttgggaccataagtatgactactgggtggaggcagacagccctgatatccacccgatcggatggtgtgatgtcacagggcatccactggaagtgccacagcgaacgaatgacctgaagatccttccaggtcaagctgtctgtcctactcccgggtgccgaggaataggccatatccgtggtccacgttattcgggacatcacagtgcttttggctgcccgtattcagacatgaacttgaaaaaggaggcaacacttcacgatcgtttgagagaacaaacacaggcaaatttggaatcagactcttcacattcaaaatcaaaaagcctctgtagtttgaacttcaatggaaaacatgaaaaggtgaacagtcagcccagacttgtacagcaggcaaagtgtttgaaaatcaaaggaaaagaagatattgacttggataatctcttcagagtgcttgtgctgcatcccagaggtttggaatactcggtggagcaggcgcagcaggtgcttcaccagccagtgtccatgtccacggtgtcagcccacccttttcgggaccttcccctcggcagggagcaacactgcaagttgcttccaggcgtggctgacatccgagccagccaagtggcacgttggactgtggatgaggtggctgagtttgtacagtctcttctgggctgtgaagagcatgccaagtgctttaagaaagagcagattgatggcaaagccttcctgcttctgacacagacggacattgtcaaagtgatgaagatcaaactgggcccagcactgaagatttacaactctatcctgatgttcaggcattcccaggaactccctgaagaagatattgcctcagaccaagaagtcaggggatgaatgggctccctgaacttcctctggcaccaagacctgcgctctttcagcaataaaagtggagcacatt

SEQ ID NO: 1543 - DNA, 1771 bp, Homo sapiens
aaaaaaccgcgtgacaacaagatggcggcgctgcgggacggctagcggccctgcgtgtactttcccaagcaccaccaggccaaaggtctctcagttcagagcagaaagccgtatacccagaggagcaggcagataacagaaacttccagaaacctctgtggagacagtggaagaggcaaaagggagttcctgacagctggattctagaagtagaactatgagctcacctttggcctcccttagcaagacccgaaaagtgcccctgccctcggagcctatgaatcctgggaggcgaggaatccgcatctatggagatgaagatgaggtggacatgttgagtgatgggtgtggctcggaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagcggatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacaccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggctccagtccctgtcccggacccagtcccagcccccaataaagcacccgccccctc

SEQ ID NO: 1544 - DNA, 1539 bp, Homo sapiens
ctcagaagccttgagtatgccagtgttttctcacattttgcaggtcccctgtctgggatctcttttctttctttccttgggtactggattttcagtgctgcctggttcactcactgatgaatcttgttgcttacaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagtaagtgaagacttatcagtagggcaggcagcctggtccctcagggcccagtgcagcacagagcttgcctcgcaacctctggcttatttactgctgttactcttacagtgatgcagtatttagtatttgggagaagagggggagaaacatcacgtgaggctatgcaacagaaaaaagagtttatcctggtacctggaggtaaatgagatggccaggaattgctttggagttttggagacattttgggtttaagtaccatggacacttctttgtaatctcttctcaggaagagtaaagttacaggtgtagatgaatgggacacctcaagtgtgtcccagtgctgtttccttgtatcataagtaaatggttttagc

SEQ ID NO: 1545 - DNA, 1839 bp, Homo sapiens
agaactgatacttttcctgatttattggtctgaagcttgatgcatatggaggcctgaaaaataaggatgtggcatacagacaggctctcctggtgttatcaggcatctatgcatgtgatatgcagggagaatttggtggatggaacttaagccggtaccaggggggcgggggaagagttgggaaaggacgccatctgtgcccatgatgacaaatgccatcatggagacttcattcagggtcccttttatatatttagtgaagcagattttccatttcacactttctagatatatttgtattgcacagatgtcagggaaatatcatgtgtgtgaaagaaaaaaaaaagatcaaaattcacatccatggccagggattgtaattcaatcattttgtcctgaaattgacatccatttaacgtgcatggatgttccctgcttttgcttttgctttgggggttcaagtcagagcagtttgagaaacataaatctcagccctacacattgttaaaattcagagatctaggttaaggggggaaaagatggggagaataaaattaaacatataagaccttgccatcagtgccgtcagtaccagagctgatgaaatcaatcagcaagtgattcctcatcctctttcctgtaacacacagatgagctgaagaaaccacaggacgcagtcaaatatgcttcaagaaggttgtcccactggccttcttcactccctccatctcagcctctaaagacatattttattgtgacgtatttgattttgacaaacagcacattgaacatatatgaaatatatgaagcaaaatatgacacacacccaccatgcagcctgagaccagaagatcaccatcttatttgaagctacttttgtgtttctgccacctctcaccttttgcctgtcttgagagcacctcgatcagcctccctactaaatgctgagctcctctaggttaagggcttgtcacacttctcttagtattcctgaaactacttgcctcagtatctgcctcagcaggtacttctttctccgaatgtgaaatgagctcaaggaacagcctaagagttgagaaggtctgcatttcgttgcttctagaatgctatacgccatgttgtgtccacaaaatgcgtaccccaaagaacagatgaaatgaaaccatagataaacgtgtaagaggtacttttgaaagcagagctataaaactcagttccatattcatcatggcttggatgtccagaacttgcttacatctatttgtggacttttttgtatcaaagagaatggatcaatcaaataagaaaagaagagtgcattgggagtcaggagactgaggtgtggtctggctctgctgctaacttcaagtttacactcaattgatcaagtcccttgatgacatggaactaaagtgacttttgaagaacatgagtacctcaaggatcttgctaaaatacagattctgatctaataatgcagccttgtgagatagtgaactctccattcctggaagtattcaagctaaggttggagaggtgatgacagtttccattattttggagggtgaacttccaagatgaagaacatgagtcttagagaagtcaaagaagttgcctaaggtcacatgagcagtgagcagaggagttgcttacctttgttagactccaaatcctgtgtgactatgaaactcattaactgaaacaacccggcacctttggacctgtgcaggcaaaggcaagggagttgaccaggagcacacagcacagacaagaacagtcccaaagccttttgctgtatcccatctgtgcaaaccactcccaataaacaaacaaacacac

SEQ ID NO: 1546 - DNA, 1784 bp, Homo sapiens
tacattcctcctctgcaaataatacttcaaacagaaagcttctaattgttattgacacaaatattctgatgaatcatctcaaatttgttagaattttgaagacaacagaagtaccaggttttgacaaacttgtgttaataattccctgggtcgttatgcaagagctagatcgtatgaaggaaggaaaactactaaaacgtgcccagcacaaagctatacctgcagttcatttcatcaacgacagtctcaaaaatcaagatagaaagctatggggtcagtcaatacaacttgcatcccaaaaacattatggattgagtgatgagaacaatgatgatcgagtactaaaatgctgtctccagcaccaggaattattcccttgttcttttgttattctgtgcacggatgatagaaacttaagaaacaaaggcctaataagtggtgtgaagtcactcagtaaagaagaattgagtgcagagttattacacttatctctgaacacagatgtgtgtcatcagccttgtattcctaagcaacagttgaaagcagaaacaacacccttgaaagagagctataaggaggaatctacaaattctggactgtccattctgcttgagagcattgtatctgatcttgaaaaatctcttggaacaggtttatcttcaatattagaaacagaaatgaaaattgcttttggaaacctttggatggagatcctgtacctgaaaccaccatggactctactacatttactacagtgctttaaaaaacattggttggctgtatttggattagttatggaaaagaacttgcttttaactattgagagcctatacaaaaatctccgtaaagctaataaggcagtggattttacaacagtcaaattcttgcttcaggattctagaagtttgttacatgctttcagtacaaggtcaaattatgatggtattcttccacagacctttgctcaagtaaacaacctccttcagacatttgcagaggtcaagacaaaacttaagccaaattcttcagaaaacacagtgactaaaaagcaggaaggtacttcattgaagaattctcataatcaagaaatcactgttttctcgagttctcatcttccccaacccagcaggcatcaagaaatctggtctatcctagagagtgtttggattacaatatatcagaacagcacggatgtatttcaaagattgggctcaaattcagctctgactacttcaaatatagcatcatttgaagaagcatttatatgtcttcaaaagttaatggcagctgtgagggatattcttgaaggaattcaaaggattttggccccaaacagtaattatcaagatgttgagaccctctataacttcctaatcaagtatgaggtaaataaaaatgtcaaatttactgcccaggaaatttatgattgtgtttctcagactgagtatagggaaaagttaaccattggatgccgccagctggttgagatggaatataccatgcagcagtgcaatgcatctgtttatatggaggccaaaaacaggggatggtgtgaagacatgctcaactataggatataagtactgatttgtaactttaaaggaattgcatttgtccttaagaataacagagtagttttcaatctggtcactcttttgggccaagcccaagagaattttaagaaatgtttcataggtataaaaaggtgatcgcctattactgacagtctcattgtagctctaaaaagcctaatgtatccactgtggaataaactccatagactc

SEQ ID NO: 1547 - DNA, 1943 bp, Homo sapiens
gaggtgggaaccccggctggcgtccggtaggggggggttcccggggaaacccgcggaaggcgaggtgcctggcctgccatgtaggggctcgttccaagccgcagaccccaccgccctccctctccccggggcccatggcggtggccgtgcccccgggtcgggccgcaggctcaggctgggcctggaggccagtggcgcgggacgcgcttttggctagagctttccattcatgcaccgaactgcggggacggttctatctcgtaggtggtctcctagcaggaggagcgagagagcccagcagcgatacggtggttttcgacccagctaggggccaggccgtacgattgggagcccggggcagccccccgcgcagtcaccacggcgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattggtatggcaccctccgcccaaaacctttcactctcatccacactctcgaaaaacaaaagcctaagcagatttctcaggcaatttatccacctcctcactctagcaccctccttccaggggaacctaccatgtttaagctagctgagctctctacagtattaccctccctcttatcccacctaccgcactgccccatgcctcttctccatccatccttggcaagggcggtggcacttacattttccagaaaacccactcagccctgaatttctgcatgtccacagctacaagcaagaaggctgccacacagcctcacgctcaggtcactgtgcggccctgctccaaactcctggaccccatccaggtcatcagctattgctctttgggggttgcaacttagctgaaccagaagtagctgggcattggagtcatgggaaaattaaggtattagctcctcacacatcttgtttaggatgggaagaggctaaaattgtgatgcccaggtctcttcggacagtcctttctttctccccaaggaggaaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgtgagagccagactaatggctgaagggggggaaggtgggaagatgggggaacctgaagactacagaaagaggatggagtgatggggtagggaggaggaaaaattagttgacaggagttaaaggagtgcacagaatattaagcatttgaagaggcctacaaatcaagtgagcagaaaaacaatgggcaagcccttggtcatgttgaattctgtgaatgacaaagtgctactgcctcaataaccaccctctgcccgtatccaacaggcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactc

SEQ ID NO: 1548 - DNA, 2377 bp, Homo sapiens
agtggcctggtcccaggggctgttgtggggagttgaagaacaccctggcctcctccatcatgtcggccaagagggcagaattgaagaaaacacatctgagcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcacgggatccccttcatcactgtgggacctgctgcgtaagtgaaaccctgcccgagcccagcactggtgccagacccctggctccggctccctggtgacttccccgagcttgtgctgtatcatagtgaagggacaggtccgcccgctgctgacttctgggtgccgcccgagcctgcgccctccctgacctgccttgccttctaggcctgtggagcctccttagctgtgaccatgcaggacttgaccctggatgggcctacccgccagctccaccctcttattctgtccttccctttagcaagggcagatagggtgcctagcaggctgcccttcttggaccaggggaaattgatctttcttgtgccgtttctgtcctctgcaggagaaatgtttgttgtgtgctctaaagaacaactacaatcggggtaggtagattcatacaagatgtgccttttctcgatcaggtgccttgttgtccccaaggccatgtgctcccagccgcattcacatcacacccctcctgaggttgtgccaggagtagggactgttagcagatgctgccacccagcatgctcagtcatacaggatgtggcaccaggaaggaggacttgggtcacccagcctagaggctgctgcctggggctcccatggtggggagggtgcaccactagtggcggaactgaccttgcctcaggtcctgccctttctccccatccagtgggaaatattcacaccaggtctgggcacccttttcacccttggcttctggagctgccttctgatttatctgtacctcaaccccggtgacatcgaatatgtgtttccaacctagcgcagctgcagaacctaccagcagttccgattcatcacctccaagctccttaagatgcacagtcagggcttcttgtcctgttaaataccaccccaaccccaggcctccactggagattaaaaaccttcattcaaagccaaaggggatgtcatggttttgagtaccagtccaaaacttgagtgtgtggaggttgattatttttggttctatatcagtgtatttcagactccaacccttccccctgcttcctgatggattggtgggaaattacatcttagtcatcttagggtcctcccaaccaccacctccctccattccacctgggtctgcaaacgtcccaggtcatagcatggggagggcccctgatgatagcggacgccagtctgtgtggtctcaggagagaccctgctgcctggcccatccgctccctccacataatcagcctccacctgtgcatggggccagggtgtcttgggtgatgcagggaacccctcagcctcgagttctgcctgcaccacacccctctgaggtcttgtcaccaagcaggactcaggtccctgctgctcataggaactgggtagctttcttgggttctggggatccacccttctcacccccttgaaggtttcctctccctccctccacccccaaagggaacattccttcagaggcctcaggcctttacaaaggtggagaggagccagtgaccacccaaccttctgtgggccacgctgtgcctgccccaaagtcccagactgagggaaggtgaagcttaactgccagcttgaaatgagagtaaagaagatacagagcaaacagtgtttcagaaactgtcctgccctgggtgtgattctttggcttcaatttgaaggacgaggaatgatgggatttcatattttatttcacaccagttcctccttgtttcatctctttgctaagctggctgcttctaccatctaataaataattggccaagtt

SEQ ID NO: 1549 - DNA, 1687 bp, Homo sapiens
aggcagcatgctaaaccgggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgaggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctggtagagatacttcaggacccttcgccaccacccctctgcctcccaaccactccggggaccccagattcctccgatccctctcacttgcttggccctcagtcctgctggtcttcacagaaggaagtgagccacgagagcctggtagtgggggccattgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaactgaagaagggatgtccgctatatccaaaattacagctattggcaaataaacgagatggat

SEQ ID NO: 1550 - DNA, 1805 bp, Homo sapiens
gaaagtcctaggggtgggggcagtctccacagcctcccacaagggagttaccaccttcccgcacttctgggtacaagtctcctgctctggctgtattccacagttagaacttcatatctttggcttagagctgaattttctgttaccatgtggatgctccaggtgaaggggcccgctcctgcttaaaaacaccatgcatgcagactgctgctgggaatgtgacagttggctgttggagagaagggggcactggcattgagagacctccagactggacatggccctgagtccaggggctaacctggtcttccatgaagacccaaagatgacaccaagtcccccctcctgtggggccccgggattagggtctggtaccatccctcagccccacccagacatggctcaggtgcctatgttgaatctgctcccaagtcctggcttggctctcgttccagatcttaatgattctttgagtccagtctcaggggaggcctcaggcctggtgtctgaaaacacccccagacctgatgacagcagagctatcgctccagcctccctccagatcaccagttcttgttctggtgaagccctggacctggattccaaggatgtctcaaggcctgactcacaggggcgcctctgtccagcctcaaaccccattctgagccctagctctactgaggcccctcgtctgagctctgggaaccaccctcagtcaaattctgaagatgccttcaagtgcctctcaagtaagattttcaagttgggtcagagaaactccaacccttctaggcatgaattaaacccatttataaggcaccgttccagagaaggtctggttctgggccactgcatctctaggccaagctcaaaagcactccttattccaacctcaaactcttctctggaccttgactccaatccattgctcaacatgggctcaagaaacacctccaagctgaacctcaatgtagctccagattctcatgggaccctaatcccagacacaaatgagaccatcactttggcttcacataatatctctgagtctgtttcaaaaggagcctttagtaccacctggagcacaagttcaaaggaaaccatgaatgtggcttccagcggccactccagatctgatttgagcgtgaccatcactcaagcctcgtatgtgaccctgattcctggctccagctatggtatcagcctgcactccagcacccatgggcccaactccaccatctctccaccctcatgcatgactctaatcctgggttccaatgagactctgagcctggactccagcctcctgttcagcgacacctccaccttgacgctgagcagtcagcaggatgatgccaaggacaacagcatccacactgtgcccctggaggagaatctggagagttggagtgagatggccagcattaaggtgggccagttcccgctgggattccccatctccaaccccgcaggcaaggacgccgtgaccttgcaaggcatccctgagggtgtctcaggttcatcctggactttccctgcttgagtcctggaatcgaccttttctccaaggagccttgttccttttagtggggaaaggtatttagaagctaagatcttggtgttggctgtgttcactacaactggtgtatctacttctccatcctccagcgtcctctggtgatcgagaatctgaagttccaggttttcataggccccagtgaccttgtcctcagaaggagaaagatcctctctcctttggtgttcccctcaactcccttaaataaaggactctattggtcctgccc

SEQ ID NO: 1551 - DNA, 2151 bp, Homo sapiens
aagactgaattccttgtgagcagggattcttcagtaaatttcatttgtatgtccagtagccagtagctagtagccctcagccaagcacttagaactgagtaaatgatgggaaggtggaccatcagtgcataaaaggaaggaaccatgcctctagaagatttactggcattctatggctatgaacctacaattccagcagttgcaaattccagtgcaaatagttccccaagtgaactggcagatgaactaccagacatgacactagacaaagaggaaatagcaaaagacctgttgtcaggtgatgacgaggaaactcagtcttctgcggatgatctgacgccatctgtgacttcccatgaaacttctgatttcttccctaggcctttacgatcaaatactgcatgtgatggtgataaggaatcagaggttgaagatgttgaaacagacagtggtaattcacctgaagatttgaggaaggaaataatgattggtttacaatatcaggcagagattcccccttatcttggagagtacgatggtaatgagaaagtatatgaaaacgaagaccagttactttggtgtcctgatgtggttttggagagcaaagttaaggaataccttgttgagacttcattaaggactggcagtgaaaaaataatggataggatttctgcaggaacacacacaagggacaatgaacaggcattatatgaacttctcaagtgtaaccacaatataaaggaagcaatcgaaagatactgctgcaatggaaaggcctctcaagaaggaatgactgcatggacggaagaagaatgccgaagctttgaacatgcactcatgctttttggaaaagattttcatcttatacagaagaataaggtgagaactaggacagttgctgagtgtgtagcattctactatatgtggaagaaatctgaacgttatgattactttgctcaacagacaagatttgggaaaaaaagatataaccatcaccctggagttacggactatatggatcgtttagtagatgaaacagaagctttgggtgggacggtaaatgcttcagccttaacttctaaccggcctgagcctattcctgatcaacagctaaacattctcaactccttcactgccagtgacttgacagctttgaccaacagtgtagcaaccgtctgcgaccccacagatgtgaattgtttggatgatagctttcctccactgggcaacacaccccgtggacaagttaatcatgtgcctgttgtaacagaagagttactcaccctgcccagcaatggggaaagtgattgttttaatttatttgagactggattttatcactcggagctaaccctatgaacatgtgcagtgaagagtcagagagaccagcaaaaagattgaaaatgggcattgccgtccctgaatcctttatgaatgaagtttctgtaaataacctgggtgtggactttgaaaatcacacacatcacatcaccagtgccaaaatggctgtttctgtggctgactttggcagtctctctgccaacgagaccaatggtttcatcagtgcccatgctctgcatcagcacgcggccctacactctgagtgacctgagtgaggatcccggaactgcgtgtgcagcaccagtaaacttgaggagagctatcaggtttgcatagtctttcactggaagtttgaacctttctcactatgacatcagtgatgtcagtatgtatagaactatatcttgatttatcaagagtattttcatttttcaatccataaatgtggaaatgaactatgatcagcagagttgggaactaagattgaactctgtggtgcagctttaagctctgcttctctcttcctcatctcccaatacctcttccccactcccttctttttctattcttttgtgttccccactgccctcactcccaattttaaaacctgtagacagaggccaccagctcaaaaccagcacagatgttctgaactgaatggtgtggcctctttttgtgtaaattccttttgccgtaatggatgcagtggaataacaatgtttacaggtaccgatcccgatccctgctcaatgtagcatttttttggttttattttcttaataaaagcaggggtaggtttctttaaactgc

SEQ ID NO: 1552 - DNA, 2144 bp, Homo sapiens
aacaggatcgggtgggggggtgggatgcgggtgggggaaaactggggttgccaaagccgcctctccgccttcagtccgcccctccagtccgccgctcccggcgcccctgccgccgcgcccgcccagcgaccccatgacacagatcggcttaaagctccccgcctgtccgcctgccctcgagagagggtcccgacccccagacaggtctccgaaggctgggcttcgcctcacgccgacctccggccccaccccacccgcgtaactataaactccagctacttgccgcgctgcttttgcacagactcatgccctgccccagaagggacagtggccgtgctgtggcgggaacagcgggcgggctggtccagagcagggcctgcctgggtgaggaggatttggagggccaggccctgtcgtcacagggttatgaggccgaagggaccattccatttacaactgcgctgaagaattgtgctaagtgaaataagccagatacagaaagacaaatactgtgtgatctcgtatatggaacctataaaaccgttgaaccatagaaacggcagaacagaccaggcgctgtggttcacgcctgtaatcccagcactttgggaggccgaggcgggtggatcacttgaggggaaatggtgtcctgctggagggagaactgatcgatgtatctcggcacagcatcttggacactcatggcaggaaggagcgctactacgtgctgtatatccggcccagtcacatccatcgccgtaaattcgacgccaagggaaatgaaatcgagcccaacttcagcgccaccaggaaggtgaacacgggcttcctcatgtcgtcctacaaggtggaagccaagggggacactgacaggctcacgcccgaggcgctgaaggggctggtcaacaagccagagctgctcgcgctgacagagagcctcacccccgaccacacagtggcgttctggatgcccgagtcagagatggaggtgatggaactcgagctgggggccggggtacggctgaagactcggggcgatggtcccttcctggattcattggccaaacttgaggctggaacagtgaccaagtgtaatttcactggtgatggaaagacaggggcatcctggacagacaacatcatggcccaaaagtgttcgaagggggctgcagcggagatccgagagcagggggatggggcagaggacgaggagtgggatgactgagggacgtggctgcctctgggggcaccagcaccttctgtagcattgtggaacatttcttccatgaacttctactctggagctggagagaacagtctgccaagtcttacctggttcttccccatagccaccttggaatactctttgaacaagctctgctaaaaccaaacccatgaccactgtgttggtggtggggcctcatgctgtggctcagggagggcccctccctgcatgtgagtctagccttcctagacattacatgatgaccctttaaaaaaaaattagagatggaggtctcactatgttgcccaggctgatctcaaactcctggactcaagcgatccacccccctccacctcccaaggtgttgggattacaggcgtgagccactgcacccagcctcatgttgaccctggccctggatagcagctttgtttgtagaggcaggtggtgggagagaccctaggacagcctgagagtaactggacctggtattggtgcggagtggggaatatcccttgtctaaatgcagagcagctgagagaagttagcggggctcttcctccgttctcattgtttcctgctttccttccccacccaccccttcctcagcactctgtgttgtagcctgtactatcctgcttcaagcctccgtgtcccttgtaccttccccctaccttgagttgccagttctttactccctcaaatgttcccatgccacctctggggtttctgttatctgacatccctggctgctttcctggtagatgccattcccagagaggccaacagcgttcccaggcgtggctggctggtccgcatctctcagactcactctgccaggctacagttttgagaataccttttttgttgttgttttgtacctggagaactttttatgatgagtaaatcttcagaaagg

SEQ ID NO: 1553 - DNA, 1702 bp, Homo sapiens
agtgcaagagcagtgattctgggattcagatatgccaaagagaagccatgaagtgcatcttttaaattaaaagcctacctattctcccagagggcatgcattctatggagacagagctgaatgtgtgccatcagaagaccaaaatcaagcgacattttaaaaagaaaacagactcttctgggaaaaatggtgactccacaaagtaagaagccaccaagacttgtaggacattccttcatcttctcctggatggggcaacccagccatggatatatgcctccaatcagcataaatgcccattgcttgataaagtcaacacacgtgtaagatggtatgtagatcttctgggctcctggccttagactcttgcccttgtgtttaccaactcgattgtaaatcctttgagggcagaaaccatattttagatttcttcatatcctttcccttcctccatgtcactaacacttcatgtactcaacaaaggtcaacacctttgagaggagtgacaggagacactcccacagtgctgaactatgtcctgcccttgctcaacatggtgggactctgcctcccaatccaaagaccccgaaaactgccaccaatcctgtccttttcccccaaatgaagctagaagtaagaatggaaagagatctaaacaccatccagcccaatcttgtcatttcacaagcatggaaaccgaggccacagaaaagaattgacttaaaatcaagatcatgcatcccattagaggaagctctaactctagaatcagataatatgactctagttcaatgtccataagactctattgcacaattttttttggcatcaagtatctaaagatagttcagtcagaagaacctggaacctagagaagccaagggttagagtgtaggtggctgagatctcttactgcccctccatctgctctaggaaattctgtttcttgaagggaactcctcagagaaaaggaccacaagcaaattgctgctgctacaaaatgataccataatgagaatggaaataatcctggattctctgctcatttcgacaagtaaaataaggcacatatttttcaatggataatgttctttggtctctgtaaaaattgtttccgttttgacactttttgtaacctatttctttgaaacctgagttcactcagtttggggaaacatagggtacggaagaagaaggggaaaaggaatatggaatcacaaggatttagagtcaaagtaattttaactttcatagagagaccgcagggatcagctaacacaacaagcccattttacagaggagtcaactaaggctcaaagaatccatgagactcgcccagagaagcagctcattagtggcagagttgatctagaattctgggctcctgctgctgcaacccagtcctctttgcagcatcccaaactccctctctcataataatccaggataatagtcatttcccatttttaataagaaggaaatgagcacagagagaaccagtcacagcatgatggaagaaacctggaactaaagcctcactacttctctttcctgactgccccgccacctcagatcccaaatccacagcttacaggaagtttttaccaatgttatttctaagtgagcacagaatgtacggtccaagccagtgataagaattctccctgtagcctggggttattgtaattaaagtgcataactt

SEQ ID NO: 1554 - DNA, 2692 bp, Homo sapiens
acacggtaagagggagagcccaggtttgaacaagtctatctgattccaaagcctaaggtccttcttagcactcttcagcctgtttagataactggggaaggggagggtgggtgctctcccagaagcatattcattcagtaaactcagagcatctattttgtgccactctgcacggtactgaacgtacaaagatgatgaagtggtctctgtgggccttgggagcccatgttcaaggcaggaccattggaaaacagcatccctcatccttgacccggatggggcaggacattgatgaatcgtgatggagggggtgactatgggatgcttcaaaaaaaggcttcctggaggagatgacatttaactgaagcacatggacatttccaagaaaaatagagtaaggcagggatcaagaggcagagggaaaaccattagcaagaattcagagtccagaggccagcagaggagacacatggtgaccaacaccaagaaggagactcgctttcagtggttcttccagagggcagagatgccagatggtcagtatgacccagagacgggaacgggacttctctgcattgaagagttgtccaaaaaggacaagggaatttacagagcgatggtttctgacgatcgaggggaggacgacaccatattggacctcacgggtgacgccctggatgccatcttcaccgagttgggcaggattggtgccctctctgcaactccactgaaaatccaggggaccgaggaagggatccggatcttcagcaaggtcaagtactacaacgtggagtacatgaaaaccacctggttccacaaagacaaacgtctggagagtggtgatcggataaggacgggcaccaccctggatgagatctggcttcacatcctggaccccaaagactcagacaagggcaaatacactctggaaatagctgcagggaaggaagtccggcagctctcaacagatctctcagggcaagcttttgaggatgcaatggctgaacaccagagactgaaaaccttggccatcatcgagaagaatcgtgccaaagtggtgagaggtctgccggatgtggccactatcatggaagataggaccctgtgcttgacttgcatcgtctcaggagaccccacccctgaaatctcttggctgaagaatgaccagcctgtcaccttccttgaccgataccgcatggaagtgagggggacagaggtcaccatcaccattgagaaggtcaacagtgaagacagcggccgctacggcgtcttcgtcaagaacaagtatgtctccgagacgggccaggtcaccatcagtgtgttcaagcacggggacgagcccaaggagctgaagagcatgtgacagcgtgtgtccaggcacagtctgagtctagtctgcatggaccagtagggacaacctgtaccagggtcacagcctggcacaggctacaggggtggggcagaaggaaaggggacaagatagaacccaggatgtgagggtgggggtggagcggatgcaccaaagtggagaagcaaagatctttctggggtcctgagtggcttccaggagagcgggatgaaccctggacctggagtaggagacccggatgcactggggctatctaacagtactggcatctgataggtagaggtcaggtacgctgctaaacactgcagctcccaccacatagaattatccgaccccagatgtcaaaagtgccaagggccatgagccctgccataaactgatacatcgcacccctcttttaggatcccatagtttcaattcatgtaagttcaacagacacctgaagtctagcatgtgggaggctgaggatggagctgggaacacaaaggcagctgataagcaggttctgcttgcaaagaggcctcagtccagtgggagaaacagacctgggcgcaaacaactccaggacaaggcaggacatgataaagattataaagcaggtccaaggaaagtgccgccagtggtccaaggagggagacagagggtcgtcccaacagggggaggtagggctttgaaaacaccttcatccaggctgggcgaggtggctcacgcctgtaatcccagtagtttgggaggccaaggcgggcagatcacctgaggtcaggagttttagaccagcctggccaacatgacgaaacccggtctctactaaaaatacaaaaattagccaggcgtggtggcaggtgcctgtaatcccggctattcagaaggccgaggtgggagaatccgttgaacctgggaggcggaggttgtgatgagccaagattgagccaaaaaaaaattagcagaattggtgttgggccctgaaaaattagtccgattttgtggtggtaatgggagaaggacatcccaggagcagggtctggtgggaggaaagggaaggaggaggctaaggctgcccaggaggccttggataccaggcttggagctggtaacctccagggcttccagcacggggcctctgcctggtgtgacagataccggctggcctcacttgatggatctcagtactgagctgggcatttctctgccccccaacttttttctttttaaaaataagatggggagtgttcataaaattatagatgtttgttgtaaaattttggaaaaccctggaaattatagagaaaataaacataatctatactcccaacaccacaaagt

SEQ ID NO: 1555 - DNA, 1760 bp, Homo sapiens
gttacggagctgcttcctctccctagcctcaccctgcaggaatgccagtgaacttattgctgacatcttggagctcagtaccctcatagtgtaacggcgtcagcagatctgcctgtgctgggacttcctgtactacccattcctgaggggcaatgcttctgcagggcctgtgacttggtgcacaacttcagacaccatcatcttgcagcagcaccgcaccctcactagccagggtgttgatgacttcctcaaggccaaggccacattcaaggcttcggacttcattgatgcgcttgtgctgagcaaggtggcttctccgggatcttaattcaggaggtagaatggagcttgagatcaagtgtctgatcaaggtacttgaacttgatctggagggctctggggagccatggaagatgctggataaaggagtgacagtcagctatgttttcgagatgactgtagaagcccgcctggaaggagtgaacaagagccaggagaccagggagggagcttgtggggcaggtctggagatggtgagagagggatcctgcttggatgaaaggtcttcagggactgtctcaggttacacacaggtgtcctcagagctagtgtgttcagagtcttgcctccaggatgaaaatgggaaggagttgtcagacgaggacatataaatggaggctggcatattcatgagtgctggtggtggtcccggtgtgggactactgtgggaacaggggtctctccatccagggatatgatggatggaccctacatcactccattctgcccttcctttccctcctcccattctcccgaaagcctcagtgtatgggcgctgttcatcctctggtgctgaagcagccaagagacccaagtctgcctggctgcctcttaggatatgacagcagagccagtggcctctactagatcctgtacaacctcacaaaacacccagacatcgggagtgctgccagcctgtgatgcaagagtcctaatcctgaagacattgaatgacctgtcattctgctgtttttaccaaaaaggatcatgaggatcagagaggaaaagtcacttgcccaaagtcacacagctgaacagtggtggagttcaactttgaccgtgggctgtctggccccaaggtgtatgcttgcttctctcccaagagacaactttcttatcaggctcaaatgaatgaaaggaggatgttaaagttcctagaagctttaattgaatgaaagttcctagtagatctgtacctactaaaaaccacacttctgaagctacgtggccaccagaagacacagctagtctgccatgtaaaaaaggaaaggtggcgtgtgccctgaaggtgcaggggtgagagcagggaaatggagaccccaacagccagcagcagtggccctcatcacagccctccaggagatatcaaaggagacaacgccattattgacgagatcactcccaagcggattggagattgtcccaatacttagacccgtagcaaggccttgggagaaatggtggtgcagcaggagagcaggaacctaaccattgccatcctaaggccctgcattgtgcggagcaacgtggcaccagcttttcctgggttgggttgataatctaaatggatgtagccgactcattattgcggtatgtatagggatgaagaagtaactgtaatgtagtggaggaatagtaagaaaattcttagtgctggcttagcttcattgatccaaaaacataaatgctactttactatc

SEQ ID NO: 1556 - DNA, 1697 bp, Homo sapiens
gacggcacgccgcggcggggtgggtgcaagatgccgctgccggttcaggtgtttaacttgcagccagccagctctgtgtcagggtcggggggtgcagaaagtcaggacagaatgagggatagctcggcccccagctcggcctcctcgtcagtgacagatctgtactgcacccctcacagcagtaggtcagacctcgtcctgcccggcatggccggggacttcagcctgagcgccagcctgtcggcctgtacgctgctctacgagggggccgtggagcccatgcagatcgacgtggacccccaggaagacccgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctgaccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 1557 - DNA, 2797 bp, Homo sapiens
atcaccaacattctttcttcctcttggcttatattagggataggggatgtggtttgttacaaaggatgagtattttgatagcttctcattccttgaactattctgcaggtttataacaaagctcagaaaatactaaaggttaaaggagaattgagagctgccaaggaaatgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctctccgccagtatcagtccatcctagagaagcagacttccgacctggttcttctgcaccatcactgcaaactgaaagaagatgaggtgattctctatgaggaggaaatgggaaatcacaacgagaacacaggggagaagctccatttggcgcaggagcaactcgccttggccggggacaagatcgcctctctagagaggagcttaaacctctacagggataaataccagtcttccctgagcaacatcgagttactagaatgccaagtgaagatgttgcagggggaactcggcgggatcatgggtcaggagcctgagaacaagggtgatcattcaaaggtacggatatacacttctccttgcatgattcaagagcatcaggaggctcagaaacgactgtctgaagtctggcaaaaggtctctcaacaggatgatctcattcaagaacttcgaaataagctggcctgcagcaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctgctcagcaagcagcccagtgcaaagaagaggctgcactggcaggctgtcacctggaggacacccagaggaaactgcagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgacaagaagctagaggagatgagctgccaggtgctgcagtggcagaagcaacaccagaatgacctcaagatgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaaatacattgccaagctgagtggcgaaaaggaccacctccacagtgtaatggtccacttgcagcaggaaaacaagaagctgaagaaggagatagaagagaagaagatgaaagccgagaacacaaggctatgcaccaaagccctaggcccgagcagaacggagtccacacagagggagaaagtgtgcggcaccttgggctggaaggggttgccccaggatatgggtcaaagaatggacctcaccaagtacatcgggatgccccactgcccgggttcctcatactgctagaatccacatctagccctgagcagcatttccacgggtgtttcttcagaggacagtgagttcccagccctccctctctcttgacctggatcagctcttacaggagtatatcacggtcccagcctattttgcaagacactaacttttgttgagttttgtccacttcctgccatggagtgagctttagaaccatactaccatctccaggcccaaactctgaaataaagacatgagcatg

SEQ ID NO: 1558 - DNA, 1867 bp, Homo sapiens
atggtgcaaaacagcctgggataatattgccagctgccagaccagactagggtggctcaaggggttgccatagtttctaaatcttttgaaggaaaaactgatcgcacagaagagtggtatggaacccagtacaaacaagaagctataccggatgaagtcatcaagaaatggcaaaatgctgacctgaatgggaaatttaaacttcctacaaagaatgaatttattcctacgaattttgagattttaccgttagaaaaagaggcgacaccataccctgctcttattaaggatacagctatgagcaaactttggttcaaacaagatgataagttttttttgccgaaggcttgtctcaactttgaatttttcagtcgctacatttatgctgatcctctccattgcaacatgacatacctgtttatcaggttattgaaggatgatttaaaagagtatacatatgcagcacgcctctcaggtttgagctatggcattgcatcaggaatgaatgcaatacttctttcagtgaaaggttacaatgacaagcagccaattttactaaagaagattattgagaaaatggctacctttgagattgatgaaaaaagatttgaaattatcaaagaagcatatatgcgatctcttaacaatttccgggctgaacagcctcaccagcatgccatgtactacctccgcttgctgatgactgaagtggcctggactaaagatgagttaaaagaagctctggatgatgtaacccttcctcgccttaaggccttcatacctcagctcctgtcacggctgcacattgaagcccttctccatggaaacataacaaagcaggctgcattaggaattatgcagatggttgaagacaccctcattgaacatgctcataccaaacctctccttccaagtcagctggttcggtatagagaagttcagctccctgacagaggatggtttgtttatcagcagagaaatgaagttcacaataactgtggcatcgagatatactaccaaacagacatgcaaagcacctcagagaatatgtttctggagctcttctgtcagattatctcggaaccttgcttcaacaccctgcgcaccaaggagcagttgggctatatcgtcttcagcgggccacgtcgagctaatggcatacagggcttgagattcatcatccagtcagaaaagccacctcactacctagaaagcagagtggaagctttcttaattaccatggaaaagtccatagaggacatgacggaagaggccttccaaaaacacattcaggcattagcaattcgtcgactagacaaaccaaagaagctatctgctgagtgtgctaaatactggggagaaatcatctcccagcaatataattttgacagagataacactgaggttgcatatttaaagacacttaccaaggaagatatcatcaaattctacaaggaaatgttggcagtagatgctccaaggagacataaggtatccgtccatgttcttgccagggaaatggattcttgtcctgttgttggagagttcccatgtcaaaatgacataaatttgtcacaagcaccagccttgccacaacctgaagtgattcagaacatgaccgaattcaagcgtggtctgccactgtttccccttgtgaaaccacatattaacttcatggctgcaaaactctgaagattccccatgcatgggaaagtgcaagtggatgcattcctgagtcttccagagcctaagaaaatcatcttggccactttaatagtttctgattcactattagagaaacaaacaaaaaattgtcaaatgtcattatgtagaaatattataaatccaaagtaaattacaaaatctt

SEQ ID NO: 1559 - DNA, 2000 bp, Homo sapiens
aactgcttctctctctctcttttactcttactctttctctctcactctctctcttttcccacccttaagccaagtacagggatagttgtctcatcattggtggcttaaaatgatgtttttgaacaagaagacaccccatgggtacttttggtgctgtgttgtcctgaggcctgggccatggtgcccaaggaaagcccctgaagctcaccaggaggaagaagcatgcagggcactcctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctccgaactgaaagacatcaaagcttatctggagtctcatggacttgcttacagcatcatgataagggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggatcgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttggtgagactggctgcttagggcctggggagaagagaccgcttcacaggaaaatccatatctgtcatactcccagagggctcaggttgttactctgaatgcaggggtctgggctgattgaccccatggtgcgggggtggggtagggggagcttgctgttctcacgtgtgatcaagttcaaagctggaaatgctgtgctcccttctcacaagggccatctccaccttcaacttccaggactgctaaatccatgcttctcaccagctggtgagggtgggggagtgtgtgggagccccggggagcccctgcctttcaccccgccaatgtcatcttgcagtacgatcttgccaaggatgcggtggaggccttgtataaggtccatgggatcgagtacatttttggcagcatcagcaccaccctctatgtggccagtgggatcaccgtcgactgggcctatgacagtggcatcaagtacgccttcagctttgagctccgggacactgggcagtatggcttcctgctgccggccacacagatcatccccacggcccaggggacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacaggc

SEQ ID NO: 1560 - DNA, 1757 bp, Homo sapiens
gttggtctgtagatgttgacttcactgatcttagtgagaaccttgctaaaaaattaaagccttcagggactgatgaagcttcctgcacaaaattggtgccctatctattaagttccgttgtggttcactctggtatatcctctgaaagtgggcattactattcttatgccaggaatatcacaagtacagactcttcatatcagatgtaccaccagtctgaggccctggcattagcatcctcccagagtcatttactagggagagatagtcccagtgcagtttttgaacaggatttggaaaataaggaaatgtcaaaagaatggtttttatttaatgacagtagagtgacatttacttcatttcagtcagtccagaaaattacgagcaggtttccaaaggacacagcttatgtgcttttgtataaaaaacagcatagtactaatggtttaagtggtaataacccaaccagtggactctggataaatggagacccacctctacagaaagaacttatggatgctataacaaaagacaataaactatatttacaggaacaagagttgaatgctcgagcccgggccctccaagctgcatctgcttcatgttcatttcggcccaatggatttgatgacaacgacccaccaggaagctgtggaccaactggtggagggggtggaggaggatttaatacagttggcagactcgtattttgatcctgagagagtccaaaatgcactggtcacgaaacgtctaatactatgactgttaaaatgtcagactataacaaatatctatcttttatttttcattagacccttatacttcaagagaacacactcagtgcttgtttttattttcttgacacatttattaacaaaatgcatcatggaaaaaaaaatctacctcttaaaattccatttgcttttatggttagacatgcttgaccaaaaatgttcagaagaaaatatgtacctggtccctaattaagctgcgttaaatttggtagaagcatttaaatggtctatcttcagttttactgaacaaaaaatgtaatttatttagcattctttataaaagaattgatgctagaggtaaaaaaaaatacttgtttttaaaaaatcctttacgtcttgtgtaattaccccattattaaattcaagtccttgaaaatcaactagagattataaagtctctaaagaaggcaataacaaaatttatcaagatatagtacttttcagtttttgtttagtgtcttcagcatcactgtgtctgtatttcaagtacaaatgtttttaaaaaggattctttatacatatgtgctgaattgattttaagaaagttgcatgatcctgtaggagcaacatttttacctaaaaaatgctaactttatagtatttctaattgttcaaggattttaaaattctatttcagggagtatatcttctgtggttttgaaggaggtgagttctgtatgtgccttgcagtactgtaattcaaaaataggaatctttggctgcaaaattttaatgaaatgttaggaagtaattttcgtgctaacattaaaattataactttttgaaaggtaatagattttccagaagtaaaatctgatggttctaaatcaatcaatgtgatagttcatttttaactcttagaagaattcagaggaaattaacccagctaagtaaaaaatctgtcttgattttgttacttattcctcagaatattaaacattgatcacatatttttagagtttt

SEQ ID NO: 1561 - DNA, 2031 bp, Homo sapiens
agtgtgagacattccagccaatgagacccacaggctttggaggcgatgggtccacctgtgagtggagtacagaacgtgggggaacagcttcccaggagtctggggctcaacctctccaggaggccctgaaggtggcctgagaaagttctgcctctcgggggggcagcgtggagcacaggagccgcagtgagtcctgcctggctctaagcaccactttccaagcatgcagctttggcaggtgaattagcccagtactcagtttcctcggcgggagagcagggctgtggggtggcacctgcctcacagggccgctgggagggatgcctgggtgacagtgaacgcaaggagcatgctcatacaccccaaacatggcgagcgttatctggaggcatatgcagaggtgggactggggaccaggtctccaaagaccaagaatcagccgaggcactaaggggcagattgcagaggtgaacagtcccgccagtgagaacccggccctgttattccacggccttctctgccttctgcgagaaaacgaatttcccagaccccagcgcaggcctttctcacgtctcagcagcagggaccgtggctccaactgcggctcaggatgaaggccccaggcgctgaagagagtgaagccgaacccctcctcaatcccaaaacactggggaccacggtgagacagcgacgccctggatgctgcctggtcaaggtcaggctgtgatcggcctgtcaggcgtgtggcagaaccagcttcagaggcagcggtgtccacgtaatgagctcaaatgatgccccaggaagaacatagatggcttctttctttaattcctcagcatgtttttaaatttaaataactctacattgcattttggaaaaagcgcttctaacataagcctgtttgactgcagttaaataatttatgtgtctcttggcctgggaatcactgtctccattattttttttatgtgactcactttattgctccattattattaataataaatatgtcaggaatcaggcacacaaaaatatcaagaataaagaagtatataaagagctcctcaagacacaacccaaatgaaagatgggcaaaagatataaacaagctgttctttttcaaaaaggagaaaagaacagcaaatggacttaaacacataaaaagattctcaacctgcctgttagcaggagaagtacaagataaaaccacaacaggacgtggcatctcatccagcagcggtaggcaggcccagaagctggcaagccgggcagcgcaggctgctggcgaggtaggtggagaacaggcatcctcctacggcactgacagagcaaaccgcaaacgtaccccccttctcagaaatctcccttctccaaagcgatcccaaagctgtcctcgcagaaatatagctgatgtactcacaaggcatctgcagcactatttataaaagcagaagattggagcccagctgtccatgatgtggggcggccaggggcgggggaggttgagtccacaggggaacatcacgcagctgtgcagacacatgcacgccatccacataacacgcaggtacaaagggacggagggacagagagaaaaaagtctgggccggggtaactgtaagccaccgtatatgtcattgggaacactgactcatttaccctgggcctgatgtcactgacttctacctcctgccccaagacttagagtgaaagatgaaaagatgacctgttaactcacctgtgggcaggatgtgtagaccatgtagcatatgtgattgaatacacagccagtccctccattaactccaaaggacacggctccttcggcagctgctggaggccaggcggaagccactcccaggtgggtgcatcctggctgactttcctggaaagtcccgatgctacactgacaactacattctctttagcaattgtaggatggccagcaaggacactgtggttatcggcggtggaaagtaaattcttggcatcctactgctattccaggctattaaactacattacggt

SEQ ID NO: 1562 - DNA, 1561 bp, Homo sapiens
gtttccgaagcccgccccaccaccgtcgccgcaccagtggcccaggcttcgtgggaccaacagggctaatcctgccccacggatctaatccggatcgggacccggtcccaggggaggcccccacctccccttctattgttctgtggcccagcggtccgccgtcttcgagcgcgtcctcagcgcgtcttactacactgcccagcactgcgcagctccccctgcgcactccgcttgagccagctgcgtacggtgctcgtggccgatcacctggcgcgagccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctggtgactgaggatctcctctctgtgctggctgagctgcaagaggctctatggcattggcccgaggacagccacccaggcctggctggggcctcagatactggtacaggcggctgcctggttgtacatgttgttagctgtgaggaggagttccagcaacagaagttggacctgctttggcggaagttggttgacaaggctccactcagacagaagcacctcatctgtggccctgtgaaagtagctggtgcacctggcactctgatgactgcccctgagtactacgagttccggcatacccaggtgtgcaaggcctcagcactgaagcatggtggggatctggcacaagacccagcctggacagagatctttggtgttctctctgtggccaccatcaagtttgagatgctgagcacagccccacagagtcagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgagggtgagtggttgttgctcttcaacagtatcctcccctttccggatctgctgagccggacagcagtgctggactgcacagccccggggctccacattgctgtacgcacagagatgatatgcaagttcctggtacagctcagcatggatttcagctcctactacaaccgggtacacatcctgggggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgttac

SEQ ID NO: 1563 - DNA, 1838 bp, Homo sapiens
tggaccattagtttccactgcagtgtttgcagatggagtcgaatgtaaccccccgggaatggagccgggagggtcagagaacgcggctgcgctctggatctccgaaggggggcgggggcctggaagaggtccgggcccagaatggacctccaggtccctgctgccgcaatctggccctgccctccagcctaccccttactcccagaggaagggacccagggagacccacccagatgccctgaaaggaggtggaggatgggggtggggcaatacgcagagtttgtctggtgaatgcaggaaaggggtgggggctggagaggaaaaggatggagcagccgtcagcttgtcaactccgcatctgctggctgcctcggccgggctccagcctgcgccctcgcccctcggaacagcgggacccaccaccctctctcaggcaccttcaggatctggtactgttctggagtggcccgttgcagacactgaaccaccagccagctgcatttgttgtcctggatgtcagtgccaattttgccggtcacactggggtccccaaagaggtcaaggcacgctgcaatcctgtaccctgaaaccagctagatgagcatgtcctatagaggccaaggctaccatgggcaccctctgggcatcgggccctgtctgcaatacacctgcaggaagagctcgatcaggttcagatctgtccccggcgggtaagggatgaatccatgatgtcatctgccaccaggaagaaagcttgcagctagaaagagtggaataagacctgcagggctcctcattactgttccttctatcagcaacagagctgctactttatatctgtatatagttttgcttttttttggtaggggacagagtctcactattatccagtgcagtggtgcaatcacagctcactgtagcctctaactcccaggctcaagtgatcctcccacttcagcttcctgagttcctgagaccgtgggcacataccccatgcctggctattttttttttttaatttattttttgtagagacagggtcccactatgttgctcaggctggttttgaacccctgggttcaaatgatcctcctgcctcagcctcccaaattactgggattacaggcatgaggcatcacagccggccagagctgctgcctttgacagtccctatgagctgggaaagtcaggatggggagacagaagacttctgtgctatggagacttggaaagtgacataacatgtttggctcagactccccgcctataaaatggaactaaaacactcttgttttaggttaagaaactagaacagatctttgacatctctaatgagccctagattattcctggtgtcagggagattaggaaacaccttcatataccgtactctattcttgccaaaaacctcaatgaatgcttaaagtaagatctattcatgaaactgacttcacattacttcctaaataaaagaaggctattcccacattgcccccagcactgtgtttgaacaccctggtgactaggaacacagccttacctaaagcagctccttagcagtgcaggtctaataaggtggaactgaaatctgactttgacctatgagtctcagacatctttaaacatctttaaacattaactaagggcttactcttctgagtgcccatctgaaggtacctgaacgtgtcgggtttcccactagaccatgatctccttggaagcagggacagtaacttccccctcttagcatttgcagagcctagcacagcattaggcctggagtgagagtttcctaaacacttgtctgacaaagaaattaataaaacactctaacattc

SEQ ID NO: 1564 - DNA, 2879 bp, Homo sapiens
atccggcggtggtgacgcgagaggctggggtctccagcctttagtctgcctgcgcgttcacatgcacccacttacttcttgaagtctactcctcacaagtaagggctatggtgcggggtgcccgattcctgagaaatctgaagatgtggaagtttattttttcttcccaaaatcagcagtagagggactcaggaccaactcctcttcatcttcgtcttcctcagcctgctcaatgtgaagcccctgatcatgattcacttccacttaataaataaagtgtttacaaatcagaataacttttagacaatattaaggtggtaatcatgaacagaaaagattttgtagttcttccatggggaaaacctggaaattctgtaaagctaaaatatagaaatgctcaagaactgcgaatggagaaagtacagttagagtttgagaaccaagagatggagaagaaactgcaagaattccgatccacaagaaacaaagaaaaggaagatagagagtcaagcgagtattactggaaatctggaaaagtgggcaaattggtcaatcaatcatatatgatgtcacaaaataaaggaaatgttgttaagttttctgctggaaaagtgaaattaaaattgctgaaggaacagattcaagagccagtgaaaccaacagttaattataaaatggcaaattcttcagaatgtgaaaaacccaagataaatgggaaagtttgtggacagtgtgagaacaaagctgctctactggtatgccttgaatgtggagaagattattgttcaggatgctttgctaaagttcaccagaaaggggcactaaagctccacagaacaactcttttgcaggcaaaatctcaaatattattcaatgtattggatgttgcccatcagttcataaaggatgttaatccagatgaacccaaagaggagaataattctacaaaggaaaccagtaaaattcaacataaacccaaatctgtacttctccagaggagcagctctgaggtagaaattacaacgatgaaaagagcacaacgtacaaaaccaagaaagagtctgttgtgtgaagggtcattcgatgaagaagcttctgcacagtcctttcaggaagtgttaagtcaatggagaaccggaaatcatgatgacaacaagaaacagaatttacatgcagcagtaaaagactcattggaagaatgcgaagtacagactaatctgaaaatttggagagaaccacttaatattgaacttaaagaagacattctatcctatatggaaaaattatggcttaaaaaacacaggagaactccacaagagcaactttttaaaatgctaccagatacgttcccacatccacatgaaaccactggtgatgcacagtgttctcaaaatgaaaacgatgaagatagtgatggtgaggagaccaaagtacaacacacagctcttttattgccagtagaaacattaaacatagagagacctgaaccatctctaaagatagtcgaactggatgatacttatgaagaggaatttgaagaagcagaaaatattgtgccttacaaagttaaattagctgatgcagacagtcaacgaagttgtgcttttcatgattgtcagaagaatagctttccatatgaaaatggcatccatcaacatcatgttttcgataagggaaagagagacttcttaaatctttgtctgagaaacagctctacttattataaagataattcaaaagcagaaacttcaaacacagattttgacaacatcgtggatcctgatgtgtattcttctgacattgaaaaaattgaggaaagcacctcctttgaaagaaatttaaaggagaaaaatataggtttagaaagtaatcaaaagtctgatgattcctgtgtatcacttgaaagcaaggacactttgctaggtagagatttagaaaaagctcccattgaggagaaattatctcaagacatcaaagaatccttggaattgagcaatctgtataagaggccaagctttgaagaatcaaaaactacaaagtcatcactgtcgttacaagaaatagcctgcagaagtaagcctataacaaaacaatatcaaggacttgagagattctttatttttgatacaaatgaaagactcaacttacttccttctcatcgtttagaatgcaacaattccagtactaggattacacttgcaggtcagaaatcacagagaccttcaacaggaaattttccactttccaactctgttaaagaaagctccagttgcctttcatcctctcatcctcgatcaagaagtgcagctgctcaatcatcatctagagctgcttctgaaatttcagaaattgaatatattgatattactgaccagaatgagctttccttagatgacactactgatcaacatactttagacaatttggaaaaagaattacaagtgctgagatctcttgcagatacttcagaaaagctttacagcttaacctcagaagagttcccagatttcagcagccaatcactgaatataagtcagatttccacagatttccttaagacctcacatgtgaggggtccctgtggagttgaggaattgagctgttctggaagagataccaaaattcagtctttgctgtcactttctgagagcagtacagatgaggaggaggaagattttctcaacaagcaacatgtcatcacactaccgtggtcaaagagtacttaaagattatttgttcattactgtttccattttgtacccagagtaaagcaaacaactgagaaaagtaaccaagtgattacctatccaagtgctggagattttgattactaatgtctttgatgtttcaaggctacaaactaataaaagtaaaattat

SEQ ID NO: 1565 - DNA, 1918 bp, Homo sapiens
ttgaaagatgcggccctgaccctgtgaacctcgcgcagagcggcctgaagcgagaggttgaggctgggaggtgggagcaacggcggcggcggccgcctgcgagcccccggcctgaggcgcagcagcagctgcccgtcttcccacatagagggcaggaaggacaactttgagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggagactgtgacaacaggtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggtcctcctcctttccctgcagaacctgttgttttatctgaactagcatatgtttcaaaagtatattatgaagggagacatattcaatatgcaaagatttcacagatcgttaaagaaagatttaatcaactaatttctaatcgttcagaatacctgaaatatagcagttcattggctgcttttataattgaaagagctggacaacatgaggttgtagctataggcacaggtgaatacaattacagccaggacattaagccagatggaagagtattgcatgacactcatgctgttgttacagcaagaaggtctcttcttaggtacttttatagacaacttctgctcttctacagcaaaaatcctgctatgatggaaaaatcaatattttgtacagaaccaacttctaatctactcactcttaaacagaatatcaacatttgcctttacatgaaccagttgcctaaaggatcagcccagattaagtcacagttacgtcttaatccacattctatatctgcatttgaagccaatgaagaactctgtctccacgtggctgttgaaggcaaaatttatctgactgtttactgtcctaaagatggtgttaatagaataagcagtatgtcctcaagtgacaaattgaccagatgggaagtgcttggtgtacagggagcattgctgagtcattttatacggccagtttacatcagcagtatacttattggtgatgggaattgcagtgataccagaggcttagaaatcgctataaagcaacgtgttgatgatgcactcacttcaaaacttccaatgttttacttagtcaacagacctcatattagtttagtaccctctgcatatccccttcaaatgaacttggaatataaatttctgagtctgaattgggcacaaggagatgtttctttggagattgtggatggcctgagtgggaagatcactgaaagttccccatttaaaagtggtatgtcaatggcaagtcggctttgtaaggctgcaatgttaagtcggtttaacctgcttgccaaagaagctaaaaaagaattacttgaagctggtacatatcatgcagctaagtgtatgtctgcctcctatcaagaagctaaatgtaagttgaaatcctacttacaacaacatggctatggatcctggattgtgaaatctccctgcatagagcaatttaacatgtgaaataggcaatccattatcacattaaaaatcttgttttgtttggtg

SEQ ID NO: 1566 - DNA, 1415 bp, Homo sapiens
agagatccagagcttgaaaagccagatcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagatgctcggtgctaaaggaagagttaaaacaggaagatgctcacagggagctcagggaagcccaggagaaagagttaaaactctgcaaaacccaaatccaagacatggagaaagaaatgaagaagcttagggcagagctgaggaagagttgtactgaacaaagcgtgatctctaggactctgagagaaaaaagcaaggttgaagagaagcttcaggaggattccagaaggaaattgcttcagctgcaagaaatggggaacagagagagcgtcattaaaatcaatttggagagggcagtaggtcagctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctccgggacctcgggatcctgccctccagccccaacaaagatcaagttcaacagttctcaggaaactcagcagtctttactgcaggaaaagctgcgggagcatctggcagagaaggagaagctgaacgaggagaggctagagcaagaggagaagctcaaagccaaaatcaggcaactgacggaagagaaggcggtaaggctttggaggagtacattactcaagagagaaacagagcgaaagagactttagaggaagaacggaagagaatgcaagaactggagagcctcctggcccagcagaagaaggctttggcgaaaagcattacccaggagaagaacagagtgaaggaagcattagaggaagagcagacaagagtccaagagctggaggaacgcttggcccgccagaaggaggttttggagagcagcatagcccatg

SEQ ID NO: 1567 - DNA, 2767 bp, Homo sapiens
aaaaactgcttttcaagacagaccagcaaactgaaaacttgagagctgatgggaccgctggaaaagatccttcacaaccatcacgtggccacctgaactgttcagtgtcactgcaacgggtttaggatcagaatgttccagcagggagcactacagctgtttcaatcttcagggagactactcatcttgggaataattccttcctttgtcctgtcagcataatgtgtatggaccctgctaagcagcacccagtcatgaaagtgctgccaccgaggaagtggaattttcttctgaggaggcaagaactgaggttgctgcagaccagcaaggattcactgctgataactcaagataccttccaccagtaacttggagatgacaccaagagacaacacaggcaaaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagctgctctctgcacaaaaacagagggtagctgcaagaacaaggagactcctccttcaggagacccctcaccgaccaacaggataaacttcctccatcatcccacagaagcccttccccacacgccagcctcagggactctgcaatgcagccactctgtggaaccaggggtccatcctctacctgctgtaccaatgaggtttcaaagttgggcaggacaagctcactgagtcctatttattctggaggttttgtcacttggaggaacaccatgtttggagttatttatgaaacccagcacctcctattttcttcctctcagcagatggtccaaatgcccaagccagagatgcaagactgatcttcactctctctctgactttctccttccacaccaaatccactaccctatcctgcatttttctaagtactaaattcctcacaaattttactaacttttctaatttcactgatctcacctggatcactttagccaccttccaagtagccaccctacctgcaagcctgcacctgctcccacccaaaaccactccctcaagcttaaaaccctttggtttatttctattaactagctaaagtctcaagtttatgttagtttgcaagtctctcagcccctccatgatgtgacctttgcatatcccccacctttctaacactgacttcccttatccttcaactaccacaactgcctgcatctactccagaaacatcccatttctcgcacatccccaaatatgtccactgctgactcactcctgggtctttatctacaatggtcactctacccagaataccatttctctctctggtattcatctgttcttccagctgctctttttgtgcagactgcagctggctgtgcagcactgtggataaactgctggtgcaaatgtacagagaggtctggactgggcgactccaggaatgggggagattctccttcatagaccaatttagaagtcacttcctccaagacgattgccttgaatcattgactggattatttctccgctgtgtgttcttctaacagcctgaacagagctaacaccaacaccgagacaccaccatgaactcaccagccattgacttctctgttctatagctttttgcctctttggaataggcatgtcatgggtgcagacatccagcccttcatagacactgccagccgttaacccgaagccctgcacagccacttcctctctgaacagaaaagactgccacaaggggagagacggtcttaccttcctgagcctgcccttgccagaggaagccactgccaccgcagaagcacttaggagcctttcccacctccttgcactgagacttatggaactcttgagggccctagtctgtaaaagtccatccccggcctggcgcagttgctcatgcctgtaatcccagcactttgggaggctgaggtgggtggatcatgaggtcaggagttcgagaccagcctggccaacatggtgaaaccccatctctactaaagatacaaaaaattagacaggcatgatggtgcacacctataatcccagccacttgggaggctgaggcaggagaattgcttgaacccaggagatggaggttgcagtgagccgagatcgcaccattgtactgcatcctgggtgacaggatgagactccgtctcaaaaaaaaaaaaaaaaatctatccccagatcacggtgcgcctgtgagacagagctgtcaatgtcctctttcccttccttctcatttgctgtttcaatagggcttcatcagcctgagttctttattagaattgacctgcatcaatccagtgcccccctcataccacctactagggaaggctgcattctacattacggtcttcagggatcctctctggggccccacatgcttccctttttgtttacctgtgtctcggggcaattttaatcttagtcttatacttttcatttaagcaggttaggctacactatacacttacagattttgccagtagaagctttgagacttcacatcttgtaaaataaaaaaaaaaaattgtact

SEQ ID NO: 1568 - DNA, 3015 bp, Homo sapiens
aatggggcagccaggagtgctcgagaacagatggggccaggcaccatggcccacacttgtaatcccagcactttgggaggccaaggcaggcagatcacttgagcctccccagggatatgaggcggcttgtgaggtcctctggagtcagaagatgccaccaccccagaggatgtgagcccacctgtggaggtcttgatccccaccactaggatggggcaggttcccaggctactttggtggatctgagaataaatccctcaagacaaggtccttgctctgcccttctccagggtgggacccagagttactggcccctccatcccatggagctgattctgcaaccctcacttcctaagcacagaaatctggaaccactggttaaaaagaagtctgagagccaaaatacacacagccagctgtgagttactacctgccttacccaggaaaaggacatgagctgcccaagcacacacctctttgccatctatgccagcatttttaccttcaaggccgatgttctcatcgtgttaagtacatttgagtttagtttcacctggacaacatgtggggcgtgggcaggcagtgagaacacagatggtagccctcgaagcatcccagcctgaaaagcacatgagtcagcccttccttccacttacccactacctctcacgctggtcgtcttttttattttttctctctctctcttttttgagacggagtctggctctgtcacccgggctggagtgcagtggcgccatctcggctcactgcaacctccgcctcccaggttcaagcaagtcttgtgcctcggtttaccaagttgctggaactacaggcacgcaccaccacgcccggctaatttttgtattttcagtaggctggatttcacgatttcggccaggctggtctcgaactcctacactcaggtgatccgcctgcctcggcctctcaaagtgctgggattacaggcttacgccaccacaccaggcctccctggtcttcttaaagtcaatcaatcccaactcctgtaatccatgtaactgctttgagtgactctggagccatctttgaagcccccacaaatacctaaatgaggaacaggagccctgcaacacattcccctaaactgtgttcctaagaaccatccaactacctgtggaatcctaaggccccttcctcattctctttaccagtatcctggcaatggttgtttaagcctagttaatgacagaagctccagacagatactgttgggggtcctctacgaaaagacaccgccattcccgagggtgacgctgcagcggcccagcacttgtgcgcatagaagctaaggggaaattaccctaccctaaactccagtgaaaagccctttgcagtccgacaggcttgcattcacatcccaacagtgtggggtttggacaaattccataatctgagtctgtttcctcctctagaatgcgagtctatgaattcctgtctactgcctggaagtgccgctgtcaggactgggataatgtgtgtactttcggtgcacaggggacgctcaacacgtgcgagcttcccttgcagaaagccaagagatgaaaggctgggggccgcccctgccttaacgtggatcccacactctccgagatcatctccccagctagcgcttactcctgcccaggaaccagatcctggggcctccggcctcgagcaatcactgacctgggatcacggacagatttcaagcatcaggaagaaggtgggagtagatggcagtgaaggtgcctctcgactgggagatgcagtgtgcattggctgggatccccttcctcggctccctactccaccactactccagaacaaactcctacctctgtttgcaactaagagttacatcccccatgccaagaccttccgaggcgtcccagaggggcttgctgggaggattaaatgagatcatccacatcagggtcagcacggtgcccggaatggggtacctgtgaaattaatgggaaattcctcgctgccggactgcgcccacccttgaggacctcacattctctttgggcagagcggaagccagacagagacagggactacgaagcgacaatccccagccctgtgtgtgcaaggagcccccgaggggcaggcagccacgctgcagaaggctagactctccgacccccagggagcctggtgtgggctgcagggacagaacgcttctcagaggaggtagggaccccatggagtacgtgacgcctggccctccagctgcatgctccagttatcaggacagagacccctccccacccattcccaggcttccctggctccctgctctgctgctgggaggccctgtcaccacacatgcgcgtgcacgcactaacatacacacacccctctcaggcacccccggaagaccagctgcagctgggggtgggggtgcacggagcacagccagggttctcagatccctagcctgctctcccaccccgccctagcccccaactgccgagctgcttctagttttaaagcaaaacatgactctgtccttcctgctgctcagtggcagcaacactgcctggggttatttttagcagggatgcagggaaggcacagttctccttgactttaactagggacaacccccacccctcagccaagactcactggaggaggccgggtacggaaacccccctcccagaaaggggaaatggtgtgttttctgttccttcaattcactagaatgggagttgcagtcaagcttggggttgaactgatgggaaattctaggttccaaagcctgtgggctctgccccatccctggtctctgtgtttccatgaatccgggaagcaagaggcacatggtgtctggagtcgaggtgccctgtctgtgggtgttggtgtccctgggaaactgcttggttatagccaggctctgtggactacacaggggcaccaggcattgtgggtggtgtttcacaggcgctggctaaataattcattaaactgagcatgtccgttccgtgt

SEQ ID NO: 1569 - DNA, 2011 bp, Homo sapiens
acagtgactatgatactgcctcctaagcaaggacacaccccagtgatgagaaataggcaaaccatggtcttgaaatgcctaggagtataggctggggtttggagggaaatagttggatgacctcaggaaatagaaaaaaacaggcagctgctttttggagagagtggagatgagatcagtgcctacctggaacaaaaccctctggcattctagactggctgaatatgtagtgtagggactttatcatctgtcagaaaatctcttttaagaagaagcgatcaagaagtttagtcctggccaggtgtggtggctcacgcctgtaatcccaacactttgggaggccaaggcaggcggattacttgaggtcagaagttcaagaccagcctggccaatgtatggtgaaaccccgtctctaccaaaaatgtaaaaaattagccaggtgtgatggcacacacctgcaatcccagctactcaggaggctgaggcagaagaatcatttgaacctgggatgcagaggttgcagtgagccgagatcctgccactgcactccagcctgggtgacggagcgagactccgtctcaaaaagagttcagcccctatcctgtacagatgagaaaatagacctggaggaaacccaagtctatcaacagcagagaccacaacccatgtcagtgcaaagaagccaagtgttgcactaccctattgggatccagctcacattgagccagttttgttttttgagctgttacgcaagtgccttctgtcgaagagaagctttactcaattctacagggcagcccccttcctattttcagtggtagaaaagatgagacctggggatccacacttgaggctgtagattggtgctggcagccctgcttctgcaactgagtctcagccctagtcttgaccttgttctttttctctaacaagccttttctctttctaaccctccctcccaatatacccacttcatactatccattgttcatacacttctctacctttattcctcttctcatattcctcccttcgccagagtgtctttttccaccatcttcacctgagttcaattcatccttcaaggtcccggctcaaattccaccttcaccaaagagcttcccagttttctccagtaaaaaatagtttccctcccttgtgttcccaagggggaagggaggaaaaaggataaacaagcattaagcacttgatccattttaggcacttcgcatgtgtcacttgtatgagggccctgtggtaggaggctggtacaaggttttggatcggttcatccctggcaccaccaaagtggatgcactgaagaagatgttgttggatcaggggggctttgccccgtgttttctaggctgctttctcccactggtaggggcacttaatggactgtcagcccaggacaactgggccaaactacagcgggattatcctgatgcccttatcaccaactactatctatggcctgctgtgcagttagccaacttctacctggtcccccttcattacaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccgg

SEQ ID NO: 1570 - DNA, 2033 bp, Homo sapiens
aaaacagcggtcccacaggcaggagggatctggaccggcggcttcttccactaccagagaggctgaggtggcgggagagacccctctcctctgggggtaagtggctggcgcggcgagtgtctgcggcgcgcttctgcggccatctgcgccctgactgacggcggccagttcctcgaggaggcccggcgggaaggatttcaatggatattataaagggaaacctagatggaatttcaaaaccagcttcaaattcaagaatacgccctgggagcagaagttcaaatgcttctttggaggtgctctcaacagaaccaggatccttcaaggtcgatactgcaagcaacttgaactctggtaaagaggaccactccgaaagcagtaatacagagaacagaagaactagtaatgatgataagcaggaaagctgctctgagaaaataaaattggctgaagagggatcagatgaagatctggatttggttcaacatcagataatctctgagtgttcagatgaacccaaattaaaagaattagattctcaacttcaagatgctattcagaagatgaaaaaacttgataaaatattggcaaagaaacaacgcagagaaaaagaaattaagaagcaaggtctagaaatgagaataaagctgtgggaagaaattaagtctgcaaaatatagtgaagcttggcaaagtaaagaggagatggaaaatacaaaaaaatttttatctttgactgctgtttctgaagaaactgttggtccttctcatgaggaggaagacaccttttcctcagtgtttcatactcaaatccctccagaagaatatgaaatgcagatgcagaaactcaataaagattttacctgtgatgtggaaagaaatgagtcattgatcaaatcaggaaagaaacctttctcgaatacagaaaagattgagctcaggggtaaacacaaccaggattttattaagagaaacattgagttggccaaggaatcaagaaacccagtggttatggttgacagagagaagaaaaggctggttgagcttttgaaggacttggatgagaaagattccgggctctccagttctgagggtgatcagtctggctgggtggtcccagtaaaaggatatgaacttgcagtcacccagcatcagcagcttgctgaaattgatataaaactccaagaactctctgcagcctcccctacaatttccagtttttctccaagacttgaaaatcggaataatcagaaacctgaccgtgatggtgaaagaaatatggaagtaactccaggagaaaagatacttaggaacaccaaagagcaacgcgatctgcataatcggctgagagagattgatgaaaagctgaaaatgatgaaggaaaatgtgttagagtccacatcatgtctctctgaagaacagttaaagtgtcttctggatgaatgcatacttaaacaaaaatccatcattaaactttcttcagaaagaaaaaaggaagacattgaggacgtaacacctgtgttcccccagctttccaggtccatcatctctaaattgctaaatgaatcagaaacaaaggtccagaaaactgaggtagaagatgcagatatgcttgagagtgaagaatgtgaagcttctaaaggctactatctcactaaagccttgactggacataacatgtcagaagctcttgtcactgaagcagagaatatgaaatgccttcaattttccaaggacgttattattagtgacacaaaagactattttatgtcgaagactcttggcattgggagactgaaaaggccctccttcttagatgatccactgtatggtatcagtgtgagcctttcatcagaagaccaacatctgaaactcagttctccagagaatacaatagcagatgagcaggagactaaagatgcagcagaagaatgtaaagaaccctaatcaaggacttgctgggtgtgcttttcagaaagttggtaatgaagttaaattaaatttcttattgaattatttgaattcaatgaatgc

SEQ ID NO: 1571 - DNA, 1746 bp, Homo sapiens
agacgcagaggcgaggccgccagtcgaggacgaggaggagataacatcaagatgccgaagactgaggaaactgtgctccagaatgatcccagtgtagcagagaatggggcccctgagcctaaaacaccagggcagagccagaaaagcaagagtttctgtttagatgaccagtctcctgacctgatgtcttttctgtcacagatctgatagagacagttaatgaagtttccaagctgagcatttcacatgaaattgtagtaaaccaagatttctatgtggaagagaccattttgcctccaaacagtgtagaaggcaggtttgcggaggcaatgtacaatgctttttggaaccatctgaaagaacagctattgagtactcctcctgacttcacttgtgcccttgaacttctaaaagatgttaaggagaaccgcctaagaaatgagatagaagaagctctggacacagatctcctcaagcaggaagcagaacatggggccctggatgtccctcatctttctaactacattctcaatttgatggctctgctatgtgcaccggttcgagatgaagcgatacagaaactagagaccataagagatccagtgcagttactgaggggcatcctccgtgttctgggcctaatgaaaatggacatggtgaactataccatccagagctttcgaccctacctgcaggaacattccatccagtatgaacaagctaaattccaggaactccttgataaacagcccagtctcctcgattataccacaaaatggctaaccaaacagccacagacatcactacactatgtccgagttctcctgactcacctagctcctcctgcagcatggcgtgttcacttccaagcggggcaggtaacaattcagagccccccagtccaacaatggtgctataccaaggctacctgaacctcctcctctgggatcttgaaaacgtagaattcccagagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttgatcagtggatccgtttttttctcaaatgctgtttgcttcatggcatgcaggagtctctgctacactttcctggaggcctcattctcattgaaaaggagttggcagaactgggctggaagtttctcaatctgatgcatcataatcagcaggtatttggcccatactatgctgagatcctaaaacacatcatccatccagctcaagcacaagaaacagatgtggagcctaactgatagtgctggaccccagctatggcaacagggactcaggagagagaggtcagcatgtttctgggaggacatcacctgtggttagtcgaacagtcagccctcttcctcgctatagccaggacacagggatgcaggggtcaagcatgtaagcaccaactggcccaatccccttcactaataaacctctgagctgcaag

SEQ ID NO: 1572 - DNA, 1975 bp, Homo sapiens
gttggggccgtgggagatgaagatggtgggtggggggttgggcccacagcctgctaagcaggcagagtggcctcctgaacccttcctccatcgcctagagcaaactcccattcctggaaggaggagcagcccagaccctgagactggactaggtctgttagggtccctgtgtggccggcaggactcgtggtgaagcccggggaaggcctgggtcctccaggtcagggatgtaggtcccagggtgtgcaggccgcggtatctgaccatcgtcggcgccctgcgcccaggcatcaattttacatggcagagtcaagaatgccctcttggtcgagtgcagtggctcacacctgtgatcccaacactttgggaggctgaggcaggaggattgcttgagcccagaagttcaagaccagcctggacaacatagacacagaatggtctgcctgggcctcagtcacattggaggagcagagagagaaggagccatgaggagtcactcaagggttttaggcagagccgtgacacaaccagagatactacgagcaaaggttccggaacagggcagggcaggacaggtttgagagcaatggcgcgatttcggctcacagcaacctccgcctcctgggttcaagctattctcctgcctcaacaacctcctgagggctgggattacagacaagaggccatgtgaggacacagagaaagcagccgtttacaagccaagaagagaggccgcatcacaaaccaacctttatggcaccttgatcttagacttctagctccagaacagagatgcaaatggtgggaacaatggagcccttgtccccaggccatttgtggcagatcctgggctccagggaggcaaagctcctctgcctctgccatggacaagctcagtgggagcaggccccggctggggccaccgctcccaccccccagatgtgtggactccccaggttggagagaagatgctcccagcccttccttcctgcctgccccagggacttggagacacaaggcccaggaggaggacgaggaggaaaataagtatgagctgcccccccgtgaggctctgcccctcagtctagcccctgcccaccttcctggcactgaggaggactccttgtacctggatcactctggccccctgggtccatcaaagccatcgccacccctgcctcagcccaccatgagcagggtgcatcgtccagagtggtgccaggccctccaaagaaacctgatgaggacctctacttggaatgtgagccggatccagtcctggctttgactcagactctcagcttccaagtcctgatgccctcaggccctctgcccaggacatcagtggtgcccaggcctaccacagccccccaggaaactcggaatggaacagcagatgctgcctctaaagaaggaaggaaatcgtctcttccctctgtagcccccactgggagtgcctcagctgctgaggatggggcctataccgtgcgccccagctcagggcctcatggctcccagcccttcaccctggcagtgcttctccgaggccgggtcttcaacactcccatccggcggctggatggcggacgccactatgccctgggccgggagggcaggaaccgtgaggagctcttctcctccgtggcggccatggtccagcacttcatgtggcaccctctgccccttgtggacagacacagcggcagccgggaactcacctgcctgctcttccccaccaagccttgaggccacagcgaagctgacaccctcttcctggcctccaggaatgcaggtgtctgcccagttcactaggtcctggatgaaggaaccgtggtggcctagaccagtcaggggacagcacaggcactgctggaacagcaaaggatcctctcacatctacttgtgggcctagggcaccctgagagggactggcctaccttgcacaagttcacattcaataaacatttgttgaatg

SEQ ID NO: 1573 - DNA, 2791 bp, Homo sapiens
gaaggaggcagtggagcttcacttctccagcatgcaaggcatccctcttggctctgagtactttgaaaagctggacccgtacttcctggtctgcattgctaaggagtacttgctcttctgccccaagcagcccaggttaccaggccagatcgtgtctccacttcttaaacaagtcgccgtgatcttgaatcctgtagtcaaagcagcaccagctctgatcgaccccctgtatttgatggctcaggtcaggtattactcaggagagctagagaatgcccagagcatcctgcagcgttgcctggagctggaccccgcctccgtggatgcccatctcctcatgtgtcagatctacttggctcagggcaactttggcatgtgcttccactgcttagagctgggtgtcagccacaacttccaggtccgagatcaccccctctaccacctcatcaaggccagggccctcaacaaggctggagactatccagaggccataaagacgctgaaaatggtcatcaaattgccagctctgaagaaggaagaaggcagaaagttcctcaggccctctgtgcagcctagccagcgggcatccatcttattggaactggtggaggccctccggctgaatggggagctacatgaggccaccaaggtcatgcaggacaccatcaatgagttcggtggcacaccagaagagaaccgcatcaccattgccaacgtggacttggtcctgagcaagggcaatgtggacgtggcgctgaacatgctaaggaacatcttgcccaagcagtcctgctatatggaagccagagagaagatggccaacatctacctgcagaccctcagagacaggcgcctctacatcagatgctaccgtgagctctgtgagcatctgcctggcccccacaccagcctgctactgggcgatgccttaatgagcattctggagcccgagaaggccctggaggtctatgatgaggcctatagacagaacccacatgacgcctccctggccagcagaattgggcacgcttatgtgaaggcccaccagtatactgaggcaattgagtattatgaggctgcccagaagattaatggacaggactttctgtgctgcgatctgggcaaactgctcctgaagttaaagaaggtcaataaagcagaaaaagttttgaagcaggcactggaacatgacattgtccaagacatcccatccatgatgaatgatgttaagtgcctgcttttgctggcaaaggtttacaagagccataaaaaagaagctgtgatagaaactttgaacaaggccttggacctccagtctcggatactgaagcgagttccactggagcaaccagaaatgattccctcccagaagcaactggcagcctctatctgcatccaatttgcagagcactacctggcagagaaagagtatgacaaggcggtacagtcttataaggatgtcttctcctacttgccaactgacaataaggtgatgctggagctggcgcagctctacctgctccaggggcacctggacctgtgtgagcagcactgtgccatcctcctgcagactgaacagaaccatgagaccgcttctgtgttgatggctgacctgatgtttagaaaacagaaacatgaagcggccatcaatctttaccaccaagtcttggagaaagcgccagacaattttttggtattgcataaattaatcgatctgctaagaagaagtggaaaacttgaagacattcctgccttctttgaattggccaagaaggtgtctagccgggtgcctttggaaccagggttcaattactgcagaggtatctactgctggcacatagggcagcccaacgaagccttaaagttcctgaacaaggcacgcaaggacagcacttggggccagagcgccatctaccacatggtgcagatctgtctgaatccagacaacgaggttgtgggcggagaggcttttgagaaccagggagctgagagcaactacatggagaagaaggagttggagcagcagggtgtgagcaccgccgagaaactgctgcgtgagttttacccacattcagactccagccagacccagctgcggctgctgcagggcctctgccggctggccaccagggagaaggctaacatggaggctgcgctgggcagcttcatccagatagcgcaggctgagaaggacagcgtccctgccctgccggccttggcacaagcctacgtgttcctgaagcagatccccaaggcgcgtatgcagttgaagcgcctggccaagaccccctgggtgctgagtgaggctgaggacctggagaagagctggctcctgctggctgacatttactgccagggcagcaagttcgacctcgccttagaactgctgcggcgctgtgtgcaatacaacaagtcctgctacaaggcctatgagtacatgggcttcatcatggagaaggagcagtcctacaaggatgcagtcaccaactacaaactggcctggaagtacagtcatcacgccaaccctgccattggcttcaaacttgctttcaactacctgaaggacaagaaatttgtggaggccatcgaaatctgcaacgatgtcctcagggagcaccccgactaccccaagatcagggaggaaattttggaaaaggcccgaaagtccctgaggccctagctggggtcaaggggcctggaccagtagaagccatcaacctactgaagttgtgtggagggatggaaagtgggtcagtggagaagggattcagaaaatgacacattcttcccc

SEQ ID NO: 1574 - DNA, 1899 bp, Homo sapiens
ttttagtagagatggggtttcatcgtgttagccaggatggtctccatctcctgacctcgtgttccgcccgcctaggtctcccaaagtcctgggattacaggcgtgagccactgtgcctagccattccctagccttttcgtcttggaatcatttgtagtgtcatacgccccagttctttcatcttggaattctttaggggaccgtgtgccccagtgtttccatcttgggatcacttgcagggctgtgctcttcaaatctttggggacactgtattatgccccagtctttcccatcttggaatctttccagagaccctatgcccagtctttttgtcttggacttatttgcagggctatatgccccaggcttttcatcctggaatcttttgagagatcgcatgccccagcctttccatcctgggatcatttgcagtgctggactccctaatctttttgtgtcgtaatcgtttgcggtgtcatcttggaattatcttgtcatcttggaagtgtcttttcatcttggaattatttcagggactgtaagtcccagtcatctgtcttggaattgttttctgggatggatgccccaatcgtttcgttttggggtctttggggaatcgtatgccccagtgttattgtttcaggattgtttcaggattctttgcagtaccgtgcaccgcagtcttttcatcttagaatcctttggggtactcccggttcatcttggaattatctggaagaccgtatgcccctgtttttttcaaaataccacagttttaaacatttatgttcacctcttgagagacatcttggttacttccagttgccccagtttttttgtcttggaatctttggaggtactgtattctccctctttttgtcttggaatcatttgcggtgctgtacaccccagtcttctcgtcttacaattctttaggggtaaaatatgctccagtcttttcatcttgggattctttcagtgaacgcaggtcccagtttttttgtcttggaattctttatgggaccacacaccccggtcttcctgtcttggaaccgttcgcagcactctattgcatgtaataccgccggcggcactctacacgacttggagccgcctgcgctaccgtatgcagcactctccacggtagctccctggggactcaaacttttccagttccccatctttaggctgcaacagcatggcaatgcccaatagaaaacaacgcaagcagtagccatcacgctgccaacactggcggtgccctcttgggcagtggccactgtctgctgggcgcattactaagcccagagcactctatgaactcatcactccagcctgggcaacaagagtgaaactctgcctcggagggaaaaaaaaaaaaaagaattgaaagaatgaaaacctgtcctcaatgtgcctgaataaatgcttgttcagacactggatgtgaagtccgattctccactggatacccaaactgcaggaggtaggtggttcccatctggacccgagttgcctaccagaccattgtcagaaacacagctggacgtgagttaaagtggtgaaaaaacagattttattcagtaactactgaaagtagggaaggagctgagcttattccgatttcggcagaggtgatttgggtgttttaaagaaagaatgagggagacgggaataaaggagctccgaagtgtcggggaagtgaaaaagtgcaaaggggagcttccggatagcgaagcacgtggaggttcctggagggtgtcctcccagagaggacgtggaaccttcccgctcccaccgcgcacttgccctgtgtatctcttccctttggctgttcatctacatacgtggtagtttcctttatagtaaactaataaacggaaatttgcagcagctgtg

SEQ ID NO: 1575 - DNA, 1901 bp, Homo sapiens
aaaaggagagtttctttgtcacaacaaacaaggggaaagctttcttcctgtctcttcgatttaccaatgcctcatcagaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccacgtcctgtggccaaaaaatgtcactgcaaatgaccttcaggagaatatcacaaagttaaacagtgggatggcttttatgattaaacactcccagaaactttttaaggctcctgcttatattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaaggatttctctgaaggatccagagttgtctcctatggtccatgcagaattttctgtttagtgggcaggtgttattcctgcccacagcaaagcttggacttgcagcttgcttgctgcattttgaattgtcaaagccaactaataccgtgacccgactgatacctctaaccccactcactggatgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttgaaaaaaaatatgaaatgtgtgctcaactgccagtaattttttaaaaagcactgtcccagtggattgatgttgtttttaatggatattttgggtttttctctgttttgatagtattgggtatttggttgtttttgtttgtttatttctttgttttaaaagccatgtttttggttgggctctaagctagatatctttccctctttttcactttgagctttgggaaaactctttatcttatgaggctgtattcctcaatacctaatttgtgtccaaagaatttatagcttttctggacattttttattatttcttgggtgtgacatcagagtatttgacctgcagtattgaaaaaggagaattcagaatgatacagtattttaacaaatcttaattattaaactcttttccttccttcc

SEQ ID NO: 1576 - DNA, 1900 bp, Homo sapiens
agcgcttgagaaggaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgttgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggagactataaacatgtttgaaaggaacattgttgacatggtaggactgtttatcgaaaatgtccaaagcctgatggctcagtgccgggacctggagaatcaccaccacgagaagctcctggagatctctatcagcaccctggagaagattgtcgagggcgacctggacgaggacctgcctaacgacctgcgcgcgctttttgtcgataaagatacgattgttaatgctgtcggggcatcgcacgacatccacctcctgaagattgacaatcgagaagatgagctggtgaccagaatcaactcttggtgtacacgtttaatagacaggattcacaaggatgagatcatgaggaaccgcaagcgcgtgaaggagatcaatcagtacatcgaccacatgcagagcgaactggacaacctggaatgtggcgacatcctagactagatgaatgtcagccacaggagcttcttcaaaacatagcaccagccccagccaggagaaggaagtgcacacgcctcacccgcacctctagagagttgctgggcatctctcaaccgcgatccccaacaccattcttcccccacccctggaaaaacttccaaaagtagagaaaataaaggactcatttcac

SEQ ID NO: 1577 - DNA, 1874 bp, Homo sapiens
cagagggaatatggccctgccaacaccttcatttcagactctagcctctagaattgtgacggaatatatttctgtcattttaagctaccaagtttatagtaatttgttatggcagccacaggacactaatacaaataccttccatgaaacagatatgattctagaccccaagtgtttagcagtggacaaaaaaagcagaagcggaagtaaactcattcacttattaacaaataattactggctagatgaggtggattatacttgtaatcccaacactttgagaggtgaaggcaagaggattgcttgaagttcaagccagaagttcaagactgcattgagacatgattgcaccactatactccagcctgggcaacagagcaagatcccatctcaaaaatttagcagggtgggtgcggtgactcatgcctgtaataccagcattttggaaaactggtgggcagatgacttgagctcaggagttcgagactaaactaggcaatatggtaaaatcctgtctctatgaacaaaaattagctggatgtggtggtgtgttcctgtggtcccagctacttgggaggctgaggtgggaggactgcttgagctgagaggttgaggctgtggtgagccgtgattgtgccactgctctgcagcctgggtgacagagcaagaccctgtctcaaaaaaaacaaacaaaaaacaataaagaacaaataattattgaatacttagtaggtgcttgggatgttatcagtgaacaaaatagacaataatgcctgcttcatggagcttacatattagtagtggtaaagagataataagcagtgaatatattaagtaaattaatctgttaaaatatgataagcattatgggaaaattaaaagtagaacaggttaagggagattgggagtagaaggtgggattgcaaatgggttgtaggttttttttctttttttttttgaggcagagtctcgctctgtcaccaggctggagtgcagtggcacgatatatcggctcactgcagcctccgcctcctgggttcaagcgactctcctgcctcagcctcccaggtagctgggactacaggtgtccgccaccatgcctggccaatttatttatttatttttttgtattttagtagagacgaggtttcaccatgttgcccgggctggtctcaaactcctgagtttagagtttgggagtagtttggccctcattgtcttatgccccagctttagggggtggccaggggcagaaccagaataatgagtggactagtcatatcttgtaaatgtttgtgaagccatacatttctcctttctgttcaagaggagctagtcaacaaagggaaagtttggacttatcagaagtgtctgaagtagagtctaattatggtgccactgaagaggatttaataacatctgcatcaaaaacagaagagaccttgtcaaaaaagagagagtaccagtcttcctcctgtgtctcctccacatcctcttcctattcttcctcttctgaatccagattttctgaatctattggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatagaacaatgtctgttcattaaaattaaaaagtataagtgtctaggcc

SEQ ID NO: 1578 - DNA, 2735 bp, Homo sapiens
tcacgtgtcctggaaagtggtatcagctttcaagtgccccagggcttttcttttttcaaaggagaagggaggcatcagtgaattttcagctgacacctcgccttggggcccatgggatcattctgggatgcagcgaggccctgccttcctagcagatgtggtgagcccatcctttctcacccggaggggtccaaagtcggatctcaagaggagttctgggaccccagcaggcgcccagaagctccacctccaccccggaagtcggcttaaggaggtcctcaagaccggactccttggggtttggccttgggacgcctgtggcctcctctcccacgctgccccgtactggacccctgatccagccaccgccagggctgcaatgcgagccgcccttcctctgcgtagccgctattgtttaaaggggtcgcagcctgactgccaggagcggagtgcgactcggcccctccaatgcgcatgcgcaaggccctggcgcatgctccagtcacagttattcccacggttgtcttagaaacccgtccctgaggcttggcaaagtaggagccctccgtggcagtgcttgggtgtcggggctccgaggctccggcctgacctctccacggggtcgacaggaacatctctggctgccaggagtcgcaaagggccgaccaggatgacgaaaccacaggcgaagtccgggggaagcggcatggcatgccagcctcaggcctgccaggacggtgttcgggtgagtctccccagaagtcgtgcccccgtgatctcaaggaccggtctgcttgcatgcctatgggctgctctctcacctgagggtcgttctcatgtggagcagaaccctgctgcctcagaggttgccttggggtgtggtgtgtttctgtgccagtgctgtatgactgtgtgtttttgtttctgtgtgtgtgtgtgtgtgtgtgtgtgtgtgtctcctattctctcctctctctctgtctcttactctttccctctctctgtcggtttgtttgtgtccttgtgcgtgtgtttgtttggacgaatgtgccttgtgcgccaaagaagctatttttgcatgtcgtctggtctttgttgagcctctttctgggtctctgcctgggtcatgtggccggctgtctatcgttttctcggcgtttccactttgggttcgtggagacctcgaccacgtgaggagatgcgtcagtcccggggcaattgaaatctcatccccatcctgagcagcctcttttctaggatcaatatgaccacactccagccaaggacaaaatgctcacaggaggtcatttttctgcaggggtggagccaaccaaagtcaaagaagattgttgtatcttttcacagctcttctctgagaacgaagccacacaacgatagaatcttgaagaagaagctaggaatgggagatggcaacaatccctgtcactggaacactggcctctctggacaagtcaccagtttggcacccctccccttatgcctgtaccgatggcatggtgctatatcctgcctgggctctggcctctgctctgtcctccctcttgctctgtctcccctgtttctgaggggccttgatgtttcttgatctgtctgaatgtcttcaacaaagaccacttcccagtcctccggggcgacacttcctggagatccgtgtcatgattgtttctccctccaaacctgtttctgcttgattagccagggtcgatgatcctggggctcttggcttccatacgtatctcagacagggaagctagcttggtctccatgtttcacctcatgggtgagtggattgcctagaatgagcagtaggtgactgtgactggccttgtcttctagggcagggacatgtcgcatttcctctgcacttcctgtctcattcttgagaaacatcctcccctctgctcatgggtggactgactccttgaatcttttggctgtaatgaaagtcagggatccaatgggactgggctggggctggagctggatgcaggggaggttctgtcagggctacctgggcattggaggattgggggtggattgaactttgcataaacctctttactcctccagcaggcttttcaaaatgtggcttggactcatgcaataagaaatttaccggttgaaagggcccctttttcaatggcactctgggtaacatcgcttcagcacaatcatatggtagagaagccttatcaaatttgctgtccctcagggctcttaaagatgcttgataaattattagggaaataagaaacaaattgaaaggaaaaggaaatccaaggacctgccccagaagaatcatagatatgtttgaatacttattcattatttgccccagatagaaaatgtttgttaatcaaaaggcaaaagttataatgaggaagataatattgcctggggcaatgttgagacaaataaggtgaagatcaaccaaacgccctgagtcctttggcccaaatccctgctggggacccaaatacttttgatatagcatcttgctacctgaggaacgcaaggagaataatactcataagcagagcctctgttttcccataggactgactctaactatgtgaagaactgctacatattctacagtgcttaataggcggtgcctatctaacaggagctgtttggcttgtggatagcagttccaagatgaacaaatgacattgtgtttgaaagccactgctcttattaaagaagagtcaagc

SEQ ID NO: 1579 - DNA, 1956 bp, Homo sapiens
agcagtaggatctcggtttccagcccagtgcaatttctgctctatcccgctgacctcattgttgaggtatgtccttatagcagtgtgagaaccgactaatacagttccttaggaagcccctgctgggtatggatggggagtgaagcaaggtgggcccagaagctgccgctggctgagagaccatgaagaaagtgtatagaatctccaccatcaccagaggaagagagcttggcaggaaagttacttccatgaatggatgagttgaagtgaacagcgtcttgggcaaaactgaagggtagttagtcgggtttgtctctggtgggctttcagctccactccctgcatcccattcccacatcgtgatggtcccctcataggcccagggctaccaccttggagcataggtggggatcctccagccagggtccttccttcacagggagtcagagccctctgctccggaattgccctgccccaggtcggccatctatcaaaagccccactatcccctaaagacccaccctcaagcagcagatgtgcagcaagggagccgcaaatgtcattcctgtgaccccgaagcagtctagtgtgttacctctctcagggctgctatgggctgaattgcttttccccaaaatttctatgctgcttccctaacccccagcgcctcagaatctaactctggataggacctgtgaataagtgattaagttaaaatggggtcctgtggatgggccctaacccaatctgactggtgtccttttaagaagaggaagagacaccagagatgtgcacactcagaaacaagacacatgaggacacagagacaaggcggctacctgcaagccagggagaggggcctcggggaagccaaccctgcctacgccttgatcttggacttccagcctccagaactccagaatctgagtgaaatgggtataaatcatgagctaggatacagttcaattattcctatgatgaaaagagctttctccgcatgtgggactctcggcctcattatgagtggcatctttgacaatccagggcccattaaaaacaccttgaagaaagcattcaccatgctgtggagcttcacagtctataccaggctggaatccttgagggtggcattatcaaatgaggaaatggttcctttcatttttcatctgaagactcagacagcaaacatgttatctggccctataagcaccccgatgcttctgtgaaacccaagcaagttctgcatcaccacgacagccgcggatgtcaaatcatcaaaacagcagcagaggaaggggtttattcctcctccaaatcttcagctggttttatagggttaccagtttaaagtttctttgttttcagagcatcagacctcccatttgtagctgatagccatttttcaaaggtttctggctcacccaggaattcattagggtggacgagaaaagaacagtggatagaatagaccagcagggcaatctaagccccattccctgtctctttacattggttcttggtccccgtgactcatccaaactcccttatattcctatctggaatgcgaaagctggaaatacaagtgctctgtaatcacaggcagtggttttcttggagtctggtgtgatttctgtagcttgcagcaatatgtgggacacacttgcactgaagaatttaatgacttgttttactgctgtctgccatcaatatttatctatattaactgaagaaaggcattactcgaaatggcatttcacacctctgagcattatacagtaattctaaagtcatacgttgtaccaaattctctgggcaaacacagagatacagtatgaatggaaagaatccaagttgaagtttttaaaacttgaattgtctgcagtaatctggaaaaccaaagtcaaaatgactcgaattgctatggctgggaatgactggattaaaagcaatggaaac

SEQ ID NO: 1580 - DNA, 1718 bp, Homo sapiens
aagctgcttccagtgaatgctacacacctgcaccatggtttgtctgacatccttagccaagatcaggattggctatgttggtacttacatatcctcatgagaattgtggttctggtactagtttggtaaagaaattattaaacctagctgatgcttgaaggtagttggattaacagaaaagaagacaaacttggagtatattctttagtacatttttccccaaagatgttgggttcagttgccacaacactgccattgtcatcttcaaattccagtggaatgcctcttggttactatctgtctagtcctcagattagtagagtaactatatcaacaactggacaattgacttctaaagctactgtaggtagctgttccagagtggaaaacagcttggatgccagccccttctcagttccgaagaaacaggatgaatcacccatgattggggatggagaagattatttcctttctttgtttggtgattcaaagaaacttacagcacactcaaactacactcagaaaactttaaaatacttttctatgattcttgaagaagttggccaatttacctccagttctcttggagatgttgaaatagctgaagtgaatgtcaagggtttgttcgtgaagctcattaactcttcccttgacaaagaaatggcaattggagatcatattctccagcaaaatgtgaatggacaaaccatttctttgtaccgattccttccaaacatcgtaatgcaggcaaattccacagtaacagtgtgggcagcagcatctgaagcaaagcatcaacctccatcagattttctttggaaggaacaagacaagtttagagcaagtcctgattgtataacaatcctgtgcaaaccgaacggtcaagccattgcgtggtacacccctatccactggaagcaagcgtgggaaaaattagatgctgacgttgaatttaacagatgttcagtagtatctccaacattccgaaagcgtgtgtttcagtggacagcatctacagctacaataactaaagaaaaacaagatcaacctaagaaagatatctcaaattatcaggtggaacaagctcaagttcttcttaagagagagaaggaaatcccaccaaccgttttccctaatcgcagcccttggtgccagaatccctatgtctctgcacatccttactgtcctctgattgaaccacacaatacatccaccgctggaggcagattggatagacagcccaggtctcggtcaaccagacctaatcgagcctcagggtctaagaaaaagaagacatctgagtcacaaaagcaataagcagtcaactcaacctttaaagtaatctagtccaccctcaaccagctactagaaaagcaaaagagaactcaaatccctgaggcctgctctgcaacctccctgctattccatgagagggtgaagacatcacatttctatatggaaaaaggatccaaaatttgtattgctgtagaattggtgaattatagatgcttgatgaaatcacaagtcctaccactcctgccttccaaatccctgcagaaaacaagcagatggttagtattattcaatggataaaattgctatttgccttagatttctctttttgtaaacaaagttattttgggtacagaactcacaaaagaagagcacgtgcaattgtttaaccattttacattgactgataaatctcttttttccat

SEQ ID NO: 1581 - DNA, 1794 bp, Homo sapiens
tgtggactgaagaagaaagaaaacaattcaaagattatgagaaaaaagtaaaggagttaaatgaagaaagagataagtatagaaagtcattagaagcagaactgaagaaacttcaaaactctattcaagaaagcacacaggcctttgatgaacatttgaaaagactttttgaaaggagagtgaaggcagagatggttaccaaccaggaggaactgaaaataagtaaccttgcattttctttattgttggatgaagaattaagctctagagaaaaattcctgaacaactaccttacaaggaaacagcacgagaaaagccagacttcagaagctgttcggaaatctagagaagacctggatgtgtgcaaggagcactatgacaacttactggcagaagacaaagttatggatcgcagctttaaaaaggaattttctgaaattcctggtcatcaagtggatatactctacaaactttttaaacgccgaccaaggatttccaaacagaaaacgcactcagaaacaaccagcgttgtccctttcggagaactaccaggatctggcaagttgaataaggatgcctttgcccagttaatgaaagctatggatgagttggacaatattagtaacatgccagaaggcttggaccctttggtctggaatcatttctgcatgacaagacgagcaaaagtggaaaatgaacagaaagtaaagcagaaagcagctgacttattggaaatggcaactttcctccagaagagagttgaggaggaagagaaggtgcaacaggagattgagagagtgttccatgaactcatcctattacaggaagagaaagtgagattccagttgaatttgacaatccaaattcttcttaaacaaggacaagtagaactggaaaatttccagctagtactggagtattctgatgcaattctcatcaacaagaacataattgaagacttgaattctgtgattcggactcaaggacaaaagaaagttgctagcatgatggaaagtaaagatgtacacaaaagaatacttcagattgagtgggaacataagaaaatggagatggaaagggaagatctaaatcagaaggcttgggatattcagatgctatttttttcaagagatcgtcaaaagtacctaaatgaaccaaactatgaggctctgattagtattcagattggaataatggaacaaaccattgctgttttagataagatgcacaaaaagaatgtggaaaactgcaagaaactactcaaaaaacttggaaagttcagcaatcaaaaagatatagcaaattatgccctaagctgcaatctacgagaagagttggtagctgtctcagagagaaaagacatctgtaatgcaatggggtctaaactgacttgtgaaaagattgtcaaagaacggtatgaaaacatgatgcaacagcagaagttaacaaatatttcaaaacaacaagctgaacagatttcaatactacagactgaagttgaaagattaagaatgaaaacatttcctgctcttgttcaaatgtaaaaacgctggcaggaaaacacaaggccaaatcaatcatttaaaaaatcatttcatttgggtaaaatgatttccttttctttcttactgggaaattgaagtagcatgtcctctgagttgcatgttttagataaaaaattgtttaattttagccttaattgtatacaaatttttgtcctgcatgaataaatgtgtaaaataccatgaattgctgtttttattcaagaataaacaagacttgaagtcagaaagt

SEQ ID NO: 1582 - DNA, 2045 bp, Homo sapiens
gaatgcataagatacaaagcactgggaggggggcacaaatatgtttaaaatttacatttccacttttaagggactcacagcttaagaggcagacaagacccgcacataagaaaagtgaaaacagaactacaagacactatacaatgacatgcacaaaacccagtgactatagtctagagtttgggattgcattaatctagaaaatcttctctttaaaggaatgacctgagtagtaacatagagaaagaagattcagggctgggcatggtggctcacgcctgtaatcccagcactttgggaggctgaggtgggtggatcacaaggtcaagagatcgagaccatcctggccaacatggtgaaacccgtctctactaaaaatacaaaaattagctgggcatggtggcaggcgcctgtagtcccagctactctggaggctgaggcaggaaaatcacttgaaccagggagacagaggttgcagtgaactgagactgtgccactgcactccagccttgtgacagtgtgaggctccgtcagaagaaagagaaggagaaggagaaggagaagattcaaatggctgaagagattggggacagcattttaaaatccagaaaagaataattacgatattttcaaaatggaaagttcccatgccaaagagtttgccttcttcaccaaactatgatttcgtgatgttcttaaaggctcaagaatggggcatgagtacacactgtgtgctaaggaaagaatatttggattgaattgaacccctgcagaacgtggactatttagagacctgaatttggccttgggtgaatacctgccttgggttggccaactagcagtcaacagcaatgagccaaaagagacaaaccaagtttcaaaatggcaaatcaaagacttcagaaaatagctcagctaaacgtgagaaaggaatggttgtcaatagcaaagagatttctgatgcagtcgggcaatcaaaatttgttctagagaaccttcggcattacacagtccatccaaatttggcccagtactataagcctttgaaggccactgccctgcagaaattcctggctcaaaacaggaaaaacaccagcttcatgttaaaagtaacacagtatgaccaggataagacgttactgattatgaccaacaacccacctccctgctcaatcacccagcaagacaaggagagtgcatcaaaatatttttccaaggagttactgctcaaggtcatggaaagtcatcatcagcacaaacccactgagaacctctggctgccccgcatgcctcagaaaaaaaagttaagatctaagctgaaaccaatcttccctttgatactgtcggatgatcccacatccaagcgagaacaatggtttaggttttccactgacaatgatttcaagagcgaagggaagtattcaaaagtctacgctttgaggacacagaagaaaatgtaccctcagctcacctttgctccagtccatgagagagatatgaggaaagatgcttccaagaagtcagcgagtgaaaggccaatttccaaagtgattcgggaaccactgacactcgcatcgctcttggaagacatgcccaccagaaccgcgcccggggagagcgccttccgcaacgggagggccccgcagtggattatcaaaaaggccacggtcatcgggtgaacacagacccctcagtcctcccgcctcgctctcttgagactgaggggtccgcagaagtcgccacccaaataaaaccacattcctgctgctgcgggcgtgggctcccgggtcgcaagccgggagggtcgagccgaagtctccggcgggccgcaagaggagaagggggcgtggctgcgtcccgggggccgagggcggccggggagggcgggccttggccccgagtgaaggcgcggcggcccaaccggcgtgagagcgcggggccggccttcctgcagcctcttccgctcgccggctgcggcgcctgggacggttgcggtgggtctgggcgctgggaagtcgtccaagatgattaaaaaattcgacaag

SEQ ID NO: 1583 - DNA, 1894 bp, Homo sapiens
gttactagggagcggcgagccgagacggctacatggacgccactatcgccccgcaccgtatcccccccgagatgccccagtacggggaggagaaccacatcttcgagttgatgcaggtgaccggacacccctgcccgtcgcgacgctggcggcggctcgggagcctccactgcgacgtcgggtgcgcggccgggacccgcagctggggccgagtcgcgcgcccacgaagcagcccaactcgggatgtacgattcgtgtgtcgccgtgaccccgagggggccctcgagctggggacgctcctggtcctgcccgggtttgcctcaggcggacccagggggaggaagggggccactcgagccgggatttggtcctggctgtgccgccagcgggccttatggtctggaaccagtcctttccttttctcggtttccccacctgtgaaatgccaggttgcaagaggtggtctcccaggggctctcccggcgctgacaattaccatctgtcgaatttgtggggagcctctcggcccaggtttctgaggtgggcattgtccgagttcaagctggcatctccatcctcagagagggccgcctctgggacagcagcatctcccaccttggtccctcctcctcagggccagacgtccccggcagctccgaagctctcattctggctccaggcctgactgggcccccagctcaccgtgtgactttgggcgaggccccgtccccgccagggccccagttttcccttttgcacgtggtggaggtcaaggctttcaggagctggaggggaagaactctcagccactcaaaggttctgagaggcaaggggaagctggagctcagttttcagatcatttgtctgcttcccagggtacaccccatccccaggggcatggcatggagggcatagtggtgtctgtggtcatttgaggttctgccctgcacactagacagctgaccccagacgaagaaacccgtgtctgcacctccatcaaacacatttccctcggaaagtgttaactgatagagggagagcaagagattcctaaaactgcttgagtggccaatcacaaatcaaatagctagctgggttagaagtcagcaggtcagggcaggatgggggatcatctggagccctgttgtctgctctagagaacctggtgtgttttccacattgattgttggaggaattgcccaggaaagcttttattgattttgaaacagggtcttgcactgctgcccaggctggagtgcagtgatacaatcatggcttactgcagccttgaactcctgggctcaagcaatccttctgccttagtccctccagagtagccgagactacaggtgcaggccaccatacctggctaatgttttttttttaattttagtacagacgaggtcttgctatgttgcccggactggtcttgaactcctgggctcaaacagtccttctgcctcggcctcccaacaagaaagctttcagtccagtatttccagtccttagtcatctgtggattccctccatgtttttgaccatttccattttttatacttttgattttaaaataatgttagattcacaggaagttaaaaaatagtatggatttctggtctcccctcccacattgcccccgtgataacatctaacataactgtagcacattgtcaaaaccaggaaactggcattggtacaataggattacctgaactgtaggccttgtttggatttcctccatttttacctgcattgatgtttttgttgtgcatacagttctgtgcagttgtatcacatgtacagatttgcataaccgctactgcacctccatttaaactaatcacttgtttaaatcaactcaccttttaaaaaattaaatagccgcttttgcctc

SEQ ID NO: 1584 - DNA, 2104 bp, Homo sapiens
attcccatcccccttctctagtccccgacctgcggcagccggagctcggggagcggagcgtggtggggaggggagcgggacaggcgacacaggagacagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttgcgctggggctggtccaagtgctcctgggcatcctggtggtcaccttcagcatggtggcctcttccgtcaccaccaccgagagcatcaagaggtcctgcccgtcttgggctgggttctcgctggcgttctccggggtggttggcattgtgtcctggaagcggccattcactctagtgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacggtgagaagggagcaggggccagggcacgcaggtatggtgggggcaggggtgtgtgtgctgagacttgcctgagggaacaatggctacagatctggcttttgagcaccaggggctatgggttatctattatcctcatctattggaggaatggatgtttagtggggaggatgagaaggggagatggcagggagtgagttaagtatgtgatgctggtctgggaccaggagagggtgctttagagaatgggactggatggtggggtagagtcaagaaggtcctatgctgggcacggtggctcattcctgtaatcccagcactttgagaggcccaggcaggcggatcacctgaggccaggagttcaagacccacctggccaacatggcgaaaccctgtctctattaaaaatacaaaaatcgggccgggcgcagtggctcgtgcctataatcccagcactttgggaggctgaggagggcagatcacctgagatcaggagatcgagactatcctggctaacatggtgaaaccccatctctactaaacatacaaaaaaattagccaggcgtggtggcgggcgcctgtggtcccagctactcgggaggctgaggcaggagaatggcatgaacctgggaggcagagcttgcagtgagctgagatagtgccactgcactccagcctgggcgacagagcaagactccatctcaaaaaacaaacaaacgaaatacaaaaattagccaagtgtggtggcgggtgcctgtaatcccagctacttgggagtctgaggcaggaaaattgcttgaaccggggagacagaggctgcagtgagctgagatggtgccactgcattccagcctgggcgacaagagcaagactccgtctc

SEQ ID NO: 1585 - DNA, 2589 bp, Homo sapiens
aacgtgctacctcaaggctccacctggccacacagcaggcactgaggctgggagacagcccccagacagatgagtgtccgcgcctctctgagaggtgaatgagcccggacggtccctacctaccaagtcctgaggagcagcggcaccaacgacgcaggcccgccccagcccgccagtgagccgcccatgccctctgctagcccggcccgcccgggcccccgccatgctgatcaccgtgtactgcgtgcggagggacctctccgaggtcaccttctctctccaggtcagccccgactttgagctccgaaacttcaaggtcctctgcgaagcggagtccagagtccccgtcgaagagatccagatcatccacatggagcgactcctcatcgaggaccactgttccctgggctcctacggcctcaaagatggcgatatcgtggttttactgcagaaggacaatgtgggacctcgggctccagggcgtgccccgaaccagcctcgtgtagacttcagtggcattgcggtgcctgggacgtccagctcccgtccacagcaccctggacagcagcagcagcgcacacccgctgcccagcggtcacagggcttggcgtcaggagagaaggtggccggcctgcaaggtctgggcagccccgccctgatccgcagcatgctgctctccaacccccacgatctgtccctgctcaaggaacgcaaccctcccttggcggaagccctgctcagcggaagccttgagaccttttctcaggtgctgatggagcagcaaagggaaaaggccttgagagagcaagagaggcttcgtctctacacagccgacccactggatcgggaagctcaggccaaaatagaagaggaaatccggcagcaaaacattgaagaaaacatgaatatagcgatagaagaggcccccgagagttttggacaagtgacgatgctctacattaactgcaaagtgaatgggcatcctttgaaggcttttgttgactcgggcgcccagatgaccattatgagccaggcttgtgccgagcgatgtaacatcatgaggctggtggaccgacggtgggctggggttgctaaaggagtgggcacacagagaattattggccgtgttcatctagctcagattcaaattgaaggtgatttcttacagtgctctttctccatacttgaggatcaacccatggatatgcttctaggcctagatatgctccggagacatcaatgttccatcgatttgaagaaaaatgtgctggtcatcggcaccactggcacgcagacttattttcttcctgagggagagttgcccttatgctctaggatggtaagtgggcaagatgagtcttcggacaaggaaattacacattcagtcatggattcaggacgaaaagaacattaaagcacgttataaatatgttaccaccttgagggagcctcaggtccccggcaattataagttaagagcttactggcaatgtaatcattaaaaaacatcagtaacaactaaacctggccttgggactacgttctcagatgggtaactaacgtcaatcctgattccttggtcttggtccctcttccatttcccttgtccagagatcactgaaaggcatcctgggaaggctttggaggctccagctgatttccagataatccatgaaaaagaaaaccagcttcttcctttagagacactatcctatcagattacaggtggcttatccaaatcattgctattttgcagaattccctggaaaaatgctatggctgcagaccttacaaggcatccacataaaactatttcacatcagcactaataattctttctactgagagaaatatgcccattttcacaggttttgttttctttgggaagggtattagaaatggtaggtcagttacactatgatgttaactaatacttatacatgtctgtttggggcagcataaagaccaatttcctcatatttacaccttcccttcccctggatcccctgcagtcaccctgcaatccacagctaaagactatttttgccacatttgagaaagtggatttatctccaaggatgctacattaattttctatttctcctgcattcaaagaaactctggctataaaacaaaggcaataaattagattttttaaaaaagaaattatggtacttcttgggagtcaagttgtacagtggtgggaatgagaggtggggacaggcagtggtccaggttctctaatagtcattgcaactagatcatctctctctctttttcaaagtaaaaatctgctttatacattaagctgctgctacatcagtattgtttgaacaaaggttttcactgttaaaataacatttgaaaacttttgaatgagaagatctctaaggcctcattcagaattatccattctgacaatgttagtgtttattacaactgacagtgggtaatggaagatcctagacttaattacaacccatggctaaagcacctgagagaaaagtttcagcttcctgaggccatcagatgcaggggaaatgtttcaggacaataatttatcaaaactggtattaaaacagcggattc

SEQ ID NO: 1586 - DNA, 1907 bp, Homo sapiens
agagagaattatgacccaagcaagaatcatgggtccagaattccacccaaggaagctagttcaaagccagagaaagagcacagcttttcacacaattgaatagatctcaacttcatgattttggtattgaagatgctgacagtagccagtggctctgtgaaggcaattttccaacctaccattcttggctactcctgggatattttacttggctgtgagatccccctgagaagcttctctttttctcacacaattcctccatcagcgaagtgtggtgggcagcacacagtgactatgattcctggagatggcactgggactgaacttatgctgcctgtcaagattatgttcagacatctgtgtgtgcctgtggactttgagggaatgtcagtgacctccacctctgcctcacatgaagaggaaattcataatgccatcatggcagttcattgaaaccgtgtggctttgaagagtagcgttaaaactgacgacaccctgccaccatcatacaaatccttcaacaacatgttgcataccaccctagatctctatgccagtgtcattcatttaaaaaatttgccaaacgtggagacctggcacaaagatgtagacatcctagttgtttgggaaaacacagagggtgagtatagcaatctggagcatgagagtgtgaaaggagtgacagagagcctaaagatcatgactaaggccaagtctttgcgcattgctgaatatgccttccagctggcccagaagatgggatgcaaaaaagtgatggctgtgcacaaggtcaacatcacgaaactgggagatggtcccttcctccagtgctgtgggggaggtggcatcccgctatcctcagctcaccttagaagacatgattgtggagaatgccacaatgcactttctgtgaagagggctgcagatacggtggaacgtgtgtggctcccaacaaatgtgtctgtccatctggattcacaggaagccactgcgagaaagatattgatgaatgttcagagggaatcattgagtgccacaaccattcccgctgcgttaacctgccagggtggtaccactgtgagtgcagaagcggtttccatgacgatgggacctattcactgtccggggagtcctgtattggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggt

SEQ ID NO: 1587 - DNA, 2043 bp, Homo sapiens
gtgcttaggcactgcagttgagtggctcacaaggagctaaaatttcactaatgcgtattcagtgggtggttctggtttgcctgatttttgcctctgggcatggctgtttcagcctgagaggctgttccaagaatgttgctttactaggagctcatgccgcctggtggtaaatatgaagtacagcagtgcaacagaccagttttactccaaggaaaccctgtagagatgacagcaatggttggtgatttctgcctcaattatgaaagtgatctggtgttacagggccagagaagactaggggagttcgggttttctagaccaaacagacactcagtcctgggcctggaggtctctgcagtgaggtgctgccacagacagagccaccttaactcctcaggacaaccagtggcttccgacacacactatgcactggagggcaagcagctctcagcttgggagcaactgaggatggtgaacagcctgggcaaggagtgctctgaggctaagaccctgaacagcaggaaccgaagtgcagctccccacttcaggtaatgtgattctaccctttgcctgagaaacatatccatcctaattgccatgtgctcagctggaccactagagggagccatcctgtaacgggtgaggtcaacctaacaaatggtatcagtcgagtattgatcggaggccaacgcaagaagttaccagtagcctatttcagatttattaaaaaacacataggtaacgagtcagagctttggctaggaatgatttggaaaagaactgaaggcataattccacaggacattcacagttgtgtgctagagacagagaggagcaggaaagtgttttagaagcatttgcggtggacaatggaaggcccggcttcatcgtattcctgtttgctgatccacatctgctggaaggtggacagagaggccaggatggagccaccgatccagacagagtatttgcgctccggaggggcaatgatctgtcagtcaagatgaaaaagaatggtcattaatgtcatcattagtgcagtcgttagtgcggtaggacagagcctggatgttctaccatggcctagtttcttgttcagcagggacacaggcttgtctgttagatgccaattgtgtcctaattgtgtcatgttcttggcaggaccgccagagggagccatggatttagaaattcttcagtggtttcatggatgccagcagactccatccctggaaaagagacacaggccatggtccttaagtggagagtaaaacccaggctagacatggaagaccagacttgaacatctggatgatcttgcagtggactgaggctgggaagacataataatctaggaaccacctgtctgagagacaaaagggtcttgttatgctctatgtcttcctgcctgccttctaatgaggaaggcctgctgcagcatcctgaggtgtgggctacaacagaaatgcttttggtcttggggcaaccgtcacttgtctccatgttctggaggctggcttgatatggaagaagacaatgactccccttcccaggaaaagggcgtttgttgcctaccgatgaaggatggctggaacagggtctctgggcagcggaaacgttcatttccgatggtgatcacttgcccatcaggcaactcgtaactcttctcaagggaggatgaggatgcggcagtggccatctcattttcaaagtccagagctacataacacagtttctccttgatgtcccggacaatctcacgctcagctgtcaaccagatacaaacattgtggcaaacattagggtctgcacaggtggcaaagattcacctgccctactgcagtctctccctcaagacatgtgccatcaaaaaatgtgtcagttcaatattctgcaatccaaaatccacaatgataatgacgtagtagggccaccagggaaccacctctgttcctaggacagtgtctcatgcatagtaggccctcagcatgcattgtctgggaaatgcataacaagaataaaatgagctagctagagaaaggc

SEQ ID NO: 1588 - DNA, 1969 bp, Homo sapiens
ttttttccccaactgcagtaccctctgatctctggctttcttctctcctgctcaggacctcatctattccagcccagtggacacagctcacaaggtactgattagcctgaggaccttcctgaggaggaatgaggatatccaagtgggcggtcttatccgaggccacttcctgctgatcctgcagcgtctgctagtggagcatggggcatccccatcaggagtcctccttgttcttcacagcctcggggaacctaccattgctgctgagcctcctctccctgatgcagctcaggaatgtgtcagagcaagaactggacagcgtggccatgaagctccttcaccaagtaagcaagctgtgtgggaagtgcagccccactgacgtggacatcctgcagccctccttcaacttcctgtattggagccttcatcagaccacacccagcagtcagaaaagagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcaggttcaccagacactctctgtggaaatggaccaagtattgaaggctctcagctttccaaagaaaaaggctgcactactctcagctgccatcttatgcttcctgcggacagccctgcgacaaagcttttcctctgccctggtagccctggtgccctcaggggcccagccactgccagccaccaaggacactgtcctagctccactgcgaatgtcgcaagtccggtccctggtcattgggctgcagaacctcctggtgcagaaggaccctctattgtcccaggcctgtgttggctgcctggaggccttgcttgactacctggatgcccggagcccagacattggtagaaactctccacattatctgatgttcccatgagagagattagagggagcaacacccttccaccctcctgctccagccttccattcccttgtgtgactcatacttgttttgtttaattcttttagcagcactgcaagggcagtcatgcccattatacagatgggatcaataaggttcagataggtcaaatgatgtgcccaaccaaggtcacaatgctcttaagtggcagagcccttcttactgcctgccttccacaatcatggcgtatatagtttcaccgagccagtcaacataagtggattagaagcccagggaagaaagaaccctccttgggtcagcttgttcagtgccctgtctctaactgggtagcccctttttaagccaataggagaaggtcctcttgagcaatgtcccaaggcaaggtcttggaagcattaacaacccagtgtttcttgaagctctccacgtggcctcccagccttggaatcggtttttgctgtttaccctcttggatgctggagagaattccttcctcagacctgagattttgaggctcatgaccctgtttatgcggtaccggagtagcagtgtcctctctcatgaagaggtgggtgatgttctgcaaggtgtggctttggctgacctgtctaccctctcgaacaccatactccaggccctgcatggcttcttccagcagctccagagcatgggacacctggctgaccacagcatggcccagaccctgcaggcctccttggagggccttccccctagcacctcctcaggccagccacccctgcaggacatgctctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcac

SEQ ID NO: 1589 - DNA, 2971 bp, Homo sapiens
agaatgccattggttaggccttttacttttgtcgttttaaaggacactctggacatccaaccgatgcacatcccacgcccccaccccccacgtttcctgaggctgcgtctggcctggaggaaccgcccagtgaagacaggtgctcgcagatatcaccgcctagtgttccctgggcccacttgcggggaagtcttggaggtgaaaatccaggtctggaatgaatgcattccacagatgcatatggagagctactgcatgcccagcaccattcctaggctgggagcaaaacgcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggagttcctccagcagtgtgaccgggaggatctggtggaattggctctgcctcagctggctcaggttgtgaccgtgtatgagtttcttctgatgaaggttgaaaaagatcatctagcaaagccttttttcccagctatatataaggaatttgaagagttgcataaaatggttaagaaaatgtgccaagattacctcagtagttctggtctgtgttcccaggagaccctggaaataaacaatgataaggttgctgagtcattaggaatcacagaattcctacggaagaaagaaatacacccagacaaccttggacccaagcacctcagccgagacatggatggggagcagctagagggagctagcagcgaggagagggaacgtgaggctgcggaggagggactggcctcagtgaaaaggcccagaagagaagccctgtccaacgataccactgaatctcttgctgccaacagcagaggccgggagaagcccaggcccttgcatgctttggccgctggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgttggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggagttcctctagaagctgtggagtcggtcgtcaccgtggagccagagccctcacagtgaagtggagtcagatcctagattcgtctgattttatccagagaaggtctatggcaagcaatgtatatttttctaatgtcaatattgcacagatgaaccttttatttataaagaataatgtctttc

SEQ ID NO: 1590 - DNA, 2702 bp, Homo sapiens
gactcggccccatggagacgccgccggccgccactggcgcatggcgggtaggagctgtggcgcggggccttccaggagtctgagctatgagtggcccctgtggagagaagcctgtcctggaagccagccccaccatgagtctgtgggaatttgaggacagccacagccgtcagggcaccccaaggccgggtcaagagctggccgctgaggaggcctcggccctggaactgcagatgaaggtggactccaaaggggaagggactgctcactaccaccaccaaagccagggcaggggtggggtgtgaccacctccctcctcctgctcaggcctagggggtggcaggctggccatcagtgtgggctaaccctgtcctctccctcccagccatgggaacaaggaggtcttctcctgccggggcatcctgctggcagtgaactggtttctggagcggggccacacagacatcacagtgtttgtgccatcctggaggaaggagcagcctcggcccgacgtgcccatcacagaccagcacatcctgcgggaactggagaagaagaagatcctggtgttcacaccatcacgacgcgtgggtggcaagcgggtggtgtgctatgacgacagattcattgtgaagctggcctacgagtctgacgggatcgtggtttccaacgacacataccgtgacctccaaggcgagcggcaggagtggaagcgcttcatcgaggagcggctgctcatgtactccttcgtcaatgacaagtttatgccccctgatgacccactgggccggcacgggcccagcctggacaacttcctgcgtaagaagccactcactttggagcacaggaagcagccgtgtccctatggtatggaacccagcctgccctccccggccctcctcactcctgcccttcctctcacctgtctgcctgtgccgtgttttcctcttggggacctccaccattggaccacccaaccccgtttcctgtgccaccccttccctgctctcatccctggttctgaagtgcccctgcttagagtccctcttgattcctcttccaggaaggaaatgcacctatgggatcaagtgccgattcttccacccagagcggccaagctgcccccagcgctctgtggcagatgagctccgtgccaatgctctcctctcaccccccagagccccaagcaaggacaaaaatggccggcggccttcaccttcatcccagtccagctctctgctaacagagagtgagcagtgcagcctggatgggaagaagctgggggcccaggcatccccagggtcccgccaagagggtctaacacagacctatgccccatcaggcaggagcctcgcacctagcgggggcagtggcagcagctttgggcccacagactggctcccacagacgctggactcactcccgtacgtctcccaggattgcctggactcgggcattggctccctggagagccagatgtcggaactttggggggttcgaggaggaggccctggtgagccgggcccaccccgagccccttacacgggctacagtccctatggatctgagctcccagccaccgcagccttctctgcctttggccgggccatgggtgctggccacttcagtgtccctgccgactacccacccgcgccccctgcctttccacctcgagagtactggtctgaaccatacccactgcccccacccacatcagtccttcaggagcccccagtgcagagcccaggggctggcaggagcccgtggggcagggcaggcagcctggccaaggagcaggccagcgtgtatactaagctgtgtggtgtgtttcccccgcacctggtggaggctgtgatggggcgcttcccacagctcctggacccccagcagctggctgccgagatcctctcctacaagtcccagcaccccagtgagtaagctgcctgtggctggcaagggcagcacccccagcctccaagggccgtcaggctgggctttgggccattgagcagcccattcccagccctgaggcccaccccagaggctggacagagggaggattcaagtcgggaaggaaacccacaaaccaaagatactgtaggattggttctggcccatgcagcacctctagttgtctgcctcagtgggtcagaagcgatcaccctgttgatacacattgtatctctgtagtttaaggagacgctgccggtaacggcgtcggtccgtggctgaggcccaaaccgtcttttctctcagagggtggggagggaggtgggggcagcagaggcctgggctgggtgccctgtgcacgccaccccacttccgccctacccctgggacgttggccttggctggctagttgggcaccgtgtgcctgccctccaagggcctcctctacgccaatgaggcctcatctgtgctctcgctgggcacgtggcttcatgtcagtaagcaagatgcttcttaataacccaccttctgccccactctattccttatcctgctgcccctgtaggggtcaagggccctccgtctacaccctcttcttctcctccatcctttattcagagtcatctcgcccttccccatgggtgggggaacctgtgtttgtttgtgtgcacatgtaaattttaaatattttaagcagaaagtccttacctcctgtaacacatcaataaagtacaatcattgtgagccctttc

SEQ ID NO: 1591 - DNA, 1543 bp, Homo sapiens
ggaaccaacacactcaaggacccagggcctcagggcagtcctcgaacaccactaaaacaaaggcatccttctcccctggtttactgtcacccccagggggactggagcccagcagttcactgcctccctgcccgagggattcggactctgggtggcttgcaggtgtccgggcaacctgcacagggagacaacagccacagaaatgaaaactgcaaaatcccttccgtgggaggcctcgaggcattccccgaacagcctcaatgctctccacacatgcctccaggcaggaggatacatacgtttgtcatctctacagctgagaaaaaccaaaaccacaaggccacaggtcagaggctgtcttggggatggccaggggagggggacagccctgtcccttccatacaggccacagagtgagccaagaagccttctgggcccgtcttgtgtctcttgcaccttgtcaatatcttgtggtacacagtgtgcaatgaacgccaccagacatctgcgagaggaaaacagggacattccgaatcactgaaacaagccaaccttggaagggcgggaggcccgggacgcggcaaggcctcccaagaacgcgggcgaaaggcgaagcacaggccatctgagtgcacagacggactcaacgcagcagaggagccgcagcaaacaccgtcggagccgcggagcgtggagggcagatgagtaaagtagggtcttgctatcaagcctgaaagcacctgccccgcctgcctgtgcctgaactccacgctcacagttttcagggagaagtctgacccatgtttatcagaccagagttcagggcccaccgggtcagagaaggctccctgggagtctgggctctcagagacatcacagagagcatctgttccgcggggcgagagccctgttagaagaaagcttcagttatgtgagcagtggcgccagtgctgagccctggggagccaatgcaactttctgcccacctcagggatgccaggccccgctgaggccacatacccaagaccacgtgagaggacccaagtcccccgcgagctggatgaaaggactgagcaaacggtgtttcttctaacggcctcaggtcttgatttcagtcactcctcaaacctctcgcttcttcgcccaggtctatggaaaggcaaatgaccgaacactcgctcaggatccagggacccctccaacactgctccaggtcagcttctccacaaacaagcagagggacacaggccgctcctcttccagcccctcctagggcgcagcaaagggctgagctccgggtaattctacagctgttcagcgagcacaagtcaggcactgcagggatggtgcagacgacaccacgccgtcgtccactggacaagatgaccccaaagcgcaaagctagagagcctcacgggacacagcggaagggcgcggggaaagccaggcaatgtcggacccaggcggcaccgggtctgggaggtgggcaggcaggagtggtcaccacttcagggtcatccaggaaatacagaacattttccag

SEQ ID NO: 1592 - DNA, 1844 bp, Homo sapiens
atgaagacctccccatcagcccagagctggccccttgtcctgggccactgagacccagaagtaccaaggctggagtcagcttgcagcacagccagggtcgaggtcactccctccctgaggactctagcacggcacagcccctctgcctctctcctggtggtggcgttgaaacagcaccctctgcttcagtcctctacaggatggcagagaaggaggcagtcaataagatgtccctgcacaaccttggcacggtgtttggccccacgctgctccggccctccgagaaggagagcaagctccctgccaaccccagccagcccatcaccatgactgacagctggtccttggaggtcatgtcccagatccagatacctaataagatgctggaatgtaatccctggacaatccgtgtcctggcagcatttgatcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccggcacctgcgggggagcccaggcattctttgtaagccctcctgaccacctggctcaaagaaaacagaagcatggaggccgccaagtattttcaagaaataaccccatgaacatggcatcacttttttagaaagaggggcttggggcaggcagaggagagaagggagagcaaactgagagccaagtttccagacagtcctgcaggaggagaggatgcagctgcgcagagggaagcaggatcacatttaaggaagtgtgtggggtccctggatgacaccagcacccagtgcggctctgtctggcaaccgctcccaaggtggcaggagtgggtgtcccctgtgtgtcagtgggcagctcctgctgagcccgcagctcactggggagcctgacagcggggccatgtgcctgacactcctctctgcttgtggacctggcaaggcagggagcagaaaacagagccacttgaaggctttctgtctgcgtctgtgtgcagtgtggatttagttgtgtttttttcttgctgggagagcacagccaccatttacaagcagtgtcaccctcgtgggtggcgaggacagaacaggagcctctgctctctgtacctatctgggcccggtgggctcccttgtcctggcttccatctctgtctcagcaaccattcagccctgcgcaggaacacgtgttgcttagaaaagccaaatccagccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccgcagggtcccagggctggtggttgctttgggtctacagctacgtcttacccgcctcctgcctcaacagcctgtgtggtagcaaagccggtgtggggctggggaacgcagcgttctccaggagggggacccggctctccttctgcaatgcaggcgaaggcctagatgccagtgtgacctcccacaaggcgtggcttccagactccccggccggaagtgatgcttttttgccgtgggccctgggtttgaagcagcctggctttctcttggtaagtggctggtgtcttagcagctgcaatctgagctcagccacctacacaccaccgtggccgacactttcattaagaagtttcctgagacg

SEQ ID NO: 1593 - DNA, 1962 bp, Homo sapiens
agtaggaggcggcaagtttgaaaagtgatgacggttgacgtttgctgatttttgactttgcttgtagctgctccccgaactcgccgtcttcctgtcggcggccggcactgtaggtgagcgcgagaggacggaggaaggaagcctgcagacagacgccttctccatcccaaggcgcgggcaggtgccgggacgctgggcctggcggtgttttcgtcgtgctcagcggtgggaggaggcggaagaaaccagagcctgggagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgtt

SEQ ID NO: 1594 - DNA, 2012 bp, Homo sapiens
acattaagtcttcagccttgttgagatagtgaatatttatgccgtatttgagaattaatattagcagaaatgtacaatgtagatttctttttaaaattctaggttactttatggaattgggctcttagagaacaagaaaagactgaagttttacgggaaaacaaatcatgtggtcttcagattctgaaataaggagaaatgcagccatctgaaatggtcatgaaccccaaacaagtcttcctctctgtgctgatatttggagtagctgggctactcctcttcatgtatttgcaagtctggattgaagaacaacatacagggagagtggagaagagaagagaacaaaaagtaacttcaggatggggaccagtgaagtacttgcggcctgtacccagaatcatgagtacagaaaaaatccaggaacatatcaccaaccagaaccccaagtttcacatgcctgaggatgtacgagaaaaaaaggaaaatcttctactcaattctgagagatctactaggctcttaacaaagaccagtcattcacaaggaggggatcaagctttaagtaagtccacagggtcaccaacagagaagttgattgaaaaacgtcaaggagctaagactgtttttaacaagttcagcaacatgaattggccagtggacattcaccctttaaacaaaagtttagtcaaagataataaatggaagaaaactgaggagacccaagagaaacgaaggtctttccttcaggagttttgcaagaaatacggtggggtgagtcatcatcagtcacatctttttcatacagtatccagaatctatgtagaagataaacacaaaatcttatattgtgaggtacctaaggctggctgttccaattggaaaagaattctgatggtactaaatggattggcttcctctgcatacaacatctcccacaatgctgtccactacgggaagcatttgaagaagctagatagctttgacctaaaagggatatatacccgcttaaatacttacaccaaagctgtgtttgttcgtgatcccatggaaagattagtatcagcctttagggacaaatttgaacaccccaatagttattaccatccagtattcggaaaggcaattatcaagaaatatcgaccaaatgcctgtgaagaagcattaattaatggatctggagtcaagttcaaagagtttatccactacttgctggattcccaccgtccagtaggaatggacattcactgggaaaaggtcagcaaactctgctatccgtgtttgatcaactatgattttgtagggaaatttgagactttggaagaagatgccaattactttttacagatgatcggtgctccaaaggagctgaaatttcccaactttaaggataggcactcttccgatgaaagaaccaatgctcaagtcgtgagacagtatttaaaggatctgactagaactgagagacaattaatctatgacttttattacttggactatttaatgtttaattatacaactccatttttgtagtttgcattcattttctaaaaccctgtatatacttaatgatgataagttcaaatcagctgtaatttttctataattctctgtatgacagaaatttaaccaagtgcagttgtcttgatttaatgtagatttttaccaaatagtatgacaccaattggcacaaagttataggaaaatcacctacaggagatgtaaacaacttgagttgctctaaaatgtttggaaaagagctgcttttgcattatgaattatattgttgaagcaataacctagccagctgttgcattagctaaagcagcctcttgcaatggtaggaaaaaaggatctcaaatagcatgagtgtatgtctatatcctgaaatttattgtctaaaatgcatgaatatatttttagcagtctgtggcatattaatcaaactgttgaattgttttcttacaccctggaaatctttctatcaactataatgataaatccattttgaagtg

SEQ ID NO: 1595 - DNA, 1523 bp, Homo sapiens
atgaagaggcggcggcgccggcgcccggtcgccccggccacggccgcccggggcggcgactttagggcagaagacggggctgggttggaggcgcgggaggagaaggtggtgtactcgcggtcgcaactgtcgctggctgacagcaccaaggcgctgggcgacgccttcaagctcttcatgccccgcagcacggagttcatgagctcggacgcggagctctggagcttcctctgcagcctcaagcaccagttctccccgcacatcctgcgcagcaaggacgtctacggctactcctcctgccgggccctggtacccgaccccccggggccccctacagcccgcggccaggcgcgccggccggttccgcgcgcagcggccaggaggaggcgccgcggagcccgggcggccgctgcccgcaggaggaagccccggccgccacccccaccgccgccgccccccgaggagagctgcccggccaagcccgtggcccccgggccctgcttcgggggccgcaccttggaggagatctggagggcggccaccccgacgctgaccaccttccccaccatccgcgtcggcagcgacgtgtggggcgagcgcagcctggcggcagcgcggcgcagggcgcgccaggtcctgcgagtgaacctggaacccatggtgaggctccgccgcttcccggtgccccgggcatgaggtgcggcctccagggcgcctcctgccggccccgaccttgggacaggccttccgcccggaggaatgaacaagtgtcagtcgagtgtttacagatccggccaggaccccggcccccaatgcactttacgcgcgaagaagttgccggatggttgtccctgtcccgggccgcggcgcggtcgtcttggacgctggggcaggtgtgccctctgctgcctcccgtacccggcctgcggagggaggggacagctggacccgcaggggaggtccctttcttcctgaccaccgattgagacgtctccaggaccttaggggcagatccgttttctcactgttggactctacctcactggtctggaagtcctccgaagacattatttttccaaaggaatttggtttcgtgcttgtgtaataaagccagaatttacttgttctttatctccccctttttctatttcactgtcacccctctttgtggacagaagttcgaacatgtggtgttgcactagtttgtgctcagggtattctgaagcccactcgtttcctaatttttactggattccaaagctttgatcgaggatattttttaagaggttcaagcttgtgactgttagtagtgcaaggatttgtatgggctcagtgattacaaacaaagacatgcaaaatacaactgtttaaacattttcaaggtatttttaaaggttttgtattgaaacaatgtttatatttactgagctcctaaaaatggtagaatacacatgaaaacttttgtttaggaaaagttaacttgttaaattcttttgaattgaataaaaaaatgcattgaaacc

SEQ ID NO: 1596 - DNA, 1760 bp, Homo sapiens
atcacttctgctgctccacacacccagagaaggagtggggtggggggtggttaacagggtatgctgggggtggaggatttggtgggggctgggaggtgggggaggggcccagaaaaccttcctgattctggagggaggcttgcagagcaggccctgcaggggccatcccatcccttctcctgcctccctcctccagagcaaatccttggtgcctggagggctctaaaggaggagttgctgtcccgtgctccttcgcaatttaccctgtgcacggaagtcctccagagctctaacctctccccgacccctgcagtatctccctttgttcagtcttcagtggaaatggagaaattcctagttccactctccatgttcttgtctggtgagaggacttggaaattactcctgcaggttgattttcttaaccagggtggggagtattataggaactggagaaagaggagaaggacttagtatttagtgtctgaaaatattttgctcttgaggactctgacagctggaaccacacctggttgccccactcatctgatggtggggcagtagttccagtgaccagaaaaattaaacctcaatttacattctgagggtgaggctagaggtaccctcaggaaaggtactggactgggagtcaggagacctggatttgaggactagccctgccctgccacttactagctgggcgaccttggacaagccactagtcccctctggacctcaacttccttatctgtaaaacaagggggtgggccaggcgatgtctaatcgggttccggtcagctccaggctccagcatgtggagatcctgtgtgtggcatcacttagcgccgagaagtgcagaagtcacagttgcccctgccccttctcaccctggatcctcacccaggtgtcgcatcatgccagtcagtctggccgactccaccaatggagatgggaacctgggacccagagagaaaggatgcagttccctcctggcataggctcccaggcacaaaaatagcatctcgagaaatacccacggctgatgtggattcgcacaaagagacacacaagtgtacagaccacagcaaggaccgtgctgacggggctctgagatagggagacaacagaaaaagacaaacagcgatggagatgaaaactgttgatttgtgaggggcctccacagagaaaaacagggaaggtaacaagaaatgcatgcatctacagcaagaaagatggatgctacagagagagagggggacttcctggtgatgagaggaggtggaaattatgctcagtgtcaggagggtgagtgaagacatctgcagcagaatttatgagagtgcacaaagaattgattctataaccttcctgccctcaagtggcttccacctcaagtggaagattcagactcggattgctaacgaaaagtacctaaggacccacaaagaagtagagtggctcataagtggtttcttcagagaaatatttttgaaaagaccagacaacatcctagaatttgctgcagactacttcacggatccaagacttcccaacaagattcacatgcagctaattaaagacaagaaagcggcttaattagcaaaatcatgatgctcagctgttgggagagaccagacggaatccagcctcgggggtcatctggaggcatgagagccctactgccatcagtgtgggtttccaagctgccttgggctctgtctactgtcgcaaaagcttttaaagatattcattaaacacgg

SEQ ID NO: 1597 - DNA, 1766 bp, Homo sapiens
agtagcaatggatgtggtgaggagtggagtgcaatggcgccatctccgctcactgcaacctccacctcccgggttcaagagattctcatgcctcaccctctcgagtagctgggattacaggcgtgcaccaccatgccaggtaatttttttgtatttttagtagagacagcgtttcgccatgttggccaggttggtctcgaactcctggcctcaaatgatccgcccgcctctgcatctcaaagtgctgggattacaggggtgagccaccgctcctggctgattttggctatattttaaagccaacaggatttgctcgcatactggcctgggggaggagagagagttagggagtcaagaatagctccaaggtttttgggctcaataactgtaagggaagaatggaattatttactgaaatgagaaaaactggaggatcttgttgggggttaaagctcaggttttggacatattagctaagtttgaattactagacattgaaaagaatttgtcaagaagacattcggatatatgagtctagaattcagaggagaggtctgcgctgagtatatacatttgtaagtcctcagtatatggtatttaaaagccatgagattggatgaaaaactgtcaccaaggaagcgagtgtgcctagaaaagaggtccaagggctgagtactgggccacgacaatacttaaagcttggggagattaggaggaaccagcaaagcaaatcgagaagtaataaatgaagaggtgaactacgtaatgacctagaagccaagggaggaaactatttcaagactgatcaatgtgtcaaatgccgctaacaaagcaagacaaggcacattaaagaatttggatttttcacgaaaccgagacacatgcgggctttgttgttgttgtttttatggagggaagtgagtccatcggccttatttgagcgttgtgcggaacagaggaaagcggggcgacaagagcccaaagcacaagagacaggcgttcttcttaccgtgcgacgaagtgtaggcccagctgtaaaagagaaagagacttgtgaggagcaaaggaacacctacccgctcgcctcccgcttcccctccagtcctcttacaggaggtagcgggcttggcccgggcagctgtcgtgcagtccccgcgctgcagcctcaaggtagtgcttctgtctcatcgccgccgccgctgccgctggctcgccgcgggaaccaggtgagaaaatagggcgccggaagtcggcttcccagcgtccccgtcgttggtgtccggactcaagctgcttccggaaacaggcaccgtaggcagacaggttccggtttccttcgcgtccagtctggcttggaggcgtgcccagccgggaggcggccccacccgcccgccgcgtccccgccccctcagttccaccccttggcctgccgggtcccctcaggcacccagcggagtttcgagtcagacttgagctcgggcgtagcggctagaccgggctgtggcgatagagtccaaaggtgaggctcccacccgcctctccatcttcctcccgcctcgcctcctctctgacagcccttttgtgattgccctgccgcagcttcgccctccacattcgccgggcgcggtactgactggtgcgccggcgggcggaagcgctgccagcaacgaggcggccgggaggagcgtccccagtccagcctgccctccgcctgcgtaaacgctagcgtttctctttttgtaattaaagtgaaattcacataacgt

SEQ ID NO: 1598 - DNA, 1930 bp, Homo sapiens
gcggtccgggagggaggttcggcggcgggaggcagcatgtcggttgcagggctgaagaagcagttctacaaggccagccagctggtcagtgagaaggtcggaggggctgaggggaccaagctggacgatgacttcaaagagatggcgatgtcatcagcaaggcggtgacggaaatgctggcaaggaccatcaagtacctgcagcccaacccagcctcgcaggctaagctgaccatgctgaacgcggtgtgcaagatccggggccaggtgaagaaccccggctacccgcagtcggaggggctcctgagcgagtgcctgatccgccaccagaaggagctaggcaacgagtccaacttcagtgacgcactgctggatgccggcgagtccatgaagcacctggcagaggtgaaggactccctggacatagaggtcaagcagaacttcattgacctcctccagaacctgtgtgagaaagacctgaaggggatccagcaccacctgtagaagctggagggccgccgcctggacttagactaaaagaagcggcaggacaagatccccgatgaggagctgcgccaggcgctggagaagtctgaggactccaaggaggtagcagaaaccagcatgcggtcctggacaccgacattgagcaggtgagtcaactcccggtcctggtggaggcgcagctgtactaccactggcaggccttgcagatcctagacgagctggcagcgaagctcaagcgcaggatgcggaaatcttcctcacatcaaatatttgaaaacaaactagaaactgtccaaccgcatttctactgcgcccgcccgcagatgcagttttctccgcacgtgcgcgccttctctccttcccgccctcagggtccacggccaccatggcgtatcaggggcagcagtacctgtggcagcattggcctttgcagcggcggcagcagcaccaggctctgcagcggcaccccccagcggcttaagccatggcgcttctcagggcattcagcagcagcgttgctgtaaccgacaaagacaccttcgaattaagcacattcctcgattccagcaaagcaccgcaacatgaccgaaatgagcttcctgagcagcgaggtattggtgggggacttgatgtcccccttcgaccagtcgggtttgggggctgaagaaagcctaggtctcttagataactacctggaggtggccaagcacttcaaacctcacgggttctccagggacaaggctaaggcgggcttctccgaatggctggctgtggatgggttaggcagtccctccaataacagcaaggaggatgccttctccgggacagattggatgttggagaaaatggatttgaaggagttcgtctttgatgccctgttgggtatagatgacctggaaaccatgccagatgaacttttgaccactttggatgacacttgtgatctctttgcccccctagtccgggagactaataaggagacccccagacggtgaacccaattggccatctcccaggaagtttaacaaaacccgaccaggttgcccccttcaccttcttgcaacctcttcccctttccccaggggtcctgtcctccactccaggtcattcctttagtttagagctgggcagtgaagtggaaatcctgaaggagataggaagccagactccactgcttacgttgccatgatccctcagtgcataaaggaggaagacaccccttcagataatgatagtggcatctgtatgagcccagagtcctatctagggtctcctcagcatagcccctctaccagggactctccaaataggagcctcccatctccaggtgttctctgtgggtctgcccgccccaaaccttacaatcctcctggagagacgatggtagcagcaaaagttaagggtgagaaactggataagaagtt

SEQ ID NO: 1599 - DNA, 2510 bp, Homo sapiens
gactttttaataatagtcgttctgactgatgtgaaatggagtctctttgtggttctgatttgcatctctgatgatgcatgatgttgaccagtttttaatatgtttgttgactgcttgtatgtcttcttttaagaagtgtctgttcatatcctttgccctttcgcttctatgcaccaataacacccaggctgagagtcaaaccaagaacacaatcctgactacagtagccataaagaaaatgaaatacctgggaatacacctaatcaaaaacatgaaagcactctctagagggagaactacaaaacattgctgaaagaaatcagagatgattctctgaaaaagaagtcagattagaaatgattctctgaaaaagaaatcatctctgatttctttcagcagtgtgttttttgtttgtttgtttgttttgagacagagtcttgctctgtcgccaaggctggagggcaatggcatgatttcagctcactacaacctcctgctcctgggttcgagcgattctcctacctcagcctcccgagtagctgggattacaggaggctgagaaaatgttagaaattgggggagacaagtttcccttagagagcaggaagttaccaagtagtcctggaaagaacatcagttgcagatgtgacccctctgagattaatatatctgatgaaatgcctaaaactacagtttggaaagctctcagtatgaattctggaaatgcaaaggaaaagagtctcttcaactaagagtctttgctgggatggaagatttgggccgtgtggtgcctcagggaagttctggttacagagaaaatggcgagtctctcagagaagaagcaagaccaagtctggccctgtccttggtcatctcaaagccatgccgaagcattcagttattcttggtgtgcattggaaggcatccagctatccccataccagcagccagtcaccagatgtgaatgtggaagcagaagaccacctcctgttggttcttctcctcttccttctttttctctttagaacggccaccattgaagacctagcttcccattttccagacgttttctctgaaattctctgctggcctgccaagccatatggattcattctgccactgaggagtccttcagtgaggtccctcttcctaaaggacagagtggggagtaggaggggaacagagaggacatcctctctggctctccagtgctcttagtgtctacaggctcctaggcagccctgggccttggtttgattacctcccctgggggatgctggtcagacccagaggttgtcaggaggtcagctaccaggaagatccatgatctgggcattggcagtgcctgccaccacagccaggaagatgcctctgacctgggtgcatctccatcactccttagcagcagcctgcataactggcaagaatcttggatgatacaagagccaagaagggacatttgagttgtgtcgcttagataggaaagggatccagggaaaatcaacagtaagtgaggatgagcagtgtctcttggttttcattgaggatagagtaagagattgagtttagattgcaacagaaggaattagtttagataccaggaagaacttcctagcctgaagatttgtcatagtgtctgctttctagatatctgggaaagatttgataatagttgtttgtgaatagaaaggaggatatgatgtttttattggccattttgcgggactcttcgacttcttgctgctgtctcttgaggatacattccaattccatcctggcgagatccaagtgcttacgtactgtctccttagctgccttagagtaaacgatcatcagttcaatggaccaaaatcaccttcagccatgtggtttcttcatcatcatggatttcttttggttgacaaacattctggctctcagatgcaaaaagtcacactgggaaatgaactgtaagtggtgaaattagttttggtatttaatttaaaactacatttatagtttttctcttctcttctatgttgcaatgaatgtaaagtatttgggacccagtgcttataaacctttccttcctttgtgcacagaatgtaactagcaagcccattagcacccagataattctatcatgttagtttcccatcctggaaaatctttgtacagtgggaagttccccgatgtgtttttctttcttaggtgaagggttggctatatcactttattgaattttgcattccttagacttttaaaatatactaatgtattctagtcttactctaaagacctttgatgttaaaggaatccttcatttatttcatattccctatctcatagggccacaattattttaatacagagatgattttcaaaatattttaacaactggtacaggacagatgccagccactcagaagggatgcctgctgtaaacaagcagtatgtatggttgtaccaatgcctattggctgaacattatgctactttcagatattaaaatggtgttcctttgaatcgtg

SEQ ID NO: 1600 - DNA, 2483 bp, Homo sapiens
ctaaaagcccaggggctccggaaagccgaccgcgctttacaggacacgtgccaccaggaacaggggcgaatccgaggtggagaccgtgtgaccacgcgtggcactggcctaccccacagcagatggtgtggatgtgtgtcgccggaggcatacggggcgacggcgaaacaaagggtggtgtccaggcatgtgctggtggaagggggaaacgagtgacctttccatcaatgccaaggaaagtcgaagaacacctggggctcggggggtgcgggtcgagatggggggctgtgcctgacccaagccacgttttcacatgcctaccagaggagcaaagaggttttggcaaaaatcgccccacccccaagcctccatcgccctggtagccctgacgcaacttcggctgcacccagccccagccccatccccagccccagccccagcccagtccctttggtttcctgacatttgtttcgtccagaagatcaagggagtcaggccacccaggagcagaggagaggatgtccctcaagaatgagacaggaagtgcaaaggaaatgggacaccacctgtcctggaagtcaaggccagtcacggtcgcctagcgctcattctaggcaatccacccacccatgaggggaaacgtggggaagaaggaagcttccctgcctgagacacgtatggaagccaagagctctcggctcatgatacctgcccaattaagcagaaacacgtttggagagagaaacgatcatgacacggatctccaggaagtgtctccctgacggactgggaagtcatcttttttgaaggcatttggccagagcgagaggcatccaggcccctgagaaacaggggaggcagagccagagggaggagagagtagaggccagagcccaggcaggatacagcaccgtgccaccgccacagacataaggggtggggttcctaaagggtggcttgtccagggaggccagcgttccagtgacagggactgttgccatctcccattcccggcttcctcttgctgactgtatcgtggtgtggcttcatttctcagagaagagccgtgaaaagatacaagcatcttctctggcgtggatccgctgctctcctgtgggacaaagagttcctctggggctcttgttctcggctgcagtgtactcatcttgatcctagaaaagaggccactcaggatggggatgagatttcagctgctccgggagcgacgcatctcctcacgtgggccaggctttcaggcacccaaagcggatccgccgcggcgaaaacgattgacagccggcctcatgacccaggtagagacgcagaaagaggctcaccaaagacaggccgccatgcgacaaaccgctttgtggcgcacagggcacattcggccaaagacacacacgcacacgggcatacacacacaaacccacagagagagggaaagaaacacacagagactgagagacagagagagaagagagactgggagacacacacacagacacacacacacacactcacacacacacacacacacacacacacagagacacacacacagcgtcatacagcagaggcattgaaacacacaccaccaggcaacccctgaggctgcggggttctgctcacgacgagaacgactctcgggtgagagagcagcccaggggcacgcaggccgacctgtcctcgagatcacggatggcggcacgacttttggggagactcaccccaaccaacaccgtccgggcaggcctgaggctgggatcccgtgctgcttcccccgtccccgcctggggtttcctcatcgtggtcggccctttgcgactcctggcatccggagacgttcccgtcgaccccgtggagaggtgaggccggatcctcagagccccgacacccaagcactgccacagagggctcctgctttgccaagcctcggggactggtttctaagacaaccatgggaaccactgtgacgggagaaaccgctcccgcctcgcgcatgcgcattggctgagccgactcgcgctccgctcctggcagtatggctgcgtcccctttaaataccgccaccgccgcgcggcggcagcgaggttcctcctgccgccacggcggcggctggatccggggtccagtttggggcggcgtgggagagggggccgcgggtgtcttgtcctgtcccagggccaaacccctaggagtcctgtcctcaggacctccttgagccgacttccacggagggaggtggagcttcaagatgcctgctgtgttctccagactcccgttcagatccgattttggacccctccgagtgagataggataggctcaccacatctggtgaggcaggcagggccttgctgcaacacagaatgatcccgtaggtctcaaggcctacttgtactgttgtacataatgtatataattgacttttattcactcgacaaaatttcctaaaaatacatccaaatgattgcattaatt

SEQ ID NO: 1601 - DNA, 1855 bp, Homo sapiens
aggcagctttaacctgggtgtgggtgaggatgacactgtgatgctcctagaggtggttcatgaggaatggacgaataagtggttggaactgatatgagaacacatagctgaagaagagacacaggagtgttgccatgttgtccaaactggtctcgaaattctggagtcaagcagtctgcctgcctcgttctccaaacgtgctgggattacaggcatgagccactacgcctggccaagtattcggtatttataaaatctacagtagtacacagttatgtcgtaggccatcacattcggtcaccacacactcactgactcatccagagcaatttctagtcctgcaagcgccattcatggattgacttataaacagtcatgctatgtgatgaagaagcccagaagaggaaagcaaaggagtcagggatggctcttcctcagggacgcttgacattcatggatgtggccatcgaattctctcaggaggagtggaaatccctggaccctggacagagggctttatacagggacgtgatgttggagaactacaggaacctggtctttctgggaatctgtcttcctgacctaagtattatttccatgttgaagcaaaggagagagcccttgattctgcaaagtcaagttaaaatagtaaaaaatacagatggaagggaatgtgtcagaagcgtgaacacagggaggagctgtgtattgggaagcaatgcagaaaacaagcctattaaaaatcaacttggattaacccttgagtcacatctgtctgaattgcagctgtttcaagccggaaggaaaatttacagaagtaatcaagttgaaaagtttacaaaccatcgttcctcagtttcaccacttcaaaaaatttcttctagtttcacaacacacatttttaataaatatagaaatgatcttattgatttcccattactcccacaagaagagaaagcatacattagaggaaaatcttatgaatatgaatgtagtgaagatggtgaagtttttagagtccctgcaagccttactaaccatcaagtaatccataccgcagagaaaccttacaaatgtactgaatgtggcaaggtcttcagtcgcaattcacaccttgtagaacattggagaattcatactggacagaagccttacaaatgtagtgaatgtgacaaggtgtttaatcgcaattcaaaccttgcacgacatcaaagaattcatactggagagaagcctcacaaatgtaacgaatgtggcaaagcttttagagagtgttcaggacttactacccatcttgtaatccatactggagagaaaccttacaaatgtaatgagtgtggcaagaacttcaggcacaaattttctctaaccaatcatcagagaagtcacacggcggaaaaaccttacaaatgtaatgaatgtggcaaggtctttagtctgctttcataccttgcacggcatcaaataattcatagtacagagaagccctacaaatgtaacgaatgtggaagagcatttcacaagcgtccgggccttatggcccatcttctaatccatactggagagaaaccttacaaatgtaatgaatgtgacaaagtctttgggcgcaaattatacctaaccaaccatcagagaattcatactggagagagaccttacaagtgtaatgcatgtggcaaggtcttcaatcaaaatccacacctttcacgacatcggaaaattcatgctggagagaattcactgcgtaccttacagatggaatgaatgtggcaaaatctttagttagaattcacacctagcacaacattggaggactcaggagaaaaaccttacaaatatcataaatgtggcaaag

SEQ ID NO: 1602 - DNA, 1811 bp, Homo sapiens
attcttgcttagttactctgctaattcttgttagtacctaataaaaatgtctttgtataacaatggatttgtgctatcaaaaactaaccaacagtttctgaaaacagtaactgaacaaagtgtgataatcgaacaactccgaaaaaaacttaggcaagccaaattagagctgagagttgctgtagcaaaagtggaagagttaactaatgtgactgaagatctgcagggacagatgaaaaagaaggagaaggatgtggtgtctgcccatggaagagaggaagcatcagataggcgtttacagcagttacagtctagtataaaacaattagaaataagattatgtgtgacaatccaagaagccaaccaattaagaaccgaaaatacacatctggaaaaacagaccagagagctacaagcaaagtgcaatgaattagaaaatgagagatatgaggctattgtaagagccagaaatagcatgcaactcttagaagaagctaaccttcaaaaaagtcaggctctacttgaggagaagcaaaaagaagaagacatagagaaaatgaaagagacagtttctcggtttgtacaagatgctaccataagaaccaagaaagaagttgcaaacaccaaaaaacaatgtaatatacaaatttctcgattaacagaagaactttcagcccttcaaatgagaatgcacaggatgctattgctagctgtagctcctatcatatgctgagttcatctgggaaaccaaggagaaagagaaagtatatataacagtgggaaggaagaaatacagaaagcttcctgaaagaaatgaatactgaggaatgagtaggccaagaggggagaggaaaagaatacttgtgtggctagaggagtgtgctgaaaaacaaggccaaattgaacgagtcattaaggaaaaaaaagcagtggaagaagaactagaaaagatttaccgtgaaggcagaggaaatgagtgtgattacagaaaactggaagaaatgcaccaaagattcctggtttcagagcgttcaaaagatgatcttcagctaagacttacgagagcagaaaatagaataaaacaacttgaaactgactcctcagaagaaatatcacgttaccaagaaatgattcagaaacttcaaaatgtattggagtctgagagagagaactgtgggcttgtcagtgaacaaaggctaaaacttcagcaagaaaataaacagttacggaaagagactgagagtttaaggaagattgccctggaggctcaaaaaaaagccaaagtaaagatcagtacaatggaacatgaattttcaataaaggaacgtggatttgaagttcaattgagagagatggaagacagtaatagaaattccattgttgaactgaggcatctcctagcgactcaacagaaggcagccaataggtggaaagaagaaacgaagaaacttactgaaagtgcagaaattagaatcaataatctaaagagtgagctgagtcgacagaaacttcatacccaagagctgctttctcagctggaaatggcaaatgaaaaggtagctgagaatgaaaagctaattctagagcatcaagaaaaagccaacagacttcaaaggcgtctaagtcaggcagaagagagagctgcttcagcttcccagcagctcagtgtgattacagtgcagagaagaaaagcagcctccctgatgaatctggaaaatatttaaaaatattcatagttcactcacagaactttagagttgggaaagcagttggactagaagtgtattgaaatggtaaagcctgcaaagtat

SEQ ID NO: 1603 - DNA, 1889 bp, Homo sapiens
atgcagggagaagcagatgccaggactggatgtgcagaatggcaaggtgaaggcatcattttattacagcctggaaaacatgaatttccatttcgctttcaacttccatctgaacctttggtcacctcgtttactgggaaatatggaagcattcagtactgtgtgcgggcagtgttggaacgacccaaggtacctgatcagagtgtaaagcggggactccaggttgttagtcatgtcgatgtcaacacaccagcattattaacccctgtattgaaaactcaagagaaaatggttggctgttggtttttcacttctggtccagtctcgctgagtgccaaaattgaaagaaagggatactgtaatggagaagctattccaatctatgcagaaatagaaaattgttcctctcgtctgattgttccaaaggctgctattttccaaacgcagacatatttggctagtggaaaaacaaagaccattcgacacatggtcgccaatgtgcgaggaaaccacatcgcttctgggagcacagacacatggaatgggaaaacgctaaaaatcccacctgttactccatccatcctggattgctgcattatcagagtggactattccttagctgtatacattcacattcctggtgctaaaaaattgatgctcgaactgccattagtgatcggtacaattccatataatggttttggcagcagaaactccagcattgccagccagttcagtatggatatgagctggttgacactgaccctgccagagcagcctgaagcaccaccaaattatgcagatgtggtaccagaggaagaattctctagacacactcctccttaccctcaaccccctaactgtgagggagaagtgtgctgtcctgtgtttgcctgtatacaagaattccggtttcaacccccacctctttattcagaggttgacccacatcctagcgacgtagaagagagccagcctgtttccttcattctctgaacgtatttcagaaatcactgtgttcatcatcaaattagaatgttggttcttttccttctgcctttttgggagagagacaggaaagattcacttgaaaacataaatgaacgtcaagactgaaggcaatagaaattaaagaatgtgagaaagttctggtgggccggcaggattgccgcacaagtttatatgatggtcgtatatatatccctgttaaaaactgggatgaagatgtgcaaagtcacagaatgtaatggaagtcctgatggttacagagtaagtgaaagggtgcctgcgctgacgtgagagaaaggaatctgtaaacagtggaaacactgtgggagtttcccatggtgttttgaagagtggaacgaaggcgatatgaactgaaggggtgaagacttgattttggagagggcaacaaaacaagggtgtgtgtgcataggagaatggcccactccaaatacgaagtgagatcctgagtctttgggtgcttcatgatttcctaccatattcaggcctaaagacattgaaaaagcatcttttcttgagatcatggtcatatgaggtcctaatgaagtactacagttttcattctttcaagggtagactaaaatatagtttataaatcggcagtacagtattatgaaaccaagaaagggtttcttgaaaagcttgtcggttcaaagaggaaagatgaatttcaatgtgaaaacacgttttgttgagggctgtactttttaccccctttaagtgctttaacaggatatacgtttgattttcctcatatcttatttacctaggagcatgtcagagaaagaagggagagaaaaggttgcatctgcaggatgccttgataactacacagtcccaaataaaaggcctttttctaacct

SEQ ID NO: 1604 - DNA, 2522 bp, Homo sapiens
aagcaagtggaggccgccagccgacttcctcgcactgtgcagctgctccagtgagggcgcagactgtactggcctgtgcggagcaaggcggtgtttctgagaggaatgcgcagctgaagagagaggtgggcagcaggcccggtcacctgccaggtgaccacatggccaggtgccgccaccactcgggttacctggccgatgacgaggccagccactccatgtgcagtgcacgggtgcagctgcccaagaagccactggtcccagaaatgcggccagcctgcaagccgggccgtgtgccacacccaccatccacatgtggcagctcagcactccagggccaacgccgaaacaagaggcaccctcagccctttggccactttctggatttcctaactgagagccaggtcctggacagcctggagacagtggtggagaaggcgactgagcgcatggctgccatgaagacggaggctggggtgccgcttgtggaggtgcaggacccagtggaggtgccaagtggtggacggcgggcacatgcccggcccagcctcagcaccgtacaccggcaccgtgtacggccgaccctctgcactggacaccccaacaactacccatccagctccagctccatgtccaactgccatagcagcctcatggccggctgtctgggctcccacagccgggacagtgacctaggtgcccaaggctcattgccacctgtgagggacaaactcctgctggagaagaacctcaagcggctgctacagctggagagggaagggaaaggcctcagtcagtcctgctcccagagggactccctgctgtgggattcgctgggtagccagaccagctttcagtggacacaggagcagcccttgtcctggttctcagggctgctgggctcaagctctggcgtgcctgaagcatcagagccgaggcctggagaacaggagccaatcttccgcaagcgagagttcaataaggagatcaagtcattactgagccagctggagtccctcgacctgcctggctactgtccgctccgtgagccccatcgcacgctgaacttcctggctgaccaccgcctcttccctgccctgcaaagcgtggtcagccaggctgtggataagctccgtggcgcccactgccgcgacggccgtcctctgttccccaccagcttggagcccacctcagatctgccgcctctgggctctgagccagctaaacccaccaatggcgggcagccctatgcttccccccgccccacagtctccagccccaagatgcttcagagaaaacgcaaggacagaggaggctccccctccatgtctagtgcccaggtggccaccagattcaaactcaagagcccctgcagcagcagcaggttcacgaagaagaagccgctgccctccatctcgtcgaagtccagcatgtctcacttctccaaccgcctttatgaggagctcgccgacttcctgacccagcaggcagcctccttggtcatccgcaagtacgagttcgaaaaggacctcagtaagcagctgggcttcttctccttccccatcacccacgtgctcagggacctttccctgggcttaaagaaggtaaaaggctcccgcatccacctgtcctcggagacccaccggagctgcctgctgcgtaaactggaggagtccaaaagggccgctgcggtgagccttgaagcctagggcgcgggcccgggtggagccgccgcaggtgcagatcttggtggtagtagcaaatattcaaacgagaactttgaaggccgaagtggagaagggttccatgtgaacagcagttgaacatgggtcagtcggtcctgagagatgggcgagcgccgttccgaagggacgggcgatggcctccgttgccctcggccgatcgaaagggagtcgggttcagatccccgaatccggagtggcggagatgggcgccgcgaggcgtccagtgcggtaacgcgaccgatcccggagaagccggcgggagcccctctgtgcagcaggaaccagccacccacactgcccaggaccaggccacagagccctgccgctccctctacaccaacttgccagccagccggcagctcagccctttggagcccaagctctacatgtctgcctgcaccggcatgggttccagtccccccaagtccaaggacatggacaatgagggccgtgataaagccgagattgaagatgaagatgaggatgagttcaaggatgaagaccaggatgaggacaaggatgaggatggagtctagagcctcccagagcctggagaggaggcctcggtcagccactccgtggacgtgggccacggtgacccaccatgaagtccccactagccactcgattccctgctctgtcagagttgctgcacatcacaccagcccctgccaagagcaggagtcaccacaggctgaatgcccacgaggagctctgctgagactctcaagggagccagtgaaagaaatagaaataaagcctgtgttgctgggacac

SEQ ID NO: 1605 - DNA, 2042 bp, Homo sapiens
agagctgcttgcttaaaagactctggcctccctcttgctccctctctggccatgtgacatgcctgctccccctccaccttccaccatgagtggaagcttctcaaggcctcaccagaagaagatgttggtgccatgcttgtatagcctgcagaactagataggatttcaccatgttgcccaggctggtctcgaactcctgggctcaagcgatctgcccacctaggcctcccaaagtactgggattacaggcgttcactgcccggctgagaaggaggttcttccgcgagagaaggctatgcagaggggaggatctcaggcctgaagggtctagaagcccactggaaggtcttccagacacttgggacatctagctcctgaagagtagaaagaggagctgctgccgaagaggtaagacagagagaggggcacaggatgtggagtccgcccctctgtcctcagggagtttctttggagagagaagagaatgaggctgggctcagaggaagttcctcccactccgtggagctcaaactagtccagtggtggcagctgccctggctggaataaagcatcgacccacagtggcctcacatctctgaggcctttgcaggttaagagcctcctgccatgataccccaccacagtggaacccgttgttgggccagcgtgttctcagggactgggacacgggccaaatactacagccaccaaggccatagcctgtgctctctctgagccgagggaagaacaccctctccggccctgtagttccatttttgtttctttgtttcatttcctctgctgtcttctccagagctctgcgctgcagctgagagactgggtatctcctagagattcctgacccccacgcaccagccccaccaccagagggcgcccgagcacagagacgccgcaaccggagcaggagccctaaacctgtcagggtgggtcagccctggagtaatcctggagggagggtctgggagagggccccagtgtggggacctgcccggctcaaccaaatgtagtttgttaccttggtggccatctgcagccaggtggccctgccacactgctaaaccagaggatttaggaagcagacagggattcgggaagtggctgaagagcactggaaagacaaactcctgcggtgcaagagtcctggaccaggagtgcggagaactgggggcgctcctctccctgttaccctaggcttgttttctcatatgtaaacaaaggcaggggcggggagaagggaaggactcgatggtacccaggtgcccttcaggctctaaccaaagacatgccccaccctcctggaggaaccctgcggggcgcagagaacggctggagacatagcggccgcggtttcccccgcagcgcaggagcgccaggcactgcgctgagtcaactgcggtcagggagtcacctgcccgcgacagcgagcgcgcacccacactctcgaccaacccaggctggcctccagcccactctcgggtcccaacgcccaaacatctcgcattgctggctccgacatctccccacccgccgccaggaatcagcgcagagggagatgcgtcttctgtggcgggtgcggggcgaggaccctgaccccagctctgggaagtgaactgtacggaggagagagctctccatcgtcagctctgcctccgcccctcctgcggcttcacttcagcccggatgccggcgatggggaatagaccagggacgcaggagcacactggaccgggggtggatccacttggggaggcaggcaaccgacccgcgcaccggtggcgcaacctcgttccggtgaccgaagcttgtggaggtagctccactcccggctccctggtccgacatccccctgccacctcctcccccacctccccgagtcttgggagcctggaccccgaaggtgcaaaaagtcaagagcctggaaaactgcactgtgcaaatatattgactttatttgtctcctttcaggagcctcacagacatatccaggtaaaaagatcgttaaataaatgccttcagccatc

SEQ ID NO: 1606 - DNA, 1607 bp, Homo sapiens
tcctcggagtgtgtggcgccatgatgcagggaagatggcttcgtttcggaagctaacgctttctgaaaaagtgccgccaaatcatcccagtcggaaaaaggttaacttcctagatatgtctctagacgacattataatctataaagagttagaagggacaaatgctgaagaagaaaagaataaaagacagaaccatagtaaaaaggaatcgccttcaagacagcaatcaaaagctcatagacatcgccatcggagaggagaagtgcagtgacaattatgaggcccaagcagagaagaatcaaggccagtcagaggggaaccagcatcaatcagaaggaaatccggacaaatcagaagaatcccagggccaaccagaagaaaatcatcattctgagcgatcccgaaaccacttagagagatctctttctcagtcagacagatctcaagggcagctaaagagacatcatccccaatatgagagatctcatggccaatacaagagatctcatggtcagtctgagagatctcatggccactcagagagatctcatggtcactcagagagatctcatggtcactcagagagatctcatggtcactcaaagagatctcgtagccagggagatcttgtggacactcagagtgatctcatagccactcagagagatctcatagccactcagaaagatctcatagccactcagagagatctcatagccactcagagagatctcatagtcactcagagagatctcgtggccactgagagagatctcataaatcagtcagggagatctcatggccaatcagaaagacatcagagatactcaacaggtaaaaatacaataactacttaatcatcagaacaatgtgttgaattctgtggaaatagaaaagcatatatctatattctaatggctaaatatgtatttgttgaaacatgtatattgggacaaagacataaatattagaatggaggtaatacatacatagtatcaatattgtttcaacttgatgtcctctaagctatcatccagttacccaggatgtcccattaagttgttcccggtaggtctgctttccctggaagagccgtatgtactcagcctttcctattgggccttccccacaattagaatattttgacttagtgtcctgtcccccttggacgttccaacttgacttagtgtccagtgccccttggacattccaacctggtaggtaagctaatctaacaactaactgccaaattgataatatataatctatgataatgaatatctcttttgtgtctccttcctaagccatcctcagagagtccttagcagacaaatggtagatgtatctttgggcagctgaacttttctgctttcctcaaatcagaccatatgagaggatatattctatgcatagatgtaatgctaaccttctgaatatattttgaatacatttatatattcactgttgccttataaaactgttagggtaggtctgtctaccctagcaaaagaaacacagaaatttaaatgtactgggagttatgttgttaaaaacacaagatatgttaactgcagtttgtttggttattcaataaaagttttagtttt

SEQ ID NO: 1607 - DNA, 2635 bp, Homo sapiens
atcacttctgctcacaactgcccagtcccagccagtcacatggccccatctggctacagagggtcaggatgtacaatcctgccatgtgcccagcatatggtgaacagcataatgacttccatactcatgtatctaaacggtccaggagaaacgtggtttcaggcatggctggatccgggatctcaagagctattaccatctctcagctctgctttcttgtgtgtttcttgctgcccctcccagtaccctccttacagcttagtaatcccagcagaaagagagcatggaccagctagggtacgttccagcagagcaaggtgaaaaagagctgaaagtggcatcagaagcccagagttctggttccagctccgaccactcattcagtgtgtgacctcaggcaggtcaccagcctgagctgtgccttcatttcatctgtcagacggatgactctgcccctcagagcttgcagacggcaaggtgataaggaacaatatggacttcttgcagctcctggaggcagacgctggagggctgggttccgcctcagtcacaggcaatgccctgatcccacaaagccccggagatgctgtggaccaacttgcaacacaagaccctaggagggaggacggctgttgtcatctgttgaccacaaacacgtttactgtgcacacttgtgcacatgggtgagctccgtgagtccagacatgtacagggcaggtgaatgcatggagtaccatgggcattatcccaggcccacaggcacgtgcaatcacacacacacgtggacatgccactgcgcacctaagacacacacacacacacacacatgcatatgcacacacacacatatgcacacacacacacagacactgtaaacatcaggctcaaaggcccatccaggagaccaaaggctgcaggtgtcttcacatcacagcccaggtgaccttgtctctggctcagggcccagtggcctggccagctctggacatccagtcagcctcattagctggcctggggtccagggctcgaaagtggcggaggaatgaccacccactggcggaggtagctccgggggggtccttcgtccccggggctggtgaagtcacactccacagggctgctgcagtcagagcccacaaagccactgtcaaacgtgtccatatccaggccggccaggggtgagcccgcctcactctctgagacccctccaggtgaccggccaccccagggcagtcccccagcccagtcctccccatctgcaaggggtggctttagtctgtccaggaggcttcccaggggccctcctagcccagggctgccagctgagacacagccacaggacaggactgtggtccctgcatccaagagtgggtcctctaggcctgggctgggctccaggccagcatccaggtccagggctgggtagccgtcatcctcacagctgcagggccaggtgcatggcccctctgcatctagcacagtcactgtgtcaatggacaccaggccgtatggccgatccctctcctcactgtaagctgagccccccgagttctgggctgtcggccagaagctgggcttgggcacaccgtcagactccaccagctctgctggttcttgtagctccgtgagctgcagcctcttggccgggctccgtggtgggtggcagctgtacacctccagggtggagggcacctctgggctccagggtcccagctccaggctggagccagtgaagggtgcacccacccatttctgtgagagagaaaaagagagagtcatagcacaggatgagggtaaggtgagggtttatttttcttttacttttattcttttgagacagtctggctctgctgcccaggctggaatgcagtggtgccatctcggttcactgcaacctctgcctcccaggatcaagtgattctcctgcctcagcctcccaagtagctgggactacaggcgcctgtcaccacacctggctaatttttgtatttttagtagagacgtggtttcaccatgttggccagactgatcttgaactcctgacgtcaggtgatccacccgcctcagcctcccaaagtgttgggattacaggcgtgagtcactgtgcccagccaaggtgagggtttaaacagacagaaagacagacacagacacagagacaagacaaagagacatcaagagagacagacagagacatgaagatagacaaagacaccgagagacagagagagagagaggaatcaggaccacaatgtgctcccaccctagtggatccccctcctactctgggcctcagtttccctacttgtagaagggagttgctacccttagtagtgtgaccagtcagacaactggtggccccatagtccaggcagggaccaagattcctgagtcaaggagacatgggggcaggagggcctgaggtctgaggtacccctgagccatctcctgctttcccgcctccttgatgcttcttgaaacctagcactctcctggtttatgtgtccccaccagacagacacttggcccccggacataagtcttgtctcttctgtccatggctgtagccccagtgcctagcacaaagtaggtgctcaataaatgtttattaacgaaaaaaaaaaaaaaaaaaaag

SEQ ID NO: 1608 - DNA, 1809 bp, Homo sapiens
actcaaggaaatcagctcagagaggacgtcaccggtggcagctgcttccttccagagccggcaggaggccagaggctccatcctgcttcagagctgccagctgcccccgcaatggctgagcaccgaagcatggacgggagaatggaagcagccacacgggggggctctcacctccagatcgcctgggcctgtggctccccagaggcccaggcccgacagttccggaccttccaccaccccacctacggcagctgctacacggtcgatggcgtctggacagctcagcgccccggcatcacccacggtgggtgccagcccctggccggtgcgggggcaggggtgcaggtcaggtggcctcacaccagcccttggcctcccaggagtcggcctggtcctcagggttgagcagcagcctcacctccctctgctgtccacgctggccggcatcagggtcatggttcacggccgtaaccacacgcccttcctggggcaccacagcttcagcgtccggccagggacggaggccaccatcagcatccgagaggacgaggtgcaccggctcgggagcccctacggccactgcaccgccggcggggaaggcgtggaggtggagctgctacacaacacctcctacaccaggcaggcctgcctggtgtcctgcttccagcagctgatggtggagacctgctcctgtggctactacctccaccctctgccggcgggggctgagtactgcagctctgcccggcaccctgcctggggacactgcttctaccgcctctaccaggacctggagacccaccggctcccctgtacctcccgctgccccaggccctgcagggagtctgcattcaagctctccactgggacctccaggtggccttccgccaagtcagctggatggactctggccacgctaggtgaacaggggctgccgcatcagagccacagacagaggagcagcctggccaaaatcaacatcgtctaccaggagctcaactaccgctcagtggaggaggcgcccgtgtactcggtgccgcagctgctctcggccatgggcagcctctgcagcctgtggtttggggcctccgtcctctccctcctggagctcctggagctgctgctcgatgcttctgccctcaccctggtgctaggcggccgccggctccgcagggcgtggttctcctggcccagagccagccctgcctcaggggcgtccagcatcaagccagaggccagtcagatgcccccgcctgcaggcggcacgtcagatgacccggagcccagcgggcctcatctcccacgggtgatgcttccaggggttctggcgggagtctcagccgaagagagctgggctgggccccagccccttgagactctggacacctgaaccagacctgccagggctgtgcgatctcttggcctggtccttgcagctgtggcagcagcaggctccccagcggcccagggtgggccagaccagcagcccaggaagcagcacacgcggccgtggggaggcaggcaccgggcatgtcggcgcctctggtcaaaccacctacactgcctggggtgggtctcaaggaggcccggggcggaggggggttcccgcgtgcacacgagtgcggctggacgtgccgacacgcggtgatgtacccatgctccgtgtgtctgtgtctgcatgtccacacgtctgatgcacctgtgtacgtgtgtcaagcctagccacctcagctgcagggaggcagaaggcaaggcaggccccacggacacacttgggctgctctgaaataaagctgttgactccacctg

SEQ ID NO: 1609 - DNA, 1927 bp, Homo sapiens
agttgctagaaagcaatgcgcctattcacatggagaatcttccctttcctctaaaattacttagtgcctcatcactaaacacccccagctccacaccatgggtgttggatatcttcctcaccttggtgtttgccctggggctcttcttcctattactcctctacttctcttacctccgttgtgacaacccaccctcaccatcgcctaggaagagaaagaagacaaaaacattgtgtgggaaagctggagttgaggacgaacgagattctgaaaataaaaatccctggtacataagccaaaatttcagagtcaactacagattttcaaaggctatgaaataggtaacctcaagccaccgactccaatagataaaaggaaccagttccacctttccaaatccagtggagacttctgcgatgggaagtctcaggagagaccagaacagcatgcttccagggagaggcagggcagccaggggctgcagtgaaatgaagcgataccggctcagtgccacctttgcttccagagttcaagctattctcctgtcttagcgtcctgagtagctggggattacaggcgcccgccaccacgcctgggtaattttcgtatttttagtagagatggggtttcaccatggccaggctggtctcaaactcttgacctcaggtgatccacctgcctcggcctcccaaagtgcttggattataggcgtgagccaccgcacccgaccccctcttcctgtttttctaagaaaagcagtttatcatccatttaaacatgagtgggaggggagaaagcacacagagctccctgagcaagacagacagagccatgcggttcatgagtgcagcgtgctgcggctgggggcagagagggagagccggtcctagctcctcgccatttcttgtctcccagcgtcatcttgtctcccagcgtcatcttgtctcccagtgtccaacagggcggagggggaggcccagaggcaggatgaaaaaccacagtctgagagcttgtagagagtgcccgagaggcctggaggagacttgggacctgctttcacaactgcagagcctcctggggccacaccttgaaaaaggtgactttggtcagctctctggtccagacccgccaggtgaggtgggcaaaagaacacctgatggagcctcccggtcctcccatgagcctatggaagatgctgctcccattgtctccccgttagcttccccggaccctcgaaccaagcatcctcaggatctggcctccaccccaccaccaggcccaatgaccacctcagtctcctccctaagtgcctcccagccaccagaaccttcccttctcctagaacgcccctcacccgagccacctgcacttttccctcacccaccacacacccctgatcctctggcctgctctccacctcctccgaaaggcttcactcctcctcccctgcgggactccactctgttaacaccatctcactgtgactcagtggcacttccactggacaccgtccctcaaagcttgtctccacgtgaggatttggcggcttctgccccagccatctcaggccttggcggctcaaacagtcaagtttctgccctctcctggtcgcaggagactaccaaaacctggtgcatcttcaactcgtcagtccagcaagatcatctttcccgccaaagggacaccacaatgtccccactgcttttccaggcccagcccctgtcccatctggggcctgagtcccaaccctttatttcatccacaccccaattccggcccacacctatggctcaggccgaggctcaggcccatcttcaatcctctttcccagtcctatctcctgcttttctatccccgatgaagaacactggagtagcttgccctgcgtcgcagaataaagtgcaagctctctccttacctgaaactc

SEQ ID NO: 1610 - DNA, 1732 bp, Homo sapiens
aaagagctggctgtaatcccgcctcccgccagccatggcccacttgcgctcgcctagcggcttcggagacccggggaagaaggaccagaaggagtcagagcaggagttggaggcccctgagacgttcagcgaagagtacctctggaaggtcacggacatcggtgactacgacgatgacttcccagacgtgcgcccccgcttagccagcatcgtcagccctagcctgacctctacgttcgtgcccagccagagcgcgaccagcactgaaacgccgagcgcaagcccaccctccagcacctcctcgcataaaagtttccctaaaatatttcagacatttaggaaagacatgtctgaaatgagtatagatagaaatattcatcgcaatttgtctccaggaattccagtatcagtacaaacagaagaaagttggctccaagatttgtctgataaagtgcaatcgaggaagaaagcctctaaagagaaagctgaacctgaatgtctggcatctaagttaagagaaaaatgggtaattaatccagaagagtcgaaactaaatattttatatgagctggagtttaaggaagacttcataacactgttcgagccttctctaagaacgttacccagcatcggaccaccatccattctggcatacaaagaagagagctccaatttaggcattaacttcaaggatgaagaggaggagacatcacccaaatgtgaattttgtggcagcgatctaagagcatttttttctaatgtggatgtttcctctgaaccaaaagggcatgcctcctgttgtattgctttccaaaatctgattgactatatctatgaggagcaaataaaaaccaaaccccctaaagctgaattaattgctattgaccctcatgcagcccatggtagtgaggtcgacagactcaaggcaaaagaaaaagccctgcaaaggaaacaggagcaacgaatggccagacattttgcaataatatcaagggaacagactcatttctctgaagatgattcaaagcgcttaaaaacaatttcttatcaactttctgtggatattccagaaaaacagataattgatgacattgtatttgattttcaactaagaaacagtaacatgtctatcatttgttgtgattctcggatagcatgtggaaaggttgtcaggaatgagctcttagagaagcactacaaacatgggagcaagtttctgacttcatttccagatgggacaacacaaatattctatccatctggaaacctagccatcattcgagtgcccaacaaggtaaatggttttacttgtatagtccaagaagatatgcccactaaccctgctatcctagcagtgctggattcctctggcagaagttcctgctatcatcccaatggaaatgtctgggtatacatcaatatcttgggaggtcaatattcagatcaagccggcaacagaataagggcttggaattggtcaaattccatcacttcctcaccctttgtttcatttaaacctgtctttctggctttgaaccgttatattggagtccgcatcttagaacaagacaagatttctataacttttctagcaatgggccaacaggcaagaatcagtgttggaaccaaagtgaagctaccaaaccctgaggagattccaatcctccgatacgtaagtggagatgaccttcttctgctggccagtttaataaagatccgtcgcctgtttcat

SEQ ID NO: 1611 - DNA, 2306 bp, Homo sapiens
acggcccaatccatagattgtaggccccaacacccaggccgcgcattgggctgatgtataatatgcttttggcagagcttctataaggactcattatcaatttacatttagccaggaaagcatgaaaataagtacttcatgtaaagccattgtgcacatatttgttgctttaaaaaaaaaaaaagattcaattcattaggaaaagccagttctggccaaatattttgaatggcagccattgctatttttcatgttctccccttttgctttctctgtttccctggtttaaagtgtgcactctaataatttagaagatggcagaagcattcaagagcaggaccttctgagcagggcgaggctttgagttcggggcagttttcatggtagcatctgcctgtgctgaagcagaaaacagcatctgggacccccatgacttgggcactcttaggacagcccgcagatggttgcgtggggttcaggggcccttcccgcctggctcctcttgtctgcatcctgccctgtcagtgtggacctaggttcacactctgaggccctgcaaaacatgtcacctgtgggcacctccagttttccagtgcccggtccgcagctcgtctcggcagctgcatccttagggccattcccaaaacctcgggtcacggcgggggcctagggggacagcaaggcctttgccccttaagcctgatgaaaatttgtaggagagacttcagtgtccttatgaatttcagtgaagccgagtgggattaaggtgaaagacagaagctctaagtgctttcttcagggagataaagcgctggcgagtgcatcatttaaaccgaagatggagtgagcgccaacaggcactggtggttgttgctgttctaatgggattgcttcgtagatggcccttcatggcggaacacgcgtgtgtcagtggggttcgggctgcgggtggcggctgagtgtccctgtgtgtctcttacaggaacagtgtgtggtggatgcggctctggagtacgttcccggcgctcaccagtttggtctcacacaaaacagccatttcatcttgccttttaatcagtcggctgtcagaaagaagctctcggttgagctaagcatccgcacgttcgcctccagcggcctgatttactacatggctcatcagaaccaagcagactacgctgtgctccagctgcacgggggccgcctccacttcatgtttgaccttggcaaaggcagaacaaaggtctctcaccctgcactgctcagtgatggcaagtggcacacggtcaagacagactatgttaaaagaaaaggcttcataactgtcgacggccgagagtctcccatggtgactgtggtgggagatggaaccatgctggatgtggagggtttgttctacctaggaggcctgccctcccagtaccaggccaggaaaattggaaatatcacccacagcatccctgcctgcattggggatgtgacggttaacagcaaacagctggacaaggacagcctggtgtctgccttcacggtgaacaggtgctacgcagtggcccaggaaggaacatactttgacggaagcggatatgcagctcttgtcaaagagggctacaaagtccagtcagatgtgaacatcacactggagtttcgaacctcctcgcagaatggcgtcctcctggggatcagcactgccaaagtggatgccattggactagagcttgtggacggcaaggtcttgttccatgtcaacaatggtgctggcaggataatagctgcatatgagcccaaaaccgccactgtgctctgtgatggaaaatggcacactcttcaagctaacaaaagcaaacaccgtatcactctgattgttgacgggaacgcagttggcgctgaaagtccacacacccagtctacctcagtggacaccaacaatcccatttatgttggtggctatcctgctggtgtgaagcaaaaatgcctgcgcagccagacctcgttccgcgggtgtttgaggaagctagctctgattaagagcccgcaggtgcagtcctttgacttcagcagagcgttcgaactgcacggagttttccttcattcctgtcctgggaccgagtcctgaacttcaagcagaatcctcagttggaatcattgctaatattttgaggagaagtgtatgtgtgaattaagaatctcttcagttcatatttcatttccaactcaggttaagtgtttctggggagagatgttgtgtttacgttacactaaaaccacatgtgcaacaaatacctccattaaatggtctaaaatgt

SEQ ID NO: 1612 - DNA, 1799 bp, Homo sapiens
taggaacagccaagtgtatggggctgtggctgagcggctcagggaatatggcttcctccggaccctggaacagtgtcggaccaagttcaaaggtctccagaagagctatcggaaagtcaagagcggccacccacctgagacctgccccttctttgaagagatggaagccctgatgagtgctcaggtcattgccctgcccagtaatggcctggaagcagcagcctctcactctggcctggtaggcagcgatgctgagactgaagagccagggcagaggggctggcagcatgaggagggagcagaagaggctgtggctcaggagtctgacagtgatgacatggatctagaggcgaccccccaggaccccaactcagctgcacctgttgtgttcagaagcccaggtggtgtacactggggctatgaagagaccaagacttaccttgcaattcttagtgagacccagttttatgaagccctccggaactgtcaccgcaacagccagctgtatggagcagtggctgagaggttatgggaatatggctttcttaggaccccagaacagtgtcggaccaagtttaaaagcctgcaaaccagctatcgggaagttaagaatggccaggcaccagagacctgtcccttctttgaagagatggatgctttggtgagtgtccgggttgctgccccacccaatgatggccaggaagagactgcttcttgccccgtccaggggaccagtgaggctgaagctcagaagcaagctgaggaagcagacgaggccacagaggaagattctgatgatgatgaagaggatactgagatacccccaggggctgtcataacccgtgctccagtgttattccaaagcccccgtggttttgaagctggatttgagaatgaagataattcaaaacgggatatttctgagaaagtacaactgcataggacattacttgcaagatctgagaggaaaattccccggtatcttcatcagggtaaaggcaatgagagtgactgtagatcaggaagacagtgggcaaagacctcaggggagaaaagaggaaaactgacactcccggagaagagcttaagtgaagtcctaagtcaacagagaccttgcttgggagagaaaccctataaatatctcaaatacagcaaaagctttggtccaaactcccttctcatgcatcaggtatcccaccaggtggaaaatccatataaatgtgctgattgtgggaaaagcttcagtcggagtgcacgactcattagacaccggagaatccacactggagagaaaccttataaatgtcttgactgtggaaaaagtttccgtgacagttcaaatttcatcacccataggagaatccacacaggagagaaaccttatcaatgtggtgagtgtgggaaatgcttcaatcagagctcaagccttatcattcaccagagaacccacacaggagaaaagccctatcaatgtgaagagtgtggaaaaagcttcaataacagttctcattttagtgcacatcggaggatacacacaggagagagaccccatgtgtgtcctgactgtggaaagagtttcagtaagagttctgacttacgtgcacatcatagaacccacacaggagagaaaccctatgggtgtcatgactgtggtaagtgcttcagtaaaagctctgcccttaataagcacggagaaatccatgcacgggaaaagcttctgacacagtcagctcccaagtaagcccctgaggatatataacggaaagaggctcaataaatgtattgtttagaaagtcttc

SEQ ID NO: 1613 - DNA, 1844 bp, Homo sapiens
aaaaagcggaaggggcgcgcggatagagctcccagtgtgccaagcgtgggcggtatacagtaaacaaagacaacccctattcttatcaccttgcctactgagtgcaagtccaggaactgtgtaagcagaccctcagaggagctctgggaaacactgaaaaatagcctctccccccattggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttccagtctgattccaggaatgcctcaacaggttcctccttcagagtctgctggccagattgaccagaacttcaaaatgccacaagaaataaattacaaggaggcttttcagcatgaagttgctcatgaaatgcctcctggctccaaatctcctttttaggttacagaaggtagatgcttctgatttacttctctcaaagctagaagccaagaaaatggccagctagaaccaagatttaaggggctgtaaaaggcaagttcagggactctccagcctactccttttctgaaaaacccttaatcatgtgaacatttgaactagttataggataaaataaactcagaataaggatttaaaataagtaaccaagtggctgtgactttttcctcttgttttatcaacgttttggagactacacaatgaaaacacatctgttggggtgatcagacccaacacccggccatgggggctacaaagtccagccgagtcaaaggaaagagaaaagacaagtcaagagagaaagtgggaccagggggccaatgctagtatggaggctgtgaagtccccaagctctggaagcccacactatttgttggtgatcaaacaaagaaacaggtgatgaggatgtgggagttgaaagaaagtggtgtatcaagcgaatgaactacagctgtgagggtttagcattttctttgaaacatatggctacttgagataatgggagtgctagaagcaaggagccagcaagtctggacacattacaaaggccacaaggggttttatcctggaccccggacatgttccaagccctgcctcaacttttctcccaacactaagctttcctcccaacacacatccatctcgtgtgttcatgtcttaacttttgcttcacttcacagtcaggcctctccgagtattttttacacatatcctggagtctacctatgtcactgatagcagatatttttcttcaacatatattatcaatgttttaatacttttcttcaattttagtaactggtaaaatacatgtaagatgtaccatcttaaccatttttaagtgtacagatcagttgtattaagtagattcatattcttgtgcaaccatcatcaccatccggctgcaaaactctttcatcttgcaaaactgaaactctacacccattaaaaaataactcgccatttctctctctccccagcccctggcaaccaccattctttctgtctctgtgatttagattactctgtaagtatgttgtataaatagactcatacaatgtt

SEQ ID NO: 1614 - DNA, 2259 bp, Homo sapiens
aaaaaagtcacactggcctttgttcctcactcatctgtgctggccctcagccgaggggctgttggggaactctctgcaggcacagggcacctggtgactgggaagcttctgtttgtgtggacttcttgggaacagcgtcctggtgtgggccaggaggagaggactggagcaccccaggctctgacttcgtgctcctgggatcgtggtgcattgcctggccatggtggtcacccagctgaatctggagttttgctttcagggcaagaagctgcgaggcttcagctgtgagcttacccggtccccacatggggtcttgcctgaatctttcttcaccatcatgtgccaggtcgtggtgcccattctgctgtccggcttgtgcatgatgacggccggcctggtgatgaacaccattcaacactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctggcagaagtgatggttcggctgacttggcaccaggccctggatcctgacaaccactgcatcccctaccttacagggctgggggacctgctcggtactagcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgt

SEQ ID NO: 1615 - DNA, 1618 bp, Homo sapiens
gaggcccgagccaggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagccctgaatccacaccacagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaaggaggtgcttttaatgtgctgataaaccaacctcaggaaggtattatgtacagaagattcccaaggctgctgttgctgaaagagacttgggctactgccagggaactagggtctcactctgtcacccaggttggagtgcagcaggggcatgatcagctcactgaaggatcatttcttggtctaggctataggctggccttagaatcaactcacctggtgtcctattgtcagggacatcttaaccagggtgactgcacctcgaataaaggccagataaagccaaacttgctgggttacattccttgggggttagacacccttcatcacaagatgtttgtagctcaaagaaggggttaatgatgctaactagagacccagaacgtctgaaaacgtcctgatatttaaagaacaaagcatccttcatttgagaataagtttcactttaaagaccccctcaatatcctcctcagatttgccctgcacttcttgttccatgcttggggtcctaagaacaagccatctgatgcctctactatcattacctctattgggacccagaaaccaataccccaaaatatggtgcatggacatgctgaactgaagaagatgcctcaagggtcatccctaaaggcaaaaacagaacttccaaagtatctttctgtgacaacattaggttcaggcttgaagtccctgatttcgccatcaaagtcagatccaggggggacgatgctattcagaaacgtgctgagaagaggactgcaatgactgctttcaaaaaacaccagaataaatacatacgtagtgtaagcaagcg

SEQ ID NO: 1616 - DNA, 2479 bp, Homo sapiens
atagagctgcggctcgggcggcgcctccctgcggcggcccggcccggctccggcccccgctggggcaatgctccccggggccgcgggatgagccaggtgagcgcggagacccccagcactccctgcctgtgactcggccggtccgggcatggcagacccagtggcgggcatcgcgggttcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgccctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctcc

SEQ ID NO: 1617 - DNA, 1809 bp, Homo sapiens
cggagttgagatcaaacagacttttcattcctggttggtgcctgggagagtgacgaggcctatcagtactggaggacacagtcaagtgtttggtggaagaacagcccacattaagagctttggaaagactttcgtaagacaccaactcacctcccacggagtccacgggcctggtggggaggcttactactggctaagaaaggagagacagcttcatgagcgggcagtgcagaatgggccagcagggctgcaggtgccgtgggatctcaaggaagctgggagctgagctgagtggctctaaaatgtcttgatgcccttagaagagagaagatcttctggagagaggaatgatgcagcccccacaaatcacagaaggcctggggagaaaaggacgagcacagcaaagcaggtcagctcggtgcccttccttggagctgccggccaccagcagagcctaccctcttcatggaaagcctcgtgcagtggccccctggtgatggcatccgacagtgatgtgaagatgctgctgaacttcgtgaacctggcgtccagcgacatcaaggcagccctggataagtccgcaccctgccgccgctccgtggaccatcgcaagtacctgcagaagcagctcaagcgcttctcccagaagtattcccggctcccgcggggccttcctggcagagctgctgagccctacctgaaaagggggtctgaggaccggcccaggaggctgctcctggatttgggccctgattccagccccggcgggggtgggggctgcaaggagaaggtgctgaggagcccctacagggaggaatgtcttgctaaggagcagctcccacagaggcagcatccagaagctgcccagcctggccaggtgcccatgaggaaaagacagctgcccgcttccttctgggaagagccaaggcccacccacagctaccatgtggggctggaggggggactgggccccagggagggacctccctatgagggtaagaaaaattgcaagggcttggagcccctgggacctgagactaccctggtgtccatgtctccaagggccctggctgaaaaggagccgctcaagatgcctggggtctccttggtgggccgcgtcaatgcctggagttgctgccccttccagtaccatggacagcccatctatccgggccccctgggggcactgcctcagagtcctgtccccagcctgggcctttggaggaagagcccagcctttcccggggagctggcgcacctctgcaaggatgtggacggcctggggcagaaggtgtgcaggcccgtggtgctgaaacccatccccaccaagccagccgtgcccccacccatcttcaatgtctttggctacctctagccacgcggagagggcctcagcccccacctctggcctgcaggagtgtcgaggtccccgaggcgctctcctgtgaggaggtggctgggccacagtgtggcctcttccgtttgtgtgcgcatgggagtggagggcaggattggggcagggctcctcaggcagtgacccttcagccttgcagccttggaagctgggaggctggacctggttggcccctccccaggcaggccagggcccagcagcttgtcccgctgtccctgtgcagaccataggtactgggatgttgcccttccttgccttgcagtcaccccagaagccagagagacgcatctgtttacctgccacccactctgcgagccaatctcagttgttgttcttgttcttcttgttctttgtaaatattgagaaagttaaaagaataaagacatttcttttgg

SEQ ID NO: 1618 - DNA, 1825 bp, Homo sapiens
gaatggcgctggcccgcggcgctgcgctggcagggagcaggcgggaggcccgaggaagggagcctgctgcccgcccacccgcctgcacaggctgtgtaagggggctgggcacgcatatcccgccaacaactgcagctcccaccagcctgccaggccaggctcctggacactcccttcccgccttcctcctcccacctccctcctccctccacagtcctccagcttcggatccacagacggaatcaggagcagaatccagttcaggcgcccatctcccagcaatcaagtcttgctccctggcctgccctccggcaccctggagccccgcttcccacacagccttgctcctcccggcctggcttgctgcctgcaggcctctcagggtccttcaccgtctctccagtctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcagacccccaagccgaggggtccgccctgggtcctcctgggccatctctgtgggaagggacagactcgcagcagccacatcctaggatgaagccctctcccctcactccctgcccaccaggagtccctagcccctcgccacccccacacaagttggaacttcagacccttaaactggaggagctgacggtctcagagctccggcagcagctgcgcctgcggggcctcccagtgtcggggaccaagtctatgctcctggagcgcatgcgcggcggcgcgccgccccgcgagcggccgaagccgcggcgcgaggacagtcccgcgggtgctccctggccgcgcctcaagcccaaggccctggcagccgcccggcgtcagggctcggtcaagcccagcgcagcatctcacaggccacctcttccacgcgccgcggataccccggggacggctccggctccaactcccactccggctcctgctgcagctccagccctgaccccttcctcagggccgggctcagcggctctgactctggaggaggagctgcaggaagcgatccggagggcgcagttgcttcctaaccggggcatcgatgacatcctggaggatcaggtggagcctgatgaccccctgccccctattcccctggacttccctggctccttcgacgtgctgtccccctccccggactctgaaggcctctcatctgttttctcctcttcactcccgtctcccacgaactcctcctccccttctcccagggaccccacggactccctggactggctggaggccctgagcgggggtcctcctctgggttctggtcccccaccccccagcattttttccgctgacttatctgactccagcagcagccggctgtgggacctgctggaggatccatggtgatggattttaggatttacagagacagagaactgatgggggtggagagaagctccttgtgggaggagagggaactaccagcagagcccctcctaccgcagacacaggatcggagacaacctccaaccccacctgcctcctgaagtgctgctgacatgcaactgccttaactttgcctacctggcctccttatgatccccctccggcgtggtatggttggggggcttcttttgctgctggccacggcaaacaagctgcttgctgcttccttcag

SEQ ID NO: 1619 - DNA, 2381 bp, Homo sapiens
aaagtctgtatactttttggttgggcagatctccaccggccctcaatctgattggccctcgagctgtggatgtgctgtctgagttgtcctatgcccctatgactccagaccacttcccaagcctcttttgcaagtggcaaccacagctgagtgaaacaaactgtaaccgaatgaaagcaatgacaacggaatcctccccaggaagctgctgattagagagggccaaacggacagacatcttggccacctgtaacgagcaacttccaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcaaccctgaggggcagctcgtgcctgcagcccggcagctcgttctcctgttctgctgtgctgtgggctggcactcgatacctctggcaagaggatgatcatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatgtcatggactgttgtccagcctcaatgcttcattttccccttgcatatcaactgccctaatctgactttttttaagtgcaaataaactgctataagac

SEQ ID NO: 1620 - DNA, 1887 bp, Homo sapiens
ttttgtggatcttagtaggcgagtttgaaaacacggagtccaggaatgaggatcgaccgtgtgtccacctttcctggcttccctgccacactgtttgcacagcactcgtagccagcacacgcgtgtgcacatccacacaggtgctcacacaggtgcccacgcacgtgcctgcaggcctgctttgcatgctgctttctgcgtgtccctggcgcctggcacggcgagtcccttggtgcattccgtcgggacaaggagtgtggctgcgtggtccttggaacagaaaagcctcggtgttgcagagaggaccttgaggatcacccaggagttccctcgccgttggctgcctgccatggttccagcgggactcagtcaagggctgtgcttttagggaaggttccacacacacacgagcagggagatgcagcatgcctcacagcgtccccacccggacctggccgtccccaggtcccaacccctcggggtgcggagctttcagggagcagcagctctgtggctagaggagaagcgtgggtggcctccagggacggggtcatgtggccggcatcttcaggtgtgtcctgctgccaccggcagccagcagcagcccaggggcctccgggtcccggtcgttttccagttttggggtgggagggccgggcccagcgcatcacctgtgcactcgccctgtttgcactgtggcagctgacacgggccaggccggcgggaacgggctaggcaggacctgggcactctgaggctctgccccatccctgcaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggcctcttcaacctgcgccagatcgtcctcgccaaggtggaccaggccctgcacacgcagacggacgcagaccccgccgaggagtatgcgcggctctgccaggagatcctcggggtcccggccacgccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaagtttcctcactatgaagtgcggccgttacgccatgtgagcctgtgcctcccgctgacttggtgtgacccaggctcgggacagccgccagagtccctcacaaggaacaggtggctaccagctttgagggccggccctgccctgcctgggtgcaacattgcactgggcagcctgcaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtctggcctgcgctcccgccgccctggtgccttagcccccggcacaggatggggcaggctctggcacagtgcctgggactggcagggtggctgagcggctgtcttgcctcttgtcattgtctgtccccacccggtcgtggcccacccggctagagacggcgtcctcaaggcatctggagggctttcgtggctgccagggcctggtctttgttgcactaacacgtctcctctctgggaaacgtcccttgtcaggagacggctcttctttgaaatgaggtcattaaaaggaaacagaaaaag

SEQ ID NO: 1621 - DNA, 1811 bp, Homo sapiens
tgtctctcaaatcataactgtcactgtccaaactggacttgatcaataccagcaggtacctgttgagattgtcaaacctgactttcacaaaccatttcttggtggattcagacataaagtaacaggagtagagtatcacaatgctggaacacaaactgtacctaaaaggattcccgaaagactcagtatattttgtagggatacgcagacagtttttcagaaaaaaaatctccaacaaactacaaatacaacatccacacagatgactaacattggtgtatatgtatcaaatatgactgataaactggtaacaccaggaaagtatttttcagcagcagaataccatgctcaaagactaaaggcggtgatagtgatacagacttactacaggcaatggcatgctaaaatcttcgtagagaatttaagaagacagaaaagcttaagactggaatgggaaacacagcaagaactaaggaagataagagaaaaagaagaatggataaaattggactatcaccggaggcataatcctaaaacaaatgaagattttgaatttctttataatgcattagaattctggcggcaagaagaacttacacgtattaaccagtcttttactggagctgaaaggaaagctgctctgtgtgaacttctggaaaaagagactcagataattgcttccattgggagacatagatacattgcttatatggcaaatcaggaagcagcaatacaagcttttttggataagtgttcagctccaaaaatatggagaacccctaatggcaaaacaattgagatggatacgcagttcaccatcagagccagagagctgcaaaatatctataagtgcattatgctgaaaaatatctcccaagatgagaggctggatgtgctgttaactcttaaacacactgtaaaggaacatgaatgtaaactaactcaggaaattctagaattgattgacagagaggttgaccttatgatgagaggagtcaaacatcataaccttgaaggactcagaaaaagaattgcgacactcttttttcattatatcaaaacacctctgtttaatcctgaagttgcaaaataccttaaggtccctcaagacccattgaaattttataagaagatttacttttgccacagttgccagctttatttgccttctacagaattttctgtatcatccacctcacgccgcatataccggtgtcgtaactgcattaaccttcagaatgaggctcaaaaacgagaatcatttttgaagtacaaatgtttacttcaacagctctactatacagaagctgattatgaagatgattctaaaattgctttcttgatgcagctacaagacattcagtacctgacagagaacatctgggcgtcccagtcagtcctcagtgcttgcgacaatctcagtgatctggtcatggtcagatggaataaatccctggagtggtccccctggaactgcattcttcttaccaaagatgaagcggctgctcatctcaagctaacaagtattgaagagggatatgaacgctcatttattcacaagatcaaacacaaacatatcctggctaagaactatttttctcaggttccagtgctggcttcatttatacttgatgatggtgaaattgatgagatcagatggaagtatcactcagacacaacacctaagattatagaatcccagaggcctcctcattaggtgatccaggagtatttgtttgatgatcggcattttgttcactgctaatagggtaatacagaggtcacagagtatggaaatggaaaaaaaaaag

SEQ ID NO: 1622 - DNA, 1798 bp, Homo sapiens
attcgttttgttttttgtttgttttgagacggagtttcactcttgtcgcccaggctggagtgcgatggcatggtctcggctcactgcaacctccacctcccgggttcaagcgatttttttgcctcagcctccccagtagctgggattacaggcgcctgcgaccacgcccggctaatttttgtatttttagtagagatggggttttaccatgttggccaagctggtcccgaactcctgacaccagttcagctgggtctcagaccccattgctcgtgacgagatctgcccatctcagtctcccagagtgctgggattacaggcgtgagcagccgtgcctggctgcaacctgacattgattagtgaaatggggccctggcctagccatggggacgtcccttactttgtaaccctgaaactgcccagtgtccccccaaaatcacacattccgtgggtacatgatccataaatggacactgcgtaaaagtggaccatggagcaccccctgctggcccctccctccagtctggctggggtgtggtgagatgtgcttgtgtgtccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgac

SEQ ID NO: 1623 - DNA, 2206 bp, Homo sapiens
ccaaagccaacaaaaattaaaaagaaaggtgtaaagaagacattccagtgtgagctttgcagttacacgtgtccacggcgttcaaatttggatcgtcacatgaaaagccacactgatgagagaccacacaagtgccatctctgtggcagggcattcagaacagtcaccctcctgaggaatcaccttaacacacacacaggtactcgtcctcacaagtgcccagactgcgacatggcctttgtgaccagtggagaattggttcggcatcgtcgttacaaacacacccacgagaagccttacgcctgcagccactgcgataagaccttccgccagaagcagcttctcgacatgcacttcaagcgctatcacgaccccaacttcgtccctgcggcttttgtctgttctaagtgtgggaaaacatttacacgtcgggataccatggcaagacatgctgataattgtgctggcccagatggcgtagagggggaaaatggaggagaaacgaagaagagtaaacgtggaagaaagagaaagatgcgctctaagaaagaagattcctctgacagtgaaaatgctgaaccagatctggacgacaatgaggatgaggaggagcctgccgtagaaattgaacctgagccagagcctcagcctgtgaccccagccccaccacccgccaagaagcggagaggacgaccccctggcagaaccaaccagcccaaacagaaccagcctatcattcaggttgaagaccagaatacaggtgcaattgagaacattatagttgaagtaaaaaaagagccagatgctgagcccgcagagggagaggaagaggaggcccagccagctgccacagatgcccccaacggagacctcacgcccgagatgatcctcagcatgatggaccggtgatggcggagccttgtgcgtcgccaggacttctctgggctgtgtttaaacggcccgcatcttaatttttctcccttctttcttttttttggctttgggaaaagcatcattttaccaaacataccgagaacgaaaacttcaaggatgatgttagaaaaaaatgtgatttaactagaacttgctgtctgatgttagcaaatcatggaatgttctgagtccctgagggtttactgtgaagtgctgaggacagtgttgacaactaactcgttttcctagatggaaacggagacattgacccctccctccatgtggtaaaccactccagaatggccaccaggcttcccagagttctatggtcttcttcccaagagagtttttaattgtaaatgcatacttgggaaggacttagagttttaaactgttttttgcttttgcttttccctgactccctttgcttggagtcagctgcacaccagtagtatggcatgctacgatcaggttctgtcctgaaagctttgcctctttcttggcaaggtttctggtatggtcaagcttgtaaataactttttttacattttaatcttttccattaattaagaggttgaaaagaagtgcagtgtaagaaaacccagcattttaattacttgcaaattaagttaccacagactctgtagtgtgtaaatgttgacaaggaattggatcacaatcatgtagcagaatggcacccagaccactgcccaccagtgacggacatgcacgtggcagatcatgatttccagcccacggagccagcatttgaaccttgtataattaactttcagttatgatttcccatcgacattttctttgccctgtttgtagctgattgttgtgttttataaatcttctgttaaggcagaagggtgattatgagtggttcacagcagcccttataagctgggccagaaaatttcactaggtcagtaatttaaaccttggatcttcaaaaaataaaataatgtgaagcaaaaccaactaaaaagtgattcttgcacatgaactgtcacatgtttaaaaatgtgttttttagagagcctcagtcttactgatttcaaacacttttttcttctgtgtattgcttttaagagagccatcagttagctatcagactctaggttgatgcattttgtacttagctgtactgtgtgatatttttcattattttaggacgccaacatgagacctgtaataaaatatgtaatggggttgaaagctggggaggaggatctactgctgtacagctaataaatcataacggatt

SEQ ID NO: 1624 - DNA, 1875 bp, Homo sapiens
ttttgatttataaccgtgagatgttgctgctcagttgccaagcaagactggtgatgtacatcgagagagacagcagaaagaccactccaggcaaggagcagcaaagtggcaatgaatacctgtccaaatgcctggatcttctcatctgtcacattgtgcaggagctgccacgaatcctgggtgacattcttaactccttggctaatgtttctggacgtaaacacccatcaacagttcaagtgaaacagctgaagttgtgtctccccctgatgcctgtagtgcttcacctcgtaacttcacaggtatttcgacctcaagttgtgacagaagagtttcttttcagctatggaactattcttagtcatattaaatctgtagactcaggagaaacgaacatagatggagccataggactgacagcatcagaagaatttatcaagatcacattgtcagcttttgaagcaataatacagtatcctattttattgaaagactatcgctccacggttgttgactatatactgccacccttggtgtccttggttcaaagccaaaatgtggagtggagactctttagcttgcggttgctctcagaaaccacatctctactcgtgaaccaggagtttggggatggcaaggagaaggccagtgttgattctgacagcaatcttctggctctcattcgagatgtcttacttccccagtatgagcacattcttttagaacctgacccagtaccagcatatgctctgaaactgctagtcgcgatgactgaacacaacccaactttcacaagacttgtggaagaaagcaaactgatcccactcatttttgaagtaactctggaacatcaggagagcattctgggtaataccatgcaaagtgtgattgcattactcagcaatctagttgcctgcaaagattcgaatatggaactactttatgaacaaggacttgtcagtcacatctgtaacctgctcactgaaactgccacactgtgcttggatgtggacaataaaaacaacaatgagatggcagctccactgctcttttccctgcttgatattttgcacagcatgctgacctatacctccggtattgtacggctggctttgcaggcccagaagtctggctcaggagaggaccctcaggctgcagaagacctgctgctgctcaacagacctctgacagacctgattagcctgctcattccactgcttcctaatgaagatcctgagatttttgatgtttcatccaagtgcctgtctatactggttcagctgtatggaggggaaaacccggacagcctctctcctgaaaatgtggaaatttttgctcatttactgacatccaaggaggacccaaaggagcagaagcttctgttaaggattctcagaagaatgatcacctccaatgagaagcacttggagagcctcaagaatgcaggcagcctcctgcgggctctggagcggctggcccctgggagtggttcatttgccgacagtgcggtggctcccttggccctggaaatcctccaagccgttgggcactaggcaagaaggtgcttagcacaagcccgccctgtggccccagccctcggatgcataagcaaggtcagctcccagacacctttgccacatcccctcacagctgtctttggacctaataaagtcagcttaacccagaacctggtggcccaagtgctcactaaccccagggcctagaaaactgactcagaatggacttccttggttcctgtggaatgcatctgggaagcccaggtttgttagctgttctcagaaatgttctttccctctctgtgtgggccaggtgggctaaggttagcactgcctgtggtaataaagcagtggatgc

SEQ ID NO: 1625 - DNA, 2869 bp, Homo sapiens
atcatgaaggcagaggctgcctcgggacggctctgccccagggagcgtggggccatctgagccaaacagaatagagggcttggacacagccccggatgtgagttgagctctgaatgtcaagaccagtcctggacctatgaccacccagctgggagggagctgacagataaggaaactgaggcccagagtggtgctggaggtctctgagccaggaagtggcccgtcgggactggaatgcagggccctgagcctgacagcactctccgggaaggggctagagccccgagggatgagcgaaatgatcatgatcatctttgtcccatgcttgcaagttctagaactgctacaaaggagcagccacgagtgtcccccgctcccagaccactccaagctgcttctagagggactggacatcctggagcagaaacagtcccattttccactgctttggtcagggagtgagtcccctgatgtcatccgaggatatgaggcatcgctaaatctggccatcccctgaagcacccagcctcaccgacttcctgaagcgtggatgaacgctgctgccacaaatgtgctgtgacaaccgctgacaaggagagtgagtgatgtttgtgccatcctgctgagcacgagggagctgcttggggaagccaggggctggggcatctcaatagcactgagggcagcctcgggggggcttcacagcacacccacccccagatcactgctgattctgggggatgcatgacagagctttctgtccttgcacttccctttggctgctaaactgaatgaagcctccttcttagacccaaccccctactgagtgtctctctcttctgttctttgccatccctgcccccaaacctggaaacttcctctgcacctccacatgcagttggtgccaaatgtctcccacctacctgcctgggtctctgcccctcagcttctcacaagtggctgtgttcttccactcacctgctgggacacacactggctcaccagcccccatcctctccacaccgtctcacctgcctggctcgccttcttccccgtcacctgtagacaggtcatttcccagacatacctgccctactctgactagttggcatggtgaggccgtcactcccttctctccagggtcccatgtgctctccaggcacaaattcacccggacatttcttgatctagctctgtcccagaaagcgttacctttgcaatggcaaatacctgtattaattgccgtgcaagtgacacatacttatcatgtgctcgcctgttccaggcaccgatggctgtcttttttattttgtgtcaggttccagtgagtgagtctgacttatgattgtatagacttagctcacatcctccttcctccaccttgacaattgtgctaatgacaaagttgtcatttactgagcacttgccatgtcccaatcactgtgccaggagatttacctgcatgggctcacaaactctttgcagtattcttgaaagagaggcaagtatgttcctctattttgtagatgagaaaactgggctcagaaaatgaagtcattttgccccaggtcacccaaccagcgagtggcagaactatgtttaaaagtcaggattatctattccagagaccctgtgctgcccaccatggcacactgcttctccagtcaaggaaaggtagcttaaagatatctgctttccaaaatgcttgaacatttgttagaatatggaagaagataatatatggtcctgtccttgaagaattgatactctatttggggaaacaaagcagctgacattgccagccaatatttatttaaatttcatctcagaaaaatagcaaaagagattttatttaacctttcaacagtgattatctgattatgtctgtttgagtattctgtaggatagacagctaaggcagtcatggactcagtgggaaaaagttcagcaatccattattaatgtctgtttggggcgcaggcatgggtagtggaggtagatgtgccaccaatttcatttttcctatatagtagaaaacacgagagtttctaataaattcctaactatataaagcagacaagagaggaaagagaaagatacctgtgtgattgggagaggctgcctgaggaaggtaagatatgacctgtttggggtcattgtacccctggggcatgaggcatcatcaaggccagattgaattttctaaggtatgataaaaagtttggttcttccatgtgccttggttcctcttctctaaaatggctaattctgtccaattaagatctagaaggccctttctgatgccaatgtttctaaataaagatatctaataagggtggaacacgtcacagctctcaacctcctctcagaccccccaacaagcccatgatgcagccattttagagatgaaaaactgaggcccagagagctgacacccatgttagcagaagttagtggaacccagttctgttaactctaaccattctctaatccaaaagtatatttacagattttcaaataattaggaaatgttagtaatatttagaagctcctcagatgattctagttttcagccatggttgagaatgttgctaaaaagtagtgttatggctgatttccgagaaggaaacagaggttcagagtggttaagcaacttgtccaaagtcacacagccagaacatagtggagtgggaactccactgaggcaggctgactgcttaacccatgtgtctgttgtgccccaggcactgtcacatattatttcatttaattctctcaacaactttgtttttttaactctgaaaactaatccagaaaagttaaataaccagcccaaaattgcagagctaataaaaggcagctaacagtg

SEQ ID NO: 1626 - DNA, 1842 bp, Homo sapiens
gttctctgtcagggtctccctgggagggacgcagccaccgcagctggttggggcctggcttcgcccaggacagtcctttcctttcccattgtctttggatgactatcgctgggctgggacatgaggcgggcagaggcgcgggtcacccttaggacccccctcttgctgctggggctctgggcgctcctggctccggtccggtgttctcaaggccgtcccttgtggcactatgcctcctccgaggtggtgattcccaggaaggagacacaccatagcaaaggccttcagtttcccggctggctgtcctacagcctgtgttttggggtcaaagacacgtcattcacatgcggaggaaacaccttctttggcctagacatctgctggtgacaactcaggatgaccaaggagtcttgcagatgggtgacccctacatccctccagactgctagtacctcggctacctggaggaggtgcctctgtccatggtcaccgtcgacacgtgctatggggacctcagaggcatcatgaggctggacgaccttgcgtacgaaatcaaacccctccaggattcccgcaggccggtgtgtttttgaaacacttgctcctgtgtataacgaaaccatgacaacggttcgctgtggaaacctcatagtggaggggagggaggaatgtgactgtggctccttcaagcagtgttatgccagttattgctgccaaagtgactgtcacttaacaccggggagcatctgccatataggagagtgctgtacaaactgcagcttctccccaccagggactctctgcagacctatccaaaatatatgtgaccttccagagtactgtcacgggaccaccgtgacatgtcccgcaaacgtttatatgcaagatggaaccccgtgcactgaagaaggctactgctatcgtgggaactgcactgatcgcaatgtgctctgcaaggcgatctttggtgtcagtgctgaggatgctcccgaggtctgctatgacataaatcttgaaagctaccgatttggacattgtattagacaacaaacatatctcagctaccaggcttgtgcaggaatagataagttttgtggaagactgcagtgtaccaatgtgacccatcttccccggctgcaggaacgtgtttcattccatcactcagtgagaggagggtttcagtgttttggactggatgaacaccatgcaacagacacgactgatgttgggcgtgtgatagatggcactccttgtgttcatggaaacttctgtaataacgcccagtgcaatgtgactatcacttcactgggctacaactgccaccctcagaagtgcggtcatagaggagtctgcaacaacagaaggaactgccattgccatataggctgggatcctccactgtgcctaagaagaggtgctggtgggagtgtcaacagcgggccacctccaaaaagaacacgttccgtcaaacaaagccagcaatcagtgatgtatctgagagtggtctttggtcgtatttacgccttcataattgcactgctctttgggacagccaaaaatgtgcgaactatcaggaccaccaccgttaaggaagggacagttactaaccccgaataacactaattcagcctcccgatccctgtaaagatacagagaatataacagcaaaatctatgaaacaggatcaggggaagggatggcaaagctcaagtccacatttcttgaagtccacaggaagcacagggtcctgtttcacatcacagggaaacgggaggcattggcttctgtcccaggttcttgtaggtcgctgatgctcactctgaaataaatcttcaaaaacac

SEQ ID NO: 1627 - DNA, 1743 bp, Homo sapiens
aaaaaaacatacacacacccctgattccagaaacacaacaggagctgactcaaaagggagtgtctggtgcaggcatgcagggaggaagaatgactctgagcttgaccattcaacttcgaaactttaacatcaatggatcagcacacactggtgtacggtctgctatgcatgcagccctgtgctaggcaaaagaagtatcagaccaggaactgacagcctcactgcaacaggaagagaggcttcacacaataagcgtttcattcaaccaggctggacctgtgcttattgagttgaacatcactgagcacaaaatgcaagccagacaccataagagctgtaaggatgataaagatgtctttctaccctcgagagctctaagtgtggtcaggagagaaacacatgcaaagattatgctggctggaaggaaatgctggaatgaaggtggaagcattctattcatctaaaagcaccggtaattaacgatgctaataaatgtataatccctttgtaaacatctcttcacaaggtcataaagaaggaagactgaatgaaggacgccaggctttcattttagaattaattttgtcattgaatgcactcactgcattatttgatagagtacttttgcatttgaagtagtacatttgccttctaccatctcattaacattgctttcaacagaatcagaaataacacgaaccactgcagggtaattttgaatgctcatttgactatgcagtgacatcaagtggcgagttgaggaatgatcatatgctgtgtgagaactccgtgtcaaaaattccatggagccaggctagacaccacatttggcactttcagctgtttagatttcagagaattaaaaggaaatggtcaccgacctgcctttgatagtacccgtataccccttcccaccataagaaaccagcgttccttagagaaatggctaattctagctctagggcaagaaatgctaagatgtgctcaaaacatctcattataccagcaagccagggagccaccaacgactactggagctgtgtcaaaaggaccaacaaaccaacttgaagaggctcccgctggccaacagtggggcaattagagcatcaataagaataatatctgtaacaaactgaaacgtatcaaatatgtttaaattcatatgtttataattacactcaaaaaacgaagatgcagaccactttaccttgaggatgttacagaatgaaattatcattctgaaaactggtaaataaagagaaggtatcaagtaagcatgtatctggctttttctatatgaaataaaggaagccaaatagtaaacgaggggaagtttctctttactgaaatattgcaggtaattaaagaagaaggagaaacagagaacattatcgttttatggcctctaatggaacaagacatctaggcaatgatgaactatggtcaccaacatcactcaatcagggacaatcagacactgtgggcccctgaaggaagtaaacaccaccacgtaggaaatattctcaccaaaacttcaaaaacttgaatctgatctagtctttagtttcaactactaatttacaggcaatacggggctcagagggatgtggtaaaatgtcacggaaatataatcagcaaaatccagtacagataataagaagacaaatgatccacagatggaaaggaagaatgtaaagttgtgttggtaaagaaattcacagattaataaaagcttaaaaatgt

SEQ ID NO: 1628 - DNA, 1679 bp, Homo sapiens
gaaaaagtcattccctgtgtgtagcgtctagggcagcctttgccctggttccagcagatgggttgtctcttcatagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggtgagtgtttccggctccggtgctccccctggcccttttccctggagattccctgctccaagtcttctgggcgctccaggttctgtgaggccccacgggagccccggacccctggtctctgtaactgtggggtgagggaaggtgtgacctgaatgttctccctgacctcctagtttcctagtcttgcacgttctattcttcccaggttcacattcaccacacccacccactcctgtcattcccttccctttcaccccttctgtctcatttagctccactttgaaaaaactgtggcatcaaaggtccctgggtagtcccttcccaaatgacctcagtcttccctctcccacccctatgaagccacacctcaacttctcttcaggcagcacgcccggaccttgtggtacgacaggcccaggtatgtgttcatggagttttgcgttgaggacagcaccgatgtccacgtgcttattgaggatcaccgcattgtgttcaggtagtggccctgccgtccgagggcctggcttcccaggaatctacccctttcctaatgtccccacacggagtattccgcatctcctcagcttcattgtctcctcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatgatgattctgacagtgctgatgatgcaacaagtaattaactttctgtgacgcaaagctgggaaggcagctgtggctattttccagttgttctagaaagctagcgcctaggcctttgtcagcgctttggctgtgcaccaagttcttctgagatctctgaactttcctagaagctctttattaagggtcgtccttcaagcttgtcttcctcctaggcacttgactatggctccacatcagatgcagggtcggggaggggtagactggtagggcttctgatttcttactgattggtttctaatctctgtgtttaggccacttgattatttgagtatgtgtgtgtatgtggcaaaacaaaagccaaagaagaatgcagattatagaaatctctactatgtgtgcatatggggcaaagcaaaaagccaaagaagaaacagattataataaatctctaggaactgtta

SEQ ID NO: 1629 - DNA, 2088 bp, Homo sapiens
gtgggccaggccccagccggccagcctgcctcctccctgcctggggtgctgtgcctttgggcaagttctgggagtgccggccccagcacccctctcctcagaacccctacctggcctcgccctggccctgtccctcctgtctctcccttccatccatggaccaggccctggggtgccatcgagtgccctgacaggctcctgcgggtctctcctgctctgtaggagactgatggcccagtgtgagcctcctgcaggttgtgggagggggtggagggaacagcagcacccactatgatgccaccccgagggcctagggcctggggcatcttgggcaggcctcagtacctgtatctgaagagaggggaggttgtgctcacatgctgggagacttcccagctctgcactgtgagtcagtctatgatgtctgtgatggaagaaacaggttcccccggcatccctgcccaagcactgtgggtagcctgtgccgaggacaggagggacaggaaatctgccctctgggagctcccaggctcagggtggagttggggggaggacaggaagcaatcaccagggagatgaaagaaacaaggcccctaaagggactgggtcctgagtctgggagctttgaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggttttggaaggatgggccagcttgcaggggttggggagggagacatccagcttgggctttcccctttggaataaaccattggtctgtc

SEQ ID NO: 1630 - DNA, 1637 bp, Homo sapiens
gaagatgccgtggagcaattcatgtttcaaataaagacacttaggaaaaagaaccaaaaatatcatgaaagaaatagccgcttaaaagaagaacagatttggcacatacggcatctactaaaggaactgagtgaagagaaggcagagggattgccagttgtaacaagagaggatgttgaagaagcgatgaaggaaaaatggaagtttgaaagagaccaggaaaaaaacttgagagatatgcgcatgcaaataagtaatgctgagaaactatttcttgagaaactcagtgaaaaggaatattgggaggagtacaagaatgtagggagtgaacgacatgctaaactcattacctccttacaaaatgacatcaacacagttaaagagaatgcagagaaaatgtcagaacactataaaatcactctggaagatactagaaagaaaataatcaaggaaactttgttgcaactggaccaaaagaaggaatgggccacacagaatgctgtaaagctcattgacaagggcagttatctagagatctgggagaatgactggctcaaaaaagagaacaggttgcaattcacaggaaggaagttgaagaattaaaaaatgctattcatgaactggaagcagaaaatttggtgcttattgatcaactatccaactgtagacttgtggatctcaagatacccaggcgactatatcttacccaagctgctgggctagaagtgccacctgaagaaatgtctttggaattgccagaaacacatatagaagagaagtcagaattgcaacccacagaagtagaaagtagagacttgatgtcctcatcagatgagagcactatcttacatcttagtcatgaaaatagcatcgaagatctccagtatgtgaagatagataaagaggaaaactcaggcacagagtttggggacactgatatgaagtacttactatatgaggatgagaaggatttcaaggattatgtaaacttgggccccctgggagtgaagcttatgagtgtggagagcaagaaaatgcccattcattttcaagagaaggaaattccagtcaaactctataaagatgtcaggagcccagaaagccacatcacatataagatgatgaagtcttttctctaagacggaaagctgcaaaggaaacacaacttttccttataaatgttctttgggaactgaagtatatccgttgcccattttacttacactttggctcatttttaaaccagctgttatttctaaaggtcatatttacatttaaaatcaaaggtattcagctattcatttacttgcatggtatgagtgaccaaaacggaagcacgctttgtatttctacactgaagtattcagaagcatgacagtgggttcaaggtagtctctgaggttccttttcacacacaaaaaattcactgattaatctgtgattccagtatgaaatagttccattagaaatgtttctaagaaaaacttagaagtttgcatagcattgtctacacatctttccctctgaggatgctcaatgtgatagacagccagtctataatgcaagccaattctccgtagtttaaccctgtgtattagtctgttctcatgctgctaataaagacataattgaaactg

SEQ ID NO: 1631 - DNA, 2547 bp, Homo sapiens
gaaatatgataacacaatttggagttttattaaaaaacaattttttttgaatttttgaaaaagattttgtgtttaagaaaaaagaaccaaagggcctgcaatatattctgttagaggagattaaaaagaagaaagggatgagggaaaaaaagagatgaatgtttcccattatcactcatttctgtctcaggagggctaaggtggcccctgctcaccagccttcccctctcggcatcaccagcccccagcctgctatccgcttcacagagcagcgagccagtccttggagaggggacgtgagaaggggcagaagtcaggggacctaaggctgctccccagcaccagtgctgctcaacacacacaattgtgtgaccaccactgaacaaatctcacaagaaagaggtgcattttactccacacgtcatttggttttgaaaaactaatttgaacctcatttttttctaagtgagaatttggtttgctgtgtgtgtgttttcaatttggattgccaagtattcagtcctaacatatgttatggttggagtgcatataacactgtgcagccgaataactagacctagaaaataaaactgatcacggtaaagttattttccaggcaggggatgcctcatgatactggctggggcccaaccacacccaaggcctcgtcggtttctgttctcatgctgttgtcatatacccagaagtaggggaagcccaggagccatggagcctcagtgtcagttccctgacaagccatcctccaaaaaagcctttcctttgcaaaatgaacaggtactccgtgaaaacagggagagaaatttctgtttttcaccgatgcatttctcacgttcatctgacaatgtgcaaaacaaaaagtctacattagaaatttatcatgaagttatactctacttcaactcacttcttttcagtccctgtgaaaacttaatactcttggtgttgtactgaaatacccagtggatttggggtgcacctgtacccttgatctccacttctgcgtgtttctaggccaaagggaaaaccaactctctacctaattggaacttctggttttattgcatatcctggaggtcttgcttcgtttttattttcccgggttgatggtctttcccatgtgcacctacgttagcccactatgtagaacgccttggcagttttcacagagtaagaggttgaaggaagccaccaatgtgaaaatcatatttgctgtaaagaaagaaccattgtgagttgttggaaaccagattaaaattccataattggagattgatgacttttatttcatgagttttacttagttaggtgttttatcttctgtgttttgtggctccaaattacgaagactgttggccttgcaagaaactgatcacggcaaagttattttccttactgaacacgtgtcctatatatttgcttggcctcgggttttgtttaatcccttcaaaggccctttgaactgatgtttcaacatgactccttctctgtgagctctccgctaggaagcggccatcatgtcaagccccttcacagctaaagtagtgagttcacatagtcgaagaatcttctgggttgcatcttatgaaaaaaagaaatccactgcctttttataagagaacagaacatttacaccgtcttgttgagcaaatgaacgttcaaatggccagcacaaaagaaatccccaatctctaacctcacaatgaaatcgccacggacaaaagatcacgggataccgggagcactaaactggaagtgacacaaaaccacagcagaatccgctcacacctgccgaggttcctgggggatgatctttgtgtaaaggatcctggtgccgcagtcagcctgaaacactccaaggagcagagacgctcccctctgcaacagtgacatttatactgatggcgtctttttaaataaattaatacatgtctgatgtggacagagtagtgctgtctgacaaggtgatcatttgacttttcttagaggtacaaatttacgctcccttctatgaatagagagggctatttgtttcattcaaagacaagacattgttagaaatgagtggcacacctcttcaacccatccccttcctccatggaggtaaaaagatcctattagttctcataattgattctgagggctgcagcgtgcctcatttagccgtccctgctcggttcacgccaaggatgtaattcatgcacacttggacgtccaacatggctgacgcgccttggacacacagcctcggcgctgcatcattttttaatcagctatctgaggaatatttatctgatcaacaaggagtgctgtcaggaggagaccagaggtgacattaataagcctgtggtttcctggtacaatgatggaggaagagtttggaataaaaccctgctcgtttgagcatgccagcagactaaagaatatttttattctgcttataaagagccagtcaaaagagtctcagtttgaagtgttcagttaagtttaagtctcagtgataagttttcaggcattcacatgtgttag

SEQ ID NO: 1632 - DNA, 2409 bp, Homo sapiens
aaaatatagagaagtggtctgatggttaattttatatataaatttgactggactaggggatgcccagaagctggtaaaacattatttatgggtgtgtttctgaggatgtttttggaagagattagcattagtattagtggactgagtaaacaagatcaccctcgccaacaggggtggatattatccaatccactgagggccccaatagaacagaaaaacagaggaatgtgaattcatgcttgcttctggagttaggacatccatcttctgccttcagacatcagcattcctagttctcaggtctctgggcttggactaaactacattactggctctctcctgggctccagattgcagacagcagattgtgggacttctcagcctccgtaatcaatcctgtcttggaacctgcttcttagagggcctggactaacatactctggtagtgcatgaagcatctgtgatcacagcgtgacaagaaaatagcacaaacaaacctatgaggacttgagagaattcaaaagggtcatgtagggatcccaccccttctctgtgttttcactctgaagctctacacaactttacacctgaatgaacgccaaacctctatggatatataaagggaagcttgaggaggaatttcacagttacagtgcagaagcagaagcaaaagaattaaccagctcttcagtcaagcaaatcctctactcaccatgcttcctcctgccattcatttctatctccttccccttgcatgcatcctaatgaaaagctgtttggcttttaaaaatgatgccacagaaatcctttattcacatgtggttaaacctgttccagcacaccccagcagcaacagcacgttgaatcaagccagaaatggaggcaggcatttcagtaacactggactggatcggaacagaacagaaagcttgacgagacaaaattatttctggctatttccaggtgcattcctgaggcagctgcaggaagctcgggttcaagtgggttgccgggaactgcgttccaccaaatacatctctgatggccagtgcaccagcatcagccctctgaaggagctggtgtgtgctggcgagtgcttgcccctgccagtgctccctaactggattggaggaggctatggaacaaagtactggagcaggaggagctcccaggagtggcggtgtgtcaatgacaaaacccgtacccagagaatccagctgcagtgccaagatggcagcacacgcacctacaaaatcacagtagtcactgcctgcaagtgcaagaggtacacccggcagcacaacgagtccagtcacaactttgagagcatgtcacctgccaagccagtccagcatcacagagagcggaaaagagccagcaaatccagcaagcacagcatgagttagaactcagactcccataactagacttactagtaaccatctgctttacagatttgattgcttggaagactcaagcctgccactgctgttttctcacttgaaagtatatgctttctgctttgatcaaacccagcaagctgtcttaagtatcaggaccttctttgggaatagtttttccttttcaagtttttcaagatgtaggtatatccatgaatgcaatttgcatttaaattccacgtatcctgtagttttaattcctcattgttcttaaaagactgttgatactataaacatcagtgaatcattatattttaaaacagaaaagggcttctcagataccctccatctactggcccatcccctctcctaaacaaaactccttcaaaacaggttaaaaaaaatatgttgtcatgaatcttcacagtaacatttcagaagggtgcttttttggtactcttcatgggaacagtttagcagccatgagtgatcttcctttgaaagagaatgaaagaccctgtgacatttcacttcaaaaataagccctgtggctctttacggtcgcatagtatgaaattataccctgcatgctgaccctcgcttggaatggaatgccagaaatgcatggcagcagctaataagtaaagctgattaactatttatttgtcaatgttattatttaatgagctttcacatgtgatttgtttcaaaactttaattttttaatgttttgaaactttttcatggacctaaatattttcctatatgatttgtggttgattagaaatatgaaatacatgttgtagatatgtaaaatgaatattttagtctccttattacatatatgttcatggtgaactttatcaatagtatggatctttttaaatcaataagatgctttgtaaagttgaaataagtaatactttcttgtttaatctgtgcaatcagaaggtgtcttgaccttcaattcaattggtttcttttaacaaaaataaacactgctaaaagt

SEQ ID NO: 1633 - DNA, 2341 bp, Homo sapiens
cagaaagtgaagtggaaagtttacagtatgataaggacaccaaaccaaatccaaaagccagttcttctgtacctgcttcactggcccagctagtgactacatccaatgcttcagaagtagcttcaggacagaagattgctgtaccagcaacatcacatcatttttgcttttcaatagacttaaggagtatacatgccttggagattggttttccaatcaactgtatattaaggtactcatatccattctttggaagtgcagctcctattatgactaatcctcctgtagaagttcggaaaaacatggaagtttttcttccccagtcttactgtgcatttgattttgcaactatgcctcatcagctgcaagacaccttcttaaggattccattactggttgaactatggcacaaggataaaatgagtaaagatttacttctgggaattgcgagaatccagctttctaacatcttgtcttcagaaaaaactcgttttttaggttctaatggtgaacagtgttggcgtcaaacttacagtgaaagtgtgcctgttatagcagcacaaggatcaaataacaggatagcagatctttcttacacagtgactctagaagattatggactagtaaaaatgcgtgagatttttatctctgattcatctcagggtgtatctgccgtacagcaaaagccgtcttctcttcctccagcaccttgtccttcagagatccagacagagcctcgtgaaacgttagaatacaaagcagcacttgagctagaaatgtggaaggagatgcaagaagatatatttgaaaatcagctgaagcagaaagaactggctcatatgcaggctcttgcagaggaatggaagaaaagggaccgagaaagagaatcactagtaaagaaaaaggtggctgaatatactattctagaaggaaaacttcaaaaaactctaattgacttggagaagcgagagcagcagcttgctagtgtggaatcagagcttcaaagagaaaaaaaggaactgcaatcagaacgtcagcggaacctgcaagaactgcaggactctatccgtagggccaaagaggactgtattcaccaagtagaactagaaaggttaaaaatcaaacagctcgaagaggataaacaccgccttcagcaacagcttaatgatgctgaaaataagtataagattttggaaaaagagttccaacagttcaaggaccagcaaaacaacaaaccagaaatccgtctacagtctgaaataaatcttctcaccttggaaaaggttgaacttgaaagaaagttggaatctgcaactaagtctaaactgcattacaagcagcagtggggacgagctttgaaagaacttgccagacttaaacagagggagcaagaaagtcaaatggctcgtcttaaaaaacagcaggaagaattggaacagatgagactacgttaccttgccgctgaggaaaaagatacagtaaaaaccgagcgacaagaattgttggatataagaaatgaattgaacaggttaaggcaacaagagcaaaaacaataccaggattccacagagattgcaagtggaaaaaaggatggcccccatggcagtgtattggaagaaggtttggatgattatttgactcgcctgatagaagaaagggatactttgatgagaacgggtgtgtataatcacgaggatcgaataataagtgaactcgaccgacagatcagagagattttggcaaaaagcaatgccagtaattaataacatttggaaaagctttatagagactctaagtctaaattttaatttctttgtaaaaacctcaaaagtgaggaaaatggatgttttaaaatggtattttcaattttttataagcaaaattttgtatgttattgtatagtatttatttgatcttatttactttatgctacctctcccacactggttttatttgtaatttgcatttatatactcattttaaatgacttttcagtgtttttcatagtttataatctgatggctaactaactttcaaaacagcttttaactaagtttgttgtaggagaaatgactgcggtaatttccagttctataatgtttcatgttgagccaaaagagtatatcttgcactttaaaaacgctgcgtcctattccatttgaatgtaaattcttaaaagttgagaccaattgtaaccagtttaactcattttagatgacctttttttcttataatatttgcaagtgacaagtttgaaaacaaagcaagatcagtgcagagaagccacatgacatgttgggtgacagattggtcatttatttaaataaagttaatacagatt

SEQ ID NO: 1634 - DNA, 1887 bp, Homo sapiens
atgggggagaggctacacaggggagaggccgcacgccggggagatggtccctgcgggaagactccgaggcagtctcctgcagctccttccggcgaatccggttcaggaagtaaaaccagccctgtgtagagccatgccaggcaggaaaatgggcacctctagtgacccaggctggctgagagcctgcagggaagagcctttggaacgtgagccactgtgggctggcaggactgcaactggcgtctccatctactggtaccgaggcgaggaggaaaaagcaggggggcccggagacggcccctctaagtctgtaactccagagctgctgctcagtccccagaacgtcacctccgagcagagcctgtgacaactgtcaactgtgaagctgtggcgtgggttgctactgaagctctgaagtcagcgaggacacagcatgtttgttctagaccgtttggctgcgggaggaagctgtacatgcacacactcgcctcaccaccctgcgagtccacaggcccctccccggagtcacctccaggtaaagggggccctgcgtcgggacttgctctctggggcgctgagatgctctacaatgagctgtgctgcagtgcacggccgcccgactgtgcacccgcaacggggaactgaacgctgcatgaagtacatctccaagttgttctttaagaaggcttagggtccctggaagaccctcgcccacacccagcgtggagcgttgttgctcacgtggccacacctctcgggatggccgtgggtctccgtgatggaccttaatctagacagatggagggtggctggcgggacaggtagagaacaggcatgcgctgtgcacacactgccccagctctgccagctgagaacacctgtgaacaatgagatcggaatagcaagggcccagccagatcggcttctaaacaccaccctcccctcacaggagctagagatcttcagagaaatgagagaatctgaacagggccctagggctgcaaacgacttcactgagacaaccaaggactgagggttcgagggttggacacagtgaggcaggcgagtggaaccacaggtgcttcccgtcctggtcacaaagtcagagtggctgggccaagtgtcctgagaagagtcacctcctgggatcccatcagcctggccatagcagaacacccagacaggggcccatccccgaggctcaactcaacgcatgcagccactgtagaaaagtctggaaagtagttcttcaaccgactagacatggtgagcccaaaacccagccatgacactcctaggcatctgccccagaggaatgaaagcatccatcccctgcaaactcatccttacacagcagcgtgactcaagacggccaaaggcggaaacaccccaaacgtccatcagtggacaaacgggcagatgcaatgcactgtctgtaccgtgggatgtcactcagccatatgaaggaaagactccagtgtggatgagccctggaaccacggtgctgcgtgatcccgtaacacatggccagaacagacacggcccggaacctgaggccgggaggatgcgtgcaggtggcggggagacagaggggcgatggcccagtttcttttgggctgaaaatggtctaaagttgactgtggtgatggctgtacaactttgaatatgctgaaaactcgaattacacacttcagttgggcgaactgtactccatgtgaattacctctcgatggttctctcctgggctcaggcgcttctcccaccttggcctcctgagtagctggaactaccattcatgtgcggaaataaaacaactcggtctcaaaaaaaactcaactcaaaactcagtctcaaaaataaaaaaataaaaaagtaaaagaggctacc

SEQ ID NO: 1635 - DNA, 2161 bp, Homo sapiens
atatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatacatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatctacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgcctgccagataaaaggcaatttattccgtgagcaacagcggacgctctactctatgagttacatgaataagtgctgggagatttatctcgcttactgcagacccagcgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagatggaagatgacgaactggaagcaaggctgaacatcttcatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcact

SEQ ID NO: 1636 - DNA, 1913 bp, Homo sapiens
atgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtgggagaagagaagcatcctgttcatctctgcaagatcatgttgttctttcggagtaacccctacttccagaataaagtgattaccaaggaatatctggtgaacatcacaggtgacaggtggctcccaggatgggtagtgggaggaagatggtgggtggatcattgccaacgggatccagcccccttcccacaaaaactcctgtctctgtagaatacagggcttctcattccactccaattgagtggtatccggattatgaagtggaggcctatcgccgcagacaccacaacagcagccttaacttcttcaactggttctctgaccacaacttcgcaggatctaacaagattgctgaggtgagtcctcactgggaaacatgaggaatgaccccgtgtgttcccagctgcttgggtcacctttctgagccctgatgaggcctttcccgattgagtcccctgacagatcctatgtaaggacctgtggcgcaatcccctgcaatactacaagaggatgaagccacctgaagagggaacagagacgtcagaaattccttgagaggaagacagagagtgacagaatccaggacgttcatggcattgggctgaaaaggcacgttagagactgcactgcaaagcgggtgatagctgtggagtcttaagcccagtgaagaatcgtccatttccagaatcaatgagaagtaaagctgaaaatcattcagttcagtctgtggcacttgattccacggctgtcaaccccaccggcagtcatcccaccaaccccatgagattgggctccctgaatgtgcgtcctggtcatccttgccccaaaccacaaaggactgtttagattgatggatttccttaagctgttgccccatcagacttgtgtgtgcttttagggtccagtgcatcttgttagctgactcccctcacagacaatactgggaatggggcagggattgcgcagaacagtttgtaacacgtggtaggaggaagtttaagggatcacaaatggggaagggatatccttttctcagcgggccccacaattgaaacatttcaaagtatggctcagagaaaatgcgttttaacatgagtttgtgtttctctaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaaggatgtgtg

SEQ ID NO: 1637 - DNA, 2114 bp, Homo sapiens
agcattgttaacggctgcggttcgaagtggctgtgggtattgctgcggctggtgcgtcgtcgctctaggttttcttccgccgtctgtgacagcttcttgatctgtccccaggaatcctgctttttttttctttgagacacggtctcgctctgtcacccttgctggagtgcagtggtgcaatcacagatcacggcagtgtctaattcctgggctcaagtgaaccttttgcatcagcctcctgaatagctgagaccacaggatatgaaagatggcaagtccagatagaagtaaacggaagatattaaaagccaaaaagacaatgcccctaagttgccggaagcaagtagagatgctgaataagtcaaggaatgttgaagcgctgaaaacagcaattgggagtaatgttccaagcggtaatcagagtttcagtcctagtgtcataactaggacgactgaaataaccaaatgtagcccttctgaaaatggtgcatcctcattggactctaataaaaattcaatatcagagaaaagtaaagtattctctcagaattgcataaaaccagtagaagaaattgttcattcagaaacaaaattggaacaagttgtttgttcgtaccaaaagccaagtagaacaacagaatcccccagcagagtcttcacagaagaggcaaaagattcactgaacacttctgaaaacgattctgagcatcagacaaatgtaacaagatccctttttgagcatgagggtgcttgtagtctaaagtccagttgctgtccacccagtgtattgagtggtgttgttcagatgccagagtctacagtaaccagtaccgtgggtgacaagaaaactgaccagatggttttccatttagaaacaaactccaattcagaatcacatgataaaaggcaaagtgacaacattttatgttcagaagactcaggttttgtgcctgttgagaaaacacctaatttggtgaattcagtcacttctaacaactgtgctgatgacattttgaaaaccgatgagtgtagtagaaccagtatttcaaattgtgaaagtgcagactcaacatggcagtcatcacttgacactaataacaacagccattatcaaaagaagaggatgttttcagaaaacgaggaaaatgttaaacgcatgaaaacttcagagcaaattaatgaaaatatttgtgtaagtttggaaaggcaaacagcattcctggaacaggtcagacatttgattcagcaggagatctatagcataaattatgaactatttgataagaaactgaaagaattgaaccaacgcattgggaagacagagtgcagaaataagcatgaaggaatagctgataaacttttggcaaaaatagcaaaacttcaaagacgtattaaaacagtattattatttcaaaggaattgtttgaaaccaaacatgttatccagtaatggagcctctaaggttgcaaattcagaggctatgattttggataagaatcttgagtcagttaatagtccaattgaaaagtcttctgtgaattatgagccttctaacccttccgaaaaaggaagtaaaaaaattaatttgtcatcagatcaaaataagtctgtttctgaaagtaacaatgatgatgttatgttgatttctgtggaaagtcctaatttgacaactccaattacatcaaatccaacagataccagaaaaattacatcaggaaattctagcaattctcccaatgctgaagttatgaaagtccagtatcccccctggagtcacattcgaaagctgcttcaaactcaaaggaaacaaccccattggcacaaaatgcagtccaggttcctgagtcctttgagcacctgccacctctcccagaaccaccagcaccactacctgaattagtagacaaaacccgagacacacttcctccccagaagcctgagctcaaagtgaaacgggttttcagacccaatggcattgccctgacttggaatataaccaaaatcaatcccaagtgtgctcctgtagaaagctaccacctcttcctgtgtcatgagaactctaataataagttgatttggaagaagattggagaaattaaagctttaccactccc

SEQ ID NO: 1638 - DNA, 1771 bp, Homo sapiens
atttagtatacagaggaggacacaaacatgagaagattaaggtagagagtgaaatatggtcaggacaaatgtgaatttagagcctgagtgatggtttagtggatttatgtcctcacttgtcactaatgaaaaggaccttacaggttatataattaaagctctgttgacattggctcttgagggcaaacttcataatgaggggaagagtcaagttttgtgtaacctgaagcatatacagtgtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaaatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcggtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgagtctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaatattaagttactgaagtgtatatgcgtaggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatgtagacaacaggc

SEQ ID NO: 1639 - DNA, 2576 bp, Homo sapiens
gatctggcccaggaggcacaaccaggcggcagcggatacaaggccaggcggcggcgggcgggcggacctgcgccctgagcctttctgcgcccgcgggcaccatgagcagccgagtcggggacctgagcccccagcagcaggaagcgctggccaggatcctcctccgctcagttccgggagaacctccaggacctgctgcccatactgcccaatgctgatgactacttcctcctgcgctggctgcgagctcgaaactttgacctgcagaaatccgaagacatgctccgaaggcacatggagttccggaagcaacaagacctggacaacattgtcacatggcagccccctgaggtcatccagctgtatgactcgggtggtctttgtggctacgactacgaaggctgccctgtgtacttcaacatcattgggtccctcgaccccaagggtctcctgctgtcagcctccaagcaggatatgatccggaagcgcatcaaagtctgtgagctgctgttgcatgagtgtgagctgcaaactcagaagctgggcaggaagatcgagatggcgctgatggtgtttgacatggaggggctgagcctgaaacacctgtggaagccagctgtggaggtctaccagcagttttttagcatcctggaagcaaattatcctgagaccctgaagaatttaattgttattcgagccccaaaactgttccccgtggccttcaacttggtcaagtcgttcatgagtgaggagacacgcaggaagattgtgattctgggagacaactggaagcaggagctgacaaaattcatcagccccgaccagctgcctgtggagtttggggggaccatgactgaccccgatggcaaccccaagtgcctgaccaagatcaactatgggggtgaggtgcccaagagctactacctgtgcgagcaggtgaggctgcagtatgagcacacgaggtccgtgggccgcggctcctccctgcaggtggagaacgagatcctgttcccgggctgtgtgctcaggtggcagtttgcttcagatggtggggacatcggctttggggttttcctgaagaccaagatgggggagcagcagagtgctagggagatgacggaggtgctgcccagccagcgctacaatgcccacatggtgcctgaggatgggagcctcacctgcctccaggctggcgtctatgtgcggggtttgtgctccctgatcacctctccatcactgcagatgtcctgcgcttcgacaacacctacagccggatgcatgccaagaagctcagctacactgtggaggtgctgcttcccgacaaggcctctgaggagacgctgcagagtctcaaggcgatgagaccctccccaacacagtgaagaccccagccacctctacctgtgcactccaaccccttcacacccacccctctgacccctgccttcccaggcagggtggtgctggaggtggctgcagagagccacttgtcccacgtcaccatttcatctcattgtaggctcacctggcacagtggccaagcaggaaggggccaccagtgcatagcccatgctgaagattcagacaggaacctctttccctgttcccagagaatgcggctgagaatgagaacgctgaagatgatccagtccactgaggatgggtcctgcttgcagaagctgccctttcacccatcttgacaagatccagccacccaggactcacccatgcctggtgttccagcttcagggggtgtgcgtggttcctaggtcctgtggacatcacagcttcaggcctgaagagcagagaagccctgttctctgcatgtaggaggtcagcaggggtgggcaggcccagctggaggcagctgggtgagggtcctggttccagcagagcactggggcccatccaagtttgttctgccgccactggatggaaaattggaaatggactgggcgtggtggctcacgcctgtggtcccagcagtttgggaggctgagttgggcagatcacctgagatcaggagttcgggaccagcctgggcaacatggtgaaaccctgtctctgctggaaatacaaaaattagccgggcatggtggcgtgcacctgtagtcccagctactcgggaggctggggcgggagaatcgcttgtacccgggaggcggaggttgtagtgagctgagatcgtgccactgcgctccagcctgggcaacagagccagactccgtctctaaacaaacaaacaaacaaacaaacaaataaagaaagaacattggacatggagaggtggggcctggcatgggtaaccatcagaggaaaaagccatgctcagccttccagttgagtgggtaacgactgagtctccagggaattcccagtgacctcccctccacacctgctgtgatcctgccaacatttagctttggttctcttggcagctgcaccattcatgggtgcatatacgtagagtctgaacaggtgctctgctgctagaaacagcagaccatctagattaaactcctaaagccagtgccacgaggcattcctgttccaactgggtgtttgagcagattggc

SEQ ID NO: 1640 - DNA, 1789 bp, Homo sapiens
acgtggtagcgcgggcagaccagggggcacgcgctgttgcgcagcaggccgcaggcgttggcgggcagcggcacggccggcagggtcggggtccacaccagggcgcagaggacggccgaggcgtgtctgggccggcagccctggtagcaggcggggaagaggtcggagaggcagcgctccacgctgaaggccgccagcagccagagccccaccgcgaaccacaggaagaacactggacagtaagatgttcttgataagagactttttccttccacggactgcgttccgcagctcctgggtggggtgcagagtgtgtcagctcaagccagaaattcggtcgtaaagatgctgtttctcttcatgtttctcaaatggactcggcttcggaaatcacttctgcaacacaaaccagcagcctgtgcagctctgggcgggggcatgccggctacccagctcccggcattgttgcacatggctttgaaacgcacggcacagctcgtgtggcccaggggcacctcctgccaccctgcctgctgcctccaccccagatgccggtcctcgctgctctccgggacctctcccggcgtggctccacctcctcctcgaggtcaccgtccaggcctgtttcaactagcgcctccaagccttgcttacctgcctcctgtttgggtgaaacttggagcatctctattaacttagttggtagctccggtcacctgcagtcaccaggggcccagagggacgcacagagggagaccggctgcctgggtcccttctggctgcctcaccatcaggtgcgggatgaggagctcagcctcagccacagtgcgcaaggtgaagagttttgatccctcgcacatcctcgagccaggcagggcgcccggcttctatcccaggtagcagagtctcctatcccaggtctccgacggcgaccgcaaccctttgcccgtggaggacttcccctgtctaagggccattgggagtgggatggcctaatttctggggtcgctttctattgggcacttcaaacagtgctgggcaagggcagtcgtttgaggcagcttggggtgaagttcttagggaggaggtcctgtgcagctccgccagccccggtcaggcccaggcagccaccaaccctggtttctccatcacccctgacccctcccacagccccttctcgtgtttgcccaccgtctaggccatgcttccactttctcacctggctgggtatcccctatggggcacgggtgtcggccccgcagaggctgggctttggtctgtcttgttctctctgggaggggtctggtgcgggtggaatacgtggagggagcctccgtagggggagcaactgctcccggtgttgcaaggaggacagagccaatgcccgccccatcgtgtcatggccgacggtggcctcagaagatgtgtccacgtcccagtcgctggaagctgtgcacgagctcttcctggagaaaaggcccttggcagatacaaggattttgagatgagctcgtcctggagtatctgtgtgggccctaaatgcaatgacaagtgtccctatacaggaaaggagaggagggacactggagagcagggggaggccacgtgaggttggaggccagcaggggttacacagccacaggccaaggagggccagagccaccagaagctgaaagagatgaggaagcaccttcccctggagccctcagggagcgcggccctgctgccaccttgatctcagacttctgtcctctgtaaccaagggaataaagtcctgctgtgtgaagcc

SEQ ID NO: 1641 - DNA, 2354 bp, Homo sapiens
gtgcgaaggaaaccgatggggatcggaaccgtagcggttgagctgctgctgctacggatatctgacagaagccttcggtggttgtcggcctaatgagcggacggcaaagaacgctttttcagacgtggggctcaagtatctcccgatcatctgggactccgggttgcagctccggaactgagcgacctcagagccctggcagctccaaggcgcctttgccagcagcagcggaggctcagctggagtcggacgatgatgtgttgcttgtcgcggcgtacgaggctgagcggcagttctgtctagagaatggcgggttctgcacctccgcgggcgccctgtggatttaccctaccaattgcccagtgcgggactaccagctgcacatttcccgggctgctctgttttgcaatacgctggtgtgtctgcctaccggactgggaaagacctttattgccgccgtggtcatgtacaatttctaccgctggttcccttcaggaaaggtggtcttcatggccccaacgaaacccttggtgacacagcagatcgaggcttgctaccaggtgatgggtatcccgcaatcccacatggccgaaatgacagggtctacacaagcttccaccaggaaggaaatatggtgcagtaagagagtgctttttcttacacctcaggtcatggtaaatgacctttctagaggagcttgtcccgctgctgaaataaagtgtttagttattgatgaagctcataaagctctcggaaactatgcttattgccaggttgtaagagaactagtcaaatatacaaatcactttagaatcttggctctaagtgccacaccaggtagtgatataaaggctgtgcaacaagttattactaacctgctaattgggcagatagagcttcgttctgaagattctccagatattttgacatattctcatgaaagaaaagttgaaaagcttattgttccgcttggtgaagaacttgcagccatccaaaagacctatatccagattttggaatcatttgctcgttctttgattcagaggaatgttttgatgagaagggatatcccaaatctaacaaaatatcagataattctggcaagagatcagtttaggaaaaacccatctccgaatattgtgggaatacaacaaggcataatcgagggagagtttgctatttgtattagtttatatcatggttatgaattattgcagcaaatgggaatgagatcattatatttcttcctttgtggaattatggatggaactaaagggatgacacggtcaaaaaatgaacttggccgaaatgaagacttcatgaaactctataatcatctagagtgtatgtttgcacgtacacgtagtacttcagcaaatggtatttctgctatccaacaaggagataaaaataaaaaatttgtttatagtcatccaaagttaaagaaattagaagaagttgtaattgaacacttcaagtcatggaatgctgaaaacactactgaaaagaaacgtgatgagacccgagttatgatcttctcttcatttcgagatagtgttcaagaaattgcagaaatgctttcacagcatcagccaattattagagtaatgacttttgtcggccatgcctcagggaaaagcacgaagggttttacccagaaggagcaactggaggtagtgaaacagtttcgtgacggtggttacaacacgctggtttctacctgtgtgggtgaagaaggtttggatataggagaagttgatcttataatatgttttgattcccagaagagcccaattcgtcttgtacaacgaatgggtagaactggccgtaaacgtcaaggcaggatagttattatcctttctgaaggacgagaggaacgtatttataatcagagtcagtccaacaaaagaagtatatataaagctatttcaagtaacaggcaggtccttcatttttaccaaagaagtccacgaatggttcctgatggaatcaacccaaaattacacaaaatgttcatcacacatggtgtctatgaaccagagaagccttctcggaacttgcagcgaaagtcatctatcttttcctatagggatggtaaataaattttgcatttgacacatgcatttttcccctgttcttacttagcaggtcgtatcttgatataatatttcttgtttgaaaaactgaatatatgttctaattaatatattataggcattctctttggaaaggctgtacgagattattcatgtggcaaatggagagacactggtagtatagagtgacagaaactcagtgttggggaaaattaaacataccctaccaacccagagaatgttctccataaagtttag

SEQ ID NO: 1642 - DNA, 2165 bp, Homo sapiens
agatggccacctcctccctgtgtctacacgtggtcttcactcctcctttgtcatcttaatctcttcttctgataaggacacccaccagtctgaccatattggagccccgccacgtgagctcagttaactgtacctctctagagaccctatttccgaacacagtcacgttctgaggtatgggtgagtaggacttcaacctatggttttaagggggacagaattcatccagtcatagtcaccaagcttccctgaagctctactagtctggcatagagaaatcagagtgagccaagatcaaaatctgagggcaaccttggctttccccttctacacagaattggatgacagctaggagatggatctatgaattttctcccctgagaaaccagacgggaccacctagagtcggtctccttcccccaaacgccctggacctaccatgggcacaagctggggctcagggaatacctctgtgctccaccactcagcagctgcttttcaagagaaggaaaacactactacacgccatccacagccaccgcacaatactgtatccctttgtcagggataataaaacagacgggaagtcactctggaacttactatggccttgggtcaaaggcaggctgaccggggctggcagaagaaagctaaaacttacttctctgggattctaggaatttcaacaaatgagaccaacagcagatagtttcagattaaagaaaggcaatgtgttcccaaactttgacccctgtgcacaggctctgcagaaaagctgtcactttgcactcagtttccttataggtaaaatggggataataatattgtctgtctgcctaatttgtacaaggctcttacaagagggtatagcacaaagtaagtgcttaataaatgtgagcttttctttgtattcctgtttcatagtatttgtaactatttcacaagattcagaaaccttgtccctggactgtgatcatcgccttttcttcagtcttccattcacagacccagcctctggtgggcagtcacaacacagctggccatgtccagagaggtccaaaaacctgccccaggtgtcaaagcagctaagaaacagggccgggtgagactctgcctgactctttcattctgccaaatctaagctaagcagtgattcctatgcccacctgggaggggagaaacctgaggcccaccttgtaaatccctacaggctcagtgtgcctggcattgggatgggcagaggagacagagggaatgccaaaaaaagagcagttacaaaggacagaccacaggtccaggatgaggggactttcaacggcttgttcgtggttccgtttttgcccaaactctctcgatccacctttgagcaacagtaattatctctttgcctccatcaactccatttaccatccctgtccaattctttcccaataagccagagaataagagtgcagacattaaaggtcagattttcatggtgctgaacccatttaacccagctgtgtggctttgagtaagctacctaagctctctgagcctccatttcctcgtgtgcaaaccaaggaaaatactcacctacttattagaaggaaagaaaagactgagtacctgccatgtgacaggctttcaacaagggaccacctcttgtcataaacaagaggcacatgaacaagtgaccacgggtttaacttgtacacaggtattatgaaaacaacaagtctgcatttcaataaatatttgttatataaatgaacgggactgttcccagagcctgctgcttggaggaagctagggaataaggaactcaaaaacaaggtaagaatgtcagagcagggaagggaagggaggagggagggagtcgtgaccttgggtcaaaggtaggctgaccgatgctggcagaagaaaacttaaacttacttttctgggattctaggaattccaacaagtgacaccaacaacagatactttcaaattaaagaaaggcattgttcccaaactttggcccctgtgcacaagctctgcagaaaagctatcactttgtactcagtttccttgtagatcaaatggggataataatattgcctgtctgcctaatttgtatgaagctcttacaagagggtccagcacatatagtaggtgctcaataaatgtgagctcttctttgt

SEQ ID NO: 1643 - DNA, 2528 bp, Homo sapiens
aaaactcactgaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcgctacagaaagatctagaagaggtaaaggtgttgctggaaaaggctactaggaaaagagtacgtgatgcccttacagctgaaaaatccaagattgagacagaaatcaagaacaagatgcaacaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcattagaacagttttatgatttatttgtctaggagtatgtcagaaaaatcaggcttttagtaggaattactcctattccccctgaagtcaggaccagtgcctgtgatctccattactttattttcctggaggtattagccaacacagttagatcggagaaagcaattgaagccaggcatgaaggctggcgcccgtaatcccagctactaaggctggaggatcacttcagcccaggagtttaaggctgcagtgagctatgatgatgccactgtactgcagcttgggtaacagattgagaacctgtctcattaaaaaaaaaaaaaagccgttagacacacaggaaaaatccagaagggtaaactaaactaaagctacaattaatacgggaatttggaagaagtggtaggatttaaaatacagaaacagtttatgtataggatagctataagtaaatactgaaacacattatgcctctgtaattggggttgacacatgaacagaatagcagacacaatgcatatgaaagttacagaatatggtaaaagtggggtaaagatgggtttttaatgatactaagataactgaaaataggcatatagatatattccaagccgcctgacgatctaattgtaaaaagtaaagcatacaaatactagaagaaaatggaggaaaacgacattatatgtgacttaaaacctagaagaaataaataaaactattgatcaattttaactacataaaaatgtttataggacaagaaaaaccccaccataacccaaggcaaacaatgtattgacaggattccaataattaagaatacttcatacaaaaagaaatgtaaatgacctttaacatgtaaagatgctcaccttgttcagaagagaataaaccagtgtttttacctttcacttg

SEQ ID NO: 1644 - DNA, 2176 bp, Homo sapiens
ttctgttaacatttaggcaaagtttgattcttaatggaaattttttaaccatcaaacctctcgtgtggttacctccagattttgtctagtgtactcccatgctcagcacgcatgtgaccaatttcttgatgtctgtatgtagaaaggctgggcccccggcttggggatgcgttccagatggggagatgagggtgcagcgccaggccacgctcccaccccacctcacccctgggttgcttctctcctgcagtgagtacaaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcaggtaggcagccttgctgctaggggatgattccagatgggccccagatggggcctactcagggccccagggctggttcagcctacctccctctcagggctgctactgagcaggcacacagatacaaccactctggttgttaaaatactgcaatactttgtttttcttttgagacggagtgtcgccctgtcgcccagactggagtgcagtggcccgatctccgttcactgcaacttctgcctcctgggttcaagcgattctcctgccttagactccctagtagctgggattacaggcacgcacctccactccctggctaatttttgtatttttagtagagatgggggggcttcaccatgttggtcaggctggtctcaaactcctgaccttgtgatccacccgcctcggcctcccaaagtgctgggattgcaggcgtgagccaccacacctggccgaaaatactgcaatacttctatattggttggtaaatagcctttgcccccagtgcccactccagccactctgacgcctgtccgccagcccacttcagctcctatgcatggaccccgtcctaccagccagagtgagtggggccaggggagtcatctttttccgttgcgggtacccacctgccgctggccagcattgccccagaggcatccttgggtggctgcttgtataaactgcaaggtccacaaagtgttgaacaagttgttgaatgttttggccaacactgcacctgctgtcttccctacagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgtcacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttac

SEQ ID NO: 1645 - DNA, 1686 bp, Homo sapiens
actgaatggttcgctaggtttcacaacacggaggacactgacaaacttgaaaggagccatctgggtggggtggtaaggagacaatgtcctcagagtgagtacaagagagaacggggtaaagaaattgaacccagccagtagggtaggctctttcaaggaattacgttgttaagagaaataaggcagtagctgagaggaaaatggggctgtgaggctttaagatgagaaaaacaaaggcgtcttcactgaagcatgactctgtatgacatcctttcacaaaataccttcctctttcctctcatgccacatttccctcacaagccgcccgactcgctcgcttttctctcgccagagggactgaaaacgtcattaataccaactgcatacacaactccattgcagctactgccattcatgaacgttcaaactttcgtcaccctgttttcatatttgtgtaacaaacgtcgagtgaacgaacctccacctcttccaagaacccacgctgaggaggcttcccatagaccctgctcttacgaagccaacgacttctacaggaagaaagaggacctgtaagctagcgagtgaacgacccgcaagatggaaatgagtgcgctaatagaggtctccgcctcccgctgaaggagcagggaagtgaccccacccccgggaccgccagccttctacaacaaccaccatttctgaggaaccacctgatcagtctcagtcacccttcaatctgcccctttgtcccaactcctcagcgggtctcgcctcccctccccacctctgtcccccaagggtcccactaccggcccgagctgccctcccttcctctcggctggaggcccccgcgctctctgtggtcagcccctgccgcccctcgggcggcgctgctctagctctgcagccttcccgggatcccgcgccgcgcggccccgcccccgcggtcacctgaccgagcccgacgctccgcccaccgaccaccccgagcggagcgggcccaggaccctatcggctgtcgagccggtgctgccgcggccaccgccaccgcccaggggctccggggctgtggggagcggctgaactcaataccgcctccgcgctgactggaaggcactgcggccgcgcctgcctgccccacctcgtaagggcctgtgacctcacgaggccagccgccgggcgctgcattcgagcggtggggctcctgtccgtgcgctttcctcccgcagccccggccgggattccgccctccgtccttgccacccgctcgccactcttccctaatcgctgttcattctccggtgcgctgtcccgccatggtctgaccccacttcaatcttatcttcggtccgtcctttgaacaccccgacccccgacccctttcttccaaaacattccatccttcttggcttctgctactcaataatggacagcagctcgaaggccatgtgtcccacggctttgctgaaatttgtctcgggttgcctttaaggagactgtcgtttccttttgaaagagatactttggttggtttggttttcttctgtgtgtttgtttttcctatgtatttatcgtatgcagttgggcaaaatacttaacgctccctgagtctcgattttctcattcttccagggttgtgggaattcaaaaatatatacgtagtgctcaataaatgttacaatattt

SEQ ID NO: 1646 - DNA, 2542 bp, Homo sapiens
accggctctgtctggatcctgcgacagggaggccctggactggagcccctcacctctgcaccgcacccctcagccagcagcgcctctgccctgaccctggagcctgccctgactcatgccagtggagtctgtgggggccatggagcccctgccaggtgccctgcagtggggggttcaggctacgctggagagaggcagaggccctctgtggaggaggcttccgggagccatgggctcaagacagaaagctgcaacggagggccctgcccaggtgagagctgcgaggcccaagacactgtattcaccctggactgtgccaaccagtgcccacacagctgtgccgacctctgggaccgcgttcagtgtctgcagggaccctgccgcccaggctgccgctgtccccctggccagctggtccaggatgggcgctgtgtgccgatctcctcttgccgctgtggcctccccagtgccaatgcctcttgggagctggccccggcccaggcggtgcagctggactgccaaaactgcacctgtgtcaacgagtccctggtgtgcccacaccaggagtgtccagttcttgggccttggtcagcctggagcagttgctcggccccctgtggtgggggcactatggagcgacgtcggacttgtgaggggggtcctggggtggcaccatgccaggcccaggacacagagcaacggcaggagtgtaacctgcagccctgccctgagtgcccccctggccaggtgcttagtgcctgtgccacctcatgcccgtgcctctgctggcatctgcagcctggtgccatctgtgtgcaggagccctgccagcctggctgtggctgccctggagggcagtgtctgccacggtggagccttcagctgctccctcgttgactgtcagggtgagatgtggctgtccatgccctgctgcacctccaaagtcaaggcccgggactggcactgaggaggagagacgggccctgctcacagactagacagagcttcagaaagccctcccctgtctgtccacactgacctctctctaactggagacccagcaccccctgccgagggctccctgggcactcagtgtggtctgccccacttgtgggggcattccctagcacacagtatacacagagccagggctgtgatgccaggaagtggaaggttctttccctgccagtgaggaaactgaggtctggaggggtgagcggaaatgaggggcctggcctggcagcccccgggctgatagcatttgccctgtggggtgcagtgttacccccatctgatcaagaccaagggcccacccaccgtgttcccagctctgccacgctgggctctgtgaatgcagacatgcagcatggccagcctccgggcagaccacccacccccagaacaggcagagacagggcacagtctctaggtctctgacaggcaggtagaaccccagagggtgagacatcagtgctgagaatagaggccgagtggacaggattggtcagggagccttttctggaggaggtgagacctggcctgggtccagctagtgtttgggtgggtggataagaaagatcaggaggtgtggttggaggctgctgtggctgagaaggcaagatggggacgtgtgggtgctcagcttgggaggggaggaatcgaggctggatccagggctgacctgaaagctgggttggatggtcttccctggcagagtgccccctggggaaacgtggcagcaggtggccccgggggagctggggctctgcgagcagacgtgcctggagatgaacgccacaaagacccagagtaactgcagttcagctcgagcctcgggctgcgtgtgccagcccgggcacttccgcagccaggcaggcccctgcgtccccgaagaccactgcgagtgctggcaccttgggcgtccccacctgcctggatctgaatggcaggaggcctgtgagagctgcctctgcctcagtgggaggcctgtctgcacccagcactgctccccactcacctgtgctcagggcgaggagatggtgctggagccagggagctgctgtccctcttgccgcagggaggctccggaggagcagtcgccctcctgccagctcctcacggagctttgaaacttcaccaaagggacctgttacctggaccaggtagaagtgagctactgcagtgggtactgcccatccagcacccatgtcatgccagaggagccatacctgcagagccagtgtgactgctgcagctaccgtctagacccggagagccctgtgcggatcctgaacctgcgctgtctgggtggccacacagagcccgtggtgctgccggtcatccacagctgccagtgcagctcctgccagggaggtgacttctcaaagcgctaacaggctccgctgggtgagtccacagctgtccctcttgtgatcatgggactcagcagcactgaccacgtccttccacgctctctcacctgcccccaactgggggcccatgacttggcattagcatgttccaaataaagtgatactggcaa

SEQ ID NO: 1647 - DNA, 2029 bp, Homo sapiens
gcacccctcccccaggcaccaaccccgccaggtcgcgggcactcccaccagctcgcagccctccttcggaccctcgatccgagagcgccccagccagagcttgtgcccatgcccctgtcccgcaggggaaggggatcccgcctggccggctctcgagcggcgactagtaacctcccgcgggcgacagccctctccccaaagagtgccggccgcggggccctgtctataagccacgcgcaactcctcacccggcggcgccattcctccgagcaggtcccgccggagtccgagccgcgggctgacttccgctcgggaaagtggctccaagagcccgccacaggggacgccagggactcgcggcaggctctgcgggccaggatgagttctaagcacaggatctgtagtcaggaagaagtagtgatcccctgtgcctatgacagtgattcagaaagtgtggatttggagctgagcaacttagagattattaaaaaaggctcaagtagcattgaactgacagacttggacatccctgacatccctggactccattgtgagcccctgtcacatagccccagacacctgacccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccgcaaaatcattcattcacagccacatagcagacattgtgcataccttaaatgtactggtacaagaggaacgcccgcattctctgtccagttccatgcgccaggaggtctttgtcaccatcgctgatctcagttaccaagatgtccatttgctgttgggctctgaagatcgagctgagttgttcagtcttaccatcaagagtataatcactctgccctctgtaaggacccttacccagatacaggaaatcatgcccaatgggacctgcaacacagagtgtctttacaggcagacgtttcaggcattctctgagatgctccagagtttggtggtaaaagacccacatttggaaaatcttgacaccattattaagcttccactgcgattccaaagacttggacacctagtggctctgatggcactgctctgtggggacccacaggaaaaggtggctgaggaggctgcagagggcattcactccctgctgcatatcaccctgaggctgaagtatatcactcatgacaagaaagatcagcaaaacttgaaaagagcattgacaaaatgtcgagaattcctggagctccacagctctgccgctaaatgcttctacaactgtcccttcagaattgcccaggtctttgaaggttttcttgattcaaatgagctctgccagtttataatgactacatttgataccctgaaaaacctgaaacatccctgcatccagcgatcagcaggagaattactgctaactttggcgaaaaatacagagtcccaatttgagaaggtgccagaaattatgggagttatctgtgcccagttatccataatcagccagcctagagtccgccaacaaatcataaataccgtgagtttatttatatccagacccaagtacacagatatagtgctcagcttccttctgtgtcatccagtgccgtataacaggcacctggctgaggtgtggagaatgctgtcggtggagcttcccagcacgacctggattctgtggaggctcctgaggaagctgcagaaatgccataatgagcctgcacaggagaagatggcatatgtggctgtggctgtaagcccttgagctttgcccctctaatgtcagcccctcccaggatgactgaccccacaccccagcggagagtgttccttttggtccctctcaaagcctgcatctgtcatccatttataagtctacagtgtttctgccaagggattgacatggagggagctggggagagtgaaggagtcagaatgccttaatacaaactcgtccaacctgc

SEQ ID NO: 1648 - DNA, 2493 bp, Homo sapiens
gtagaaggcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccaggtgccttgccagatggccagaaccacacctcttgaagagtgacaggtgccagtgtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccgggggtctttgtgttggtatttatgccaccaactctgccgaggtttgtcaatatgtcatcactcatgccaaagtgaacatcttgctggttgagaatgatcaacagttacagaaaatcctttcgattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggttatctggaaagtgagactgagactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatcttt

SEQ ID NO: 1649 - DNA, 2288 bp, Homo sapiens
ttttacttatcaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactggaatgtagaactatctcaatggggcaaggacaagaagtacatgctcgaaagctgattcagatgtcaatgcagcagggtggttgggtattactacaaaattgccaccttggcctggaattcatggaagaattactagagacgctaattaccactgaagccagtgatgattctttccgagtatggataactacggagccccatgatcgatttccaattacattgcttcagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggagcgacgaaaatttggccccttaggatggaatattccctacgaattcaattctgctgacttttcagccagtgttcagtttattcagaatcaccttgatgaatgcgatattaagaaaggtgtatcatggaatatggttcggtacatgatcggagaagtacaatatggaggcagagtgacagatgactttgacaaacgtctacttaattgctttgccagagtctggttcagtgagaagatgtttgaaccgtcattctgcttttatactggatataaaatccccttatgcaaaaccttagaccagtattttgaatacatccagtcactgccatccctagataaccctgaagtctttgggcttcaccctaatgctgatatcacgtatcagagtaacactgcttctgctgttcttgaaacaattaccaacattcaacccaaagagagtggaggtggtgtgggagagacccgggaggctattgtttatagattatctgaagatatgctgagtaaactccctcctgattacattcctcatgaggtgaaatctcgtttgataaagatgggccatcttaattcaatgaacatatttcttagacaagaaattgacagaatgcaaagagtcatttcaacactccgcagtagcctgagtgatctaaaattggccattgaaggaacaatcattatgagtgagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgtgttttggatgactggtttctttaatccccaaggcttcctcacagcaatgaggcaagaagtgacccgtgcccacaaaggctgggcactggacactgtgaccgtccacaatgaagttctgagacagaccaaggaggagatcacgtcaccccctggggaaggtgtgtatatttatgggctctacatggatggagcagcctgggacagacggaatgggaagctcatggaatccacccccaaggtactcttcacgcagttacccgtgctccacatctttgccattaactccacggcacccaaggaccccaagctgtatgtgtgtcctatttacaagaaacccaggcgaactgatttgaccttcatcactgtggtatatttacgaacagtgttgtccccggatcactggatcctgagaggagtggcccttttgtgtgacatcaagtaagttcatttccatctgctcagggcaccagaacccacatagacagcctgtgctattgagggactcagtgatgtgtgtgtcttttctccccagtaattccttaattactctttctacattaaaaagttgatgttctaaaattgctagtgcgtgtgtgttttcctcacatatcaatattcaaaaagataactctaaatgaatgttttttattctgggaaatcatatttcactataattactttttaaagataaaaccctgtttggatgttagaacactttggaagctctgaattttaaaaatttgaaagtgttgatatgtgacatcctaaaaagagcctagtagttgtaaacttttccctcaagtaggtaccaatttcccttgaataaaatctagccatgtct

SEQ ID NO: 1650 - DNA, 1819 bp, Homo sapiens
atttacaaaatgttcatggcagggcccacttcacagggctgtgaggattacagaggataatctgggtgaggcgcatcagccccagcgccgcctgccacaattctatccggccccacatatgcatcgtccataagcgtccggcccctgcattctcgcttttccacgtggccgaggtgcacaccccaacccactgggccagtctccccgccctcttacctgctcttctttcccgactcgtctttaatacccaccaggagccagtcgccgcgggcctggctctgtggtggcaagttgcatgggttctcccatcaggacctcccgatgagcctacgaggtcggttctattactgtcgccacttcagagggaggaaacaggcccgcagggttggggaacttcccgaggtcactgaactggtgtcaggcccagattggaatccaaacacatcccagcccatgcccggctccccagcgccggctcccaggcgtcttcccgggtgccagcggcacccgcatccattcaaatgctgcccagtccccgctcctcagtcgcttccctctactacgcgcccgcatctccccccgacccctcagggtcaggcctctcggtggcttttcctttttctcttccagaaactaaggggtgagaccgacgtttgtgtgccggacgcgtgcaggtggcggcgacgctcccgggagacgcggggggagaaccagtctgtgcgcgcggctgtgagaagccccgaccaagctttccacgcgcttgtttcgggcagcagaggacgcgagggccgactgcgtccccagtgcgcaggctcggccgggggcgcgtaatcaggcagcccagcggtcccttcaaaccgaggcagggaagctctacgtcttgggggccgcatggtgccgagagcgcagaccagacccgccccgcctctccgtgccacgcacgcgctcggctccgcgcttaatggctggagtgcagtggcgcgatctcggctcatcgcaacctccatctcccgggttcaagcaattctctgcctcagcctcccgagtggctgggattacagaagcagtatctgactgtgttgcccaggctggtcttgaactcctggtctcaaatgattctcctgctttggcctcctaaagtgctgggattacagacatatttattcaatttttaatgtcagaccataagcaacgcgaatgaaatttggtgccatcactcggatcaggggacctcccttgggagatcaatcccctgtcctcctgctctttgctccatgagaaagatccacctacgatctctgctcctcagaccaaccagcccaaggaacatctcaccaattttaaatcggatcttctcagcttagcggctgaagactgatgctgccagatgactttggaagccccctggaccatcacagatgcccagctttggataactcttacagtggaggaagacaggaatatcaggtctctgagcccaagctaagccatcatatcccctgtgacctgcatgtatgcatccagatggcctgaagtaactgaagaatcacaaaagaagtgaaaatggcgcgtgcctgccttaactgatgacattaccttgtgaaattccttctcctggctcatcctggctcaaaagctcccccactgagcaccttgtgacccccactcctgcctaacagagaacaatcccctttgactgtaatttcccactacctacccaaatcctataaaacggccccacccctatctccattcactgactctttttggactcagcccacctgcacccaggtgaaataaacagccttgttgctcacac

SEQ ID NO: 1651 - DNA, 2111 bp, Homo sapiens
acagcccggcccctgccctgcaccaggccactgccctgttggtgaggagggtcggaggggcgacctccctgccccctgctccaagctccccacccccacctggaacctgccggcaggaagcctggccctggagggtggtcacggcccctccccagatgcccggcccacgagaggccaatggggagcagccaggaggagggactccggtgtcagccaagccagccagaccacgacgcagatggacactgtgggccggacctggagggggcggaaagagcctctgccacacccggaccccctgggctcctgaacagccaccggcctgcagactcggatgacactaacgccgccgggccctcagctgccctcctggaggggctcctgctggggggtgggaagccatcgccccacagcacccggccggggcccttcttctacattggaggcagcaacggggccacaatcatcagctcctactgcaaaagcaagggctggcagcgcatccatgacagccgccgggacgactacacgctgaagtggtgtgaggtcaagagccgagacagctacggcagcttccgggaaggagagcagctgctgtaccagcttcccaacaacaagctcctcaccaccaagatcgggctgctcagcacccttcggggacgggcacgggccatgagcagggccagcaaggtgccggggggggtccaggccaggctggaaaaggacgcagcagcgcccgccctggaggacctcccgtggacaagcccaggatacctcaggccacagagggtcctgagaatggaagagtttttcccagagacctaccgcctggacctcaaacacgagagagaggcctttttcaccttgtttgatgaaacccagatatggatctgcaagcccacagcctccaaccagggcaaaggcatcttcctgctccggaaccaggaggaagttgccgccctgcaggccaagacccggagcatggaggacgaccccatccaccacaagacgccgttccgggggcctcaggcgcgggtggtgcagaggtacatccagaacccgctgctggtggacgggagaaagtttgacgtgcgctcctacctgctcattgcctgcaccacaccctacatgatcttctttggccacggctatgctcgcctcacccttagcctttacgacccccattccagcgacctcggcggccacttgaccaaccagttcatgcagaagaagagccctctgtacatgctgctgaaggagcacacggtgtggagcatggaacatctcaaccgctacatcagtgacacgttctggaaggcccggggcctcgccaaggactgggtcttcaccaccctcaaggtgcgtccactgtgccctccagtctgggagtgagatccctcggggcgggggtgtgtggtcaggctgggcaccaggcacacagatgtccgtggcgtgcgtgggcggctgcgctgaagtgtgacctgaccgtgtggaaccaaacccttccagcgtctctgctcacttagctggcagtgcctgtccccagcagccagcaaaggcccggacggaaagcccagtcgggggtctgtcggcacgagtcccgcgggcagcctcgccgtagggtcaggggacagctcggcttcagtgacagccaccatgtgaagagtctttgttcctttcagatcctccacttggcaggcagggccaacagcagcccccgggccaggtgtcctggagcagcagcagctgcccgtgcaggcccggactctccctagctaagggccatgtgcggtggagtgtcctaattttgcagggttcctttctgtgggggtacctgtggggtacttcaaacagccctagcagcaaaggcccttgagcagcgcggtgtgaaactgggataaaaacggggcttggccgaaggacttttatctgtcttggtcaccccggccaggccccggaagcagcagccagggatggtccttcctcacccacaggcgtgtgtcactgtggctgggacggcagcgctcagaggagcctccagttactttcctcacatctcccaaactctctcttaattgcgataattcacagaacataaaattcacgatctt

SEQ ID NO: 1652 - DNA, 1984 bp, Homo sapiens
agaataaacatttctgggaatggggtctaggaatttatttttaaccaactccccagagtctagtaatgactgcgaagataatccaacacggaacagagggttttccaagagaggcgataatgacttagacccagacgaatgtatgcagcgcactggtggcctttttggttctagaagaccagtattaagtggcacaggtaatggtgatacttctcaaagcagaagtggcagtggaagtgaacgagattcttggaagtcagaagcagaaggaggagaaagtagtgatactcgaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtc

SEQ ID NO: 1653 - DNA, 2302 bp, Homo sapiens
aagctttcttcctgtctcttcgatttaccaatgcctcatcagaaactttcagcacttattgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcagggggatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccacgtcctgtggccaaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgtttgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaaggatttctctgaaggatccagagttgtctcctatggtccatgcagaattttctgtttagtgggcaggtgttattcctgcccacagcaaagcttggacttgcagcttgcttgctgcattttgaattgtcaaagccaactaataccgtgacccgactgatacctctaaccccactcactggatgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttgaaaaaaaatatgaaatgtgtgctcaactgccagtaattttttaaaaagcactgtcccagtggattgatgttgtttttaatggatattttgggtttttctctgttttgatagtattgggtatttggttgtttttgtttgtttatttctttgttttaaaagccatgtttttggttgggctctaagctagatatctttccctctttttcactttgagctttgggaaaactctttatcttatgaggctgtattcctcaatacctaatttgtgtccaaagaatttatagcttttctggacattttttattatttcttgggtgtgacatcagagtatttgacctgcagtattgaaaaaggagaattcagaatgatacagtattttaacaaatcttaattattaaactcttttccttccttccatttctccctcccttgtccatctctctctctctttccctttcctcagtgatgtgaaaataattgtgttttgctg

SEQ ID NO: 1654 - DNA, 1847 bp, Homo sapiens
agaaacgcgcgcagcgggggcgggaggtcggtaagctccccgcccctgcccgagaccccgccccggcccggccccgcctttttctctgcctcccctccctgcacgtacgggccccgcccctcgcgcgacgttttttgttgacccggaaacggattctccggagccgaggtccgctcggatttgtcttcttagtgcttggatggtgtgagtgaaaacccagaggaatacatttggtggctgagctagtacaatgccatcaccggattccatgaccttcgaggatatcattgtagacttcactcaagaagagtgggccctgctggacacatcccagagaaagctgtttcaagatgtgatgttggagaacatcagtcatctggtctctattggcaaacagctctgcaaatcagttgtgctttcccaattggagcaagtagagaaactttcaacacaaagaataagcttactgcaaagtgagctctaagaagcagtgcttcaataggaggaggagaaacatggccagtgagtagagaagttggcattaaacatcaagagataccattcattcaacatatctatcagaagggcacgtccaccatcagcacaatgagatctcatactcaagaggatccttttctatgcaatgacttaggagaagatttcactcaacatatagcattgactcaaaatgtgattacctacatgagaacgaaacactttgtaagcaaaaagtttgggaaaatcttcagtgactggttatcctttaatcaacacaaggaaattcacaccaaatgtaaatcatatggaagtcatctatttgattatgcctttatccaaaactctgcccttagaccacacagtgtgactcacactagagagataacattggaatgtcgtgtgtgtgggaaaacctttagcaaaaattctaatcttaggcgacatgagatgattcacactggagagaaaccacacggatgtcatctatgtgggaaagcctttactcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttg

SEQ ID NO: 1655 - DNA, 2539 bp, Homo sapiens
gcgcatgcagcccttcccaagcactggtagggcactgggcatgcagacagcccaccagaagggaagaatcaggagaaaagggatgcaagatcccagagataaactgaagcacaagggtaaaaactttgtccttggtcttacagccagaaagtggtgatgcaaagaacttagtccaagctttgatctgttctgcactgcctgccaaagcagaaccttgagaaatacccatgtttgggggatgagaagaagaagataaatcagcaaagaaaatagtgataagaaagatgcagaacccagggatatggagagccaattgtatttgtaaaacacttagaatggtgcctgacacgtgagttgctttgtctaattctagccctgtggtagctacccaagattgttgtaacctccagtgatcaagttctttggataagcaaagagggggggcattaagtgtgtggaaaagacccctcctctccactcttgttgcaaggactcaggatcctgccctctgagggtttacagaagtcattctcactatctcacactggccgtcttgacccagagcagttctttactttctcgggacacaaacgggatgaaagtccagggctgggacttcctccttggaatgtttgacaaggactgacgtactctaggccctttgaatcccggaagtccaggacacacccaaccttgattacagtgtccagaatgctggagcgtaggtgaaaggacaaaagccagacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccaggtaacccacagcatctgcctatatgccttttgggtcaaaagagcctggggaaagtgtgtgagtgatttaagataccaagacatattccttcctggaaatctccctccactatggtttggatatgacatagtcaagaggctaatcatgagactttgttcagtctgtcttcagagcattctggagctggagaaggaaagaattcaacttttatgcgataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaagaaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttacctttaaaaaag

SEQ ID NO: 1656 - DNA, 1731 bp, Homo sapiens
agcttccttggctggcatggcggcgagcgcgctgcgaggcctgccagtggctggcggaggcgagagtagcgagagcgaggatgatggctgggagattgggtatctcgaccggacgtctcagaaattgaaaaggctattacccattgaagaaaagaaagaaaaatttaagaaagcaatgaccatcggagatgtttcattggtccaggagctcctagattctggcattagtgtagattccaactttcagtatggatggactccccttatgtatgctgctagtgttgccaatgcagagctggttcgggtccttttggacagaggtgctaatgcaagctttgagaaggataagcaaagtattttgataactgcatgttctgctcatggctcagaggaacagatcttgaagtgtgtagaactactactttcaagaaatgctgatccaaatgttgcttgtaggagacttatgaccccaatcatgtatgctgctcgagatggtcacacccaggttgttgctctccttgttgctcatggagcagaagttaatacccaggatgagaatggttacactgctttaacgtgggcagcacgtcagggtcataaaaatatagttttgaagttgcttgaacttggagctaataaaatgctacaaaccaaagatggaaagatgccaagtgagattgcaaaaagaaacaaacatcatgagatcttcaacttactttcttttactttaaatccattggaaggaaaacttcaacagctaactaaagaagacactatttgtaaaatattgacaacagattctgatagagaaaaagatcacatttttagttcatatacagcatttggagatctggaagtatttttacatggtcttggacttgaacatatgacagatttactaaaggaaagggatataacgttaagacatcttttgaccatgagggaagatgaatttacaaagaatggaattaccagtaaagaccagcagaaaattctggctgctcttaaagaactacaggtagaagagatacaatttggagagctatctgaagagacaaagttggaaatcagtggtgatgagttcctcaactttcttctcaaattaaataaacagtgtggccatttaataacagctgtacagaatgttattactgagttacctgtaaattctcaaaagataacactggaatgggcttctccccagaattttacttcagtttgtgaagaattggttaataatgttgaagatttgagtgaaaaggtctgcaaactaaaagacctaattcaaaagttgcaaaatgaacgggaaaatgatccaactcatatacaattaagggaagaagtatctacatggaatagtagaattttgaagaggacagctattaccatatgcggattcggttttcttcttttcatttgcaagctaactttccagaggaaataatccaaatatttgttttaagttatatatacacatcttattgaaccatccaaaaatcattgcttttaactgtttgcagcacaatataactttacattctttgccaatattccataggaaaaattttgacaatgtggagtttttttttaaaaagtggtttgttactttgacttataaatacaatttgttatgtttatgttaattgtgattaggtagtaaagtataagtaattttttggtttgatcgtatctaaatcacattcaaaattaaagttatatctaatatctttg

SEQ ID NO: 1657 - DNA, 1619 bp, Homo sapiens
gacgcagtcggcgcggcggccctagcgacgcggttactagggagcggcgagccgagacggctacatggacgccactatcgccccgcaccgtatcccccccgagatgccccagtacggggaggagaaccacatcttcgagttgatgcagtgcccaggattgtaatattaggtccacccgcctcagggaaaacaacaatagcaatgtggctctgcaaacatctgaacagcagtctcctcaccctggagaacctgatcttaaatgagttttcctatacggccaccgaagccagaaggctttatctgcaaaggaagacagttcccagcgcgctgctcgtccagctgattcaggaacgcctggctgaagaggattgcatcaagcagttggaagtttcttgtaatagccgctttcgagttttcatccgctaattccagtatctgagttacgtggtggtgacatctgtatctgctctcatggctggattctggatggcatccctgagacgcgtgagcaggctctgaggatccagaccctggggatcacacccagacacgtcattgtgctgagtgctccagacacggtcctgatcgagagaaacttggggaagagaatcgaccctcaaactggagagatttatcacaccacctttgactggccacccgaatctgaaatccagaaccgtctcatggtgccagaggacatctcagagctggagacggctcagaaactgctggagtatcataggaacatcgtcagggtcattccctcctaccccaaaatcctcaaagtcatcagtgctgaccagccatgtgtggacgtcttctaccaggctctgacctatgtccaaagcaaccatcgtactaatgccccgttcaccccgagggtgctgctgctcgggcctgtgggcagtgggaaaagtctgcaggccgccctcctggcccagaaatacaggcttgtcaatgtctgctgtgggcaactgctgaaagaggctgtggcagataggaccacgtttggcgagctcatccagcccttctttgaaaaggagatggcagttcctgacagcctcctcatgaaggtgctgagccagcgcctggaccagcaggactgcatccagaaaggctgggtgctacacggcgtcccgcgggacctcgaccaggcacacctgctgaaccgcctgggctacaatcccaacagggtgtttttcctgaatgtgccatttgattccatcatggagcggctgactctgagaagaattgatccagtcactggggaaaggtaccacctcatgtacaagccacctcccaccatggagatccaggctcgcctcctgcagaacccaaaggatgctgaagagcaggtcaagctgaaaatggacctgttctacaggaactcagctgacttggagcagttgtatgggtcggccatcaccctcaatggggaccaggacccatacacagtcttcgaatacatcgagagtgggatcattaatcccctgcccaagaaaatcccctgatgggttcagagccaggagcgctgccccagggaaagagttaatcccctgcccccagccccccagcctcggcacagctcccctaaaaagccaataaagcctgctggatac

SEQ ID NO: 1658 - DNA, 1385 bp, Homo sapiens
aaactgcctgcagcggggaccggacctgcacaggccgcctatggcgggcggcgggtgggaccgcgagttacagccggccaactggggccagccaggagcctgagggtcggaagcccccaacacaagatgctgagctccttcctgagcccccagaatggcacctgggcagacaccttctctctgctcttggctcttgccgttgccctctacttgggctactactgggcatgtgtgcttcagaggcctcggctggtggctgggccgcagtttctggccttcctggagccacactgttccatcaccaccgagactttctacccaacgctgtggtgttttgaggggcgactacaaagcatcttccaagtcctcctgcagtctcagcccctagtcctttatcagagtgacatcctccaaacaccagatggaggccagctcctgctagactgggccaagcagcctgacagcagccaagaccctgatcctactacccagcccattgtgctgctgcttcctggcatcactggcagtagccaggagacatacgtcttgcacctagttaaccaagctctgagggatggctaccaggctgtcgtgtttaacaaccggggctgccgtggggaggaactgcggacccacagggctttttgtgccagcaatactgaagatctagagacagtcgtgaaccacataaagcatcgttatccccaagctccactgctggccgtgggcatctcttttggagggatactggtgctgaatcacctggcacaggccaggcaggctgcagggctggtggcagcactgactctgtctgcatgctgggattcctttgagaccactcgctccctggaaaccccactcaactcactgctcttcaatcagcccctcactgctgggctctgccaacttgtggaacgcctatcctatggtaagacctgcaggcccgtacaatccgccagcttgatgagcgctacacatctgtggcctttggatatcaagactgtgttacctactacaaagcagcaagccctagaaccaagatagatgccatccggatccctgtgctctatctcagtgcagcagatgaccccttctcccccgtctgtgcccttcccatacaggccgcccaacactccccctacgttgcgctgctcatcacagcccggggtggccacatcggcttcctggaagggctgctcccgtggcagcactggtacatgagccgcctcttgcatcagtacgccaaagccatcttccaggacccagaggggctgcctgacctcagggctctcttaccttctgaggacagaaacagctgacaagagtaccatttggggtctcagttcactctttccttgtttattaaatatcaacttttcctgcct

SEQ ID NO: 1659 - DNA, 1754 bp, Homo sapiens
actaagtggttagttgcctgctgagtagacataaacacctgctaaagaaatgtgaaaagagtggaaacgtgctatttggaggttattttcctagtcgacatccaggagatctccagagatctatttcagccccacctgttgatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccaggtcaacagaagaggtgaatccatttaccttcataaccgagccaactgggtgaccgtaggcatctgtttttccagctccacccacaagatccccaatgtgatgctactggcccatccgacacctggtgcccaaaaagatacagaaaccctgtttaaaagtctcctgacatctcctcctgcagagaaactagtgctcaccaggtttctccctctgcagtttgtgactctttctgtgcatgatgcggagaacatgagcctgaaagtaaagctggtgagtggtcgagcctactacttacagctctgcacctctgcatataaacaggacaccttgttttctcaatgggtggccctcatctccctcttgaatcaggagaaagccaaagtttccaaagtgtcggaggtttcaagtctctcaggaattacgaatagcacagacatcacaggctccatggatgtgacggatgtcaccacgttcacagccatcctgaccccgtacatgtatgcaggtacaggccctgaacatgtcagggacagcatagatttcccagaattcacagacatcaccgacatcacagatgtcacagatcttccagaaaatgaggtcccagaggtcccggatgtaagaattgtcacagaagtcatagaagtcagagaagccacggaagtcacagacagctctgatattacaaactgctcgggagtcacagtggtgtttgaaaacaatgacttaatcagggccaagcaagaggagaaggaaaaattgaaaaacattctgaagcctgggtgtttacaagatacaaaaagtaagagtgagttgaaagaatcctcaaaacatgtcaccatctcaaacataacactgacttttgaaggtaaaagatattttcaaactaccttgaccccagtagaaagtgaggcaaatacatccaaggagatgaaggataagacctctgaagaaaagatgcctgattttcagagcacagctctcaaggctgaagaatccaggagcttgagaactgaatcaaacacttcagttctctcccctcatatcaaatctccttctaatttcctcaaacttgtgcctcatctgtctgcccctttctcaagggaatgaatgtgaggaaagaaaagtaaaacagaaaaagacaaagttgatggaaaaacatgtaagacaaactaaagacatttgaattaaatgaactgacttctccacctttttttaaaatcagatacaaactactaaactaaaaagcaaacacagctcagggaaagacaatcagtgcaagaggaaaaccaagcagtgtcttctacgtggcagaaataaagcctatgactaatcattacg

SEQ ID NO: 1660 - DNA, 1978 bp, Homo sapiens
gagaagataagggagtaggagaagaagatacgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgtgggagcaggaagtgaggctgcggcagcaggaggagaagatgcaggaacactaggagcacctggaagctgccatctaatgagcacatgacaagaaggcaaagacaataaacatgtaaaagccggcagcaaggcctggagaagagtaagccgccatgtgactgtttagaatatagtctgagcacaaacctgaaaagaaaaatttatttattttaaattgtggcaaaatactggccaggcatggtagctcacgcttgtaatcctagcaatttgggaggccgaggtaaatggatgacctgaggtcaagagttcaagaccagcctggccaatacaaaaattagccgggcatggtggcgcatgcctgtaatcccagctacttgggaggctgaggcaggagaatcgcttgaacctgggaggcagaggttgcagtgagctgagatcgtgccactgcactcaagcctggtgacagagcgaaactccgtctcaaaaaaaaaagtttcttccttacatgtatgtttctattagttttcttcttggtctttctcatttagtcttgtgttgtcttttgacattcatagtaaacttttatctgcctccagagagtattgactttgagtttatggcacacaattggagtaagggcagatcgccttcatctactttgggactaagctggttcaaagcaggttttaggttttctgatggctggtctatgttttattcatttggactcccaggggtggcccttccagggtccccaccaaggtcccatctccttcctgggacccaaattctcattaggtcatttcagccctgtgagagtgccaaacattcagctaggctctccagcctcttaactaccacttcatactcagtttcttagcctcttagccctctactgttgaccaatcaccaaatgtgggaaagcactacagactgtcaggatcacctcctaggcctggtcactcaagtccttactgaggtctccaattaccttccaacaattgtttttgattgggggcggggcacatttttatccagtttttctaactgctcttgtggggaggcgaatccgtaacaagctcctctgcctttactgaaagttgaaaaccttcatctgtcctttttttgttgtttttgagatggagtcttgcgctgttgcccaggctctagtgcaatggcacgatctctgctcactgtaacctctgcctcctgggttcaagcaattctcctgcctcagcttcccgagtagcgtgtgccaccatgcctggctaatttttttttatacctttaatagaggcaggatttcaccatgttttccaggctggtctcgagctcctgactcaggtgatctacctgcctcagcctcccaaagtgctgggattacaagtatgagccactgcatctggcccatctgtcttttaaaacatgtttttaattggaggtataatttctattagtgaaatgcacaggtctggtttacattttgatgagttttaactcatttaacattactatggaacccacctcctttgaagatacagagtatttctatcatccagaaagttctcctgtgctttcatgctgtcccgcactcccccagcagctgatgaacatgctgaggacattggtactggattctggccgccccaaaagagccgctttgaccaggcttacccagcactaaatccctgcctgctctctcaaaatttccatctttaaactggttgtacctataaccctccctcatcaagtcaatagataaacaaaccctgaaaaataaacaactcttcctggcccagc

SEQ ID NO: 1661 - DNA, 1836 bp, Homo sapiens
aatacccagatcttcaaggttggcaaagaagagaaaagctccttgggaacttagttaccaggtcttatagcaccagctctgtgtcctcagagtcgctgtcatcaaggagacctctcactggtcaccgccgcagcccccacatggaccagtatgtgtccacagctcctccccgattccctatagcacagctgggaacatttaaacaagactctgcaggaatgggacggatattcaaggggaatttgctgcagaagaaagcacttaccacatttgaaaatgaacaccatattcgtttcttcgcattgttggttcttttccatgtgatggtgttgctgaggaatcatagcaggatacaaggggtttctgaagactggaaaagggccaacagcatatttcgaaactttctacgtttgaagtcatccaggaacacagcagaagcagaataaatgacactacgtttctctctcatggccttcataccatggatttcccctgctcaagatgaaaagaaattaagaggaaatcagattgcttagagatagcagattattgctcactttttaaaaggagctccacagagagaatgaagaacgtgtaactttttgcaatgataatgtctgctttgttcttgaggggcactcttcctttttctgttcaggaatattctggaggagagctgcagatgccacccaaccctgcgaaatctgccctgcgtgtcgaaacagatccagcagtgcaaagaacttcttcattaggacatcaagcctgtagtcatattttcaattgctgctgtaactttttccttgcaagtgctttcacttatttcgggaccacctaaggctctgtgtggtatacagcaacacagtttgagatatttctgtgatgttctgtatatcatatagttgctaacaacctgtcaaagtcatcctgacaccaaactgagaagctgatggtttgggtaacatattagaggagatgaaaaaaccgacagtcctcattactgtaataaaaccagcagagacacactgagaatcaattactgattgtgacctaatgaactaaccctcagtcaagtagaaaactgcaccaagcctcttacattatcaaatgatttaggatggagcactgtctgaagacgggcaacaagtcgaggcagatgagttttcttatattgtggctgacttaattaccttgttcctgagtgcagagatcaaattgagcaacttaaggtgctaaagctctgtgccagctggaaatgaaaaggaaataattaacaccaacaagagctacgtctaaggttgtggcacctcctgacagaagcaaggagactcaaagttaaggcggctgcaaagtccttgacgaggtgagccctgctctatccgcctggctggattcgtccaggttgcctgtggcagctgtgcactgaagagtccggctggggagccagggattcagaactcacagtgcagcccgacgaccaaagggcaaatccacctgaggacctgagtgcagatggctgggctccccggaacaaagtggaggaatgacagaggtgtaactcttacaccacagcctccatctgtgtgtcgcagagaaaaatactataatggagactattcttacacacatacacacacacacacacacacacagagttcttgtcaccgatggaacagtctgtctttgtctttcatctcccacattcatgtccagatcccattgcgctgcatcacacgtgaacccagtgaggtcaacaatgaatggatggtgttcacaaagaaaccagcttatggaaggggacctgttacaattctttgaattaagttcttggaagcc

SEQ ID NO: 1662 - DNA, 1617 bp, Homo sapiens
agatctcgaggttgattctcaaggggaggggccagtgagggcacattgctttggaggagtagtttaataaactctctagtgctggaagttttagcaaacggaggagccttcaaacccggcaacagtccccatctaggtgtttccgtaacacatgcggaattattgctagtggaatttcaggctttctttgttgtttaactcaatgcatcgctaattgtttataatgaacttagatgttgcctccacctgagccttgctattgctaacattaaaatattttgtaggcctggcgcgatggctcccgcctgtaatcccagcactttgggaggccaaggtgggcggatcacgaggtcaggagatcgagaccatcctggccaaaatgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgatttaagaaaatttttttcccagtatgggtctgtgaaagaagtgaagattgtaaatgacagagctggagtatccaaagggtatggtttcgtcacttttgaaacacaagaagatgcacaaaaaattttacaagaggctgaaaaacttaattataaggataagaagctgaacattggtccagcaataagaaaacaacaagtagggatccctcgttctagtataatgccagcagctggaacaatgtatctaacaacttcaactggatatccttatacttaccataatggtgttgcttattttcatactccagaggtaacttcggtcccaccgccttggccttcacgttctgcatgtagctcccctgtgatggtagctcagcccatttatcagcaacctgcatatcactaccagggaattaaacaatgtcatacaagaagatggatggactctttgcttccttttaccaaatgtgatgaggccaccacacagtatttaccaggacagtggcagtggagtgttcctcagccttctgcctcttctgctccattcttatacctgcaaccttctgaggttatttatcaaccagtggaaattgcacaggatggtggatgtgttcctcctccactgtctctgatggaaacttcagttccagagccttattctgatcatggagttcaagcaacatatcaccaggtttatgctccaagtgccatcactatgcctgcgcctgtgatgcagcctgagccaattaaatgtggagcattcattattaagacaattgggcagctctattccagctcaactgatttcttgtccaatgatccttgcgtggccgagatccagcttcaacgaaccagctagaagctgcccgttgtgaaacttagtgttagttaatacctcaccatactcagttattccactataagctgtctaaatttgatgaaatttgctttttcagctgttctacaaaattatttaggtagatgtggcatgttggttttttatgtgctaacctaactgtaatgaccttttctacaacatgttttatccattccataaataataaccacattgggaat

SEQ ID NO: 1663 - DNA, 1773 bp, Homo sapiens
tgcactgaaggccctctcagtactacgctacatcacagactgtgtggacaggtgagcagtccgactgggcctgggcctactgtggagggctggaagaccgggcctgtagcctgcctctactcacctccttcacaacgtccctgcccctagcctctctctcagcaccttgagccgtatgcttagcacacacaacctgccctgcctcctggtggaactgctggagcatagtccctggagccggcgggaaggaggtagggtcctcccccaccagcctaagccccaggctactgcttcagggtatctttttgatagaggggggcagcttgcacacacgaagacaaaccctgtccccaagcccactgaggataccaggatgcctcagccaaggttggcctagacctgagctctgcagcaggccaggcccatgtgtccactactgaggctcaccctgctctggggtcagcagccctatagcctgggcaagtcctgcagcccaggttctcccattcccaggcagtggtcagtctcccagcccccacagctggctcacttgaagagaattcaacgtctgcacccagtgtgctggttcctctccccaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaaggtcagactccctccgcaccagcccccacagccccagtaccgccctccccatcctaccccgactgcgtccctgctgtttatctttgcccacccacctcaaccccagtgctcttttcagtccttgggcctcaggtgacacaccagctagtgggacatgggcccccacaggcattctcagcccaacccagccccttccttttccttggccccctggccagcacctgcatcacactggcctccactggacacccttgcagcttcgggccttcctcacagacacactgctggaccagctgcccaacctggcccacttgcagagtttcctggcccatctgaccctaactgaaacccagcctcctaagaaggacctggtgttggaacagatcccagaaatctgggagcggctggagcgagaaaacagaggcaagtggcaggcaattgccaagcaccagctccagcatgtgttcagcccctcagagcaggacctgcggctgcaggcgcgaaggtgggctgagacctacaggctggatgtgctagaggcagtggctccagagcggccccgctgtgcttactgcagtgcagaggcttctaagcgctgctcacgatgccagaatgagtggtattgctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccag

SEQ ID NO: 1664 - DNA, 2223 bp, Homo sapiens
acatgcttccattgcttgattcctcgaaaagggcggggactctgggcagcggttgtggagtgccgcgggtccacagtgctgcactgagcagagaggaaggggcgtcccgggatatttggaggataaaggtgtgggcaagggtgatgaccacacctgccggctccggcagcggcttcggctccgtgtcctggtggggcctgtccccggcgctggacctgcaggctgaaagggatgctacggtggacgctctgccaaccaccatggtgccccagccagctgtcatcttgccaggtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacttctttgtgctggagaataatctggaagctgtggcccgacacatgctgatcttcagcctagccctggaggaaccggagaagatggggctgcaagagcgaagcgagaccttcctggaagtgtgggggaacgcgctgctgcgcccgccagtggccgccttcgtgcgtgcccaggccgacctgctggcgcacctggtccccgagcccgaccgcctggaggaacagctgccctggctcagcctccgcgccctcaagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcacccccaggagttccgacgctggcgggacacaggcgtcgcctttgagctcagggactccagcgcctatcatgtgcccaaccggaccctggcgtccggtcgcctcctgagctaccgtggggagcgcgtggcagcgcgcgggtactggggggacatcgccacggggcccttcgtggccttcggcatcgaagcggacgacgagagcctcctgcggacgagcaacggccagccagtcaagacggccggggagatcactcaacacaacgtgacggagctgctccgcgacgtggccgcctgggggcgcgcgagagccaccgggggggacctggaggagcagcagcacgcggagggaagcccggagccagggactccagccccgaccccggaatctttcaccgtccacttcctgccgctcaattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtcc

SEQ ID NO: 1665 - DNA, 2238 bp, Homo sapiens
atgttggtttcttctcatctagagaggctactgctttttctttttgaatttattttcatttagatgggcgtcccccccacctcccgtttccacctcttctaggggtgtaactatagcgttagtatgttgggtagggtcttttgggttcgcttctaaggccctgcgcgattctgtctgcaggttttatattggtctgtgcagtttgacctggagatcttctcactcagatatggcaacaagcagccttcactttgcatcatgtgatacacaacaggcgcccagacagcgcggagcgtctactgtcagcagagagccataacaaaagagaagagaatggaggaaggaaccttttgggaacacagaacattgaagcatggctgagacagtgaccgttcaaacaagagctacatagatgtgtgagagaggaagactacaagttggtggccacaggacaggcaagggacttgggggaaggttcatcatcaaccaaggtggatctcaagagtggcctcgaagaatgtgctgtggcattgaacttatttctaagcaacaaatttacagacgccttagaattgcttcgcccctgggctaaggagagtatgtaccatgccttgggctacagtaccattgtggtgttgcaggctgtcctgaccttcgagcaacaggacatccagaacggcatttctgccatgaaggacgctttacaaacctgccaaaaatacaggaaaaaatacacagttgtagaatctttctcaagtcttctttctagaggatccctggagcaactgagtgaagaggaaatgcatgctgaaatctgttatgccgagtgtctcctacagaaagctgcactcacgtttgtgcaggatgaaaatatgatcaacttcatcaaaggtggactcaaaattagaacaagttaccaaatatataaagaatgtctttctatcctgcatgaaattcagaagaacaaacttcagcaggaattcttctatgagtttgaagggggtgtcaagcttggcagtggggcctttaatttgatgctgtcccttttaccagcaaggattatcagactactagaatttattggattttctgggaatagggagttgggcctcctgcagttacgtgaaggtgcttcaggaaggagcatgaggtctgcactgtgctgcttaaccatcttagcttttcatacttacatctccctaatacttggtacaggagaagtgaatgttgcggaagcagagcgtctcctggcacccttcctccagcagtttccaaatggctcactcgtgttgttttatcatgcccgaatagagttgctgaaagggaatcttgaagaggcacaagaagtatttcaaaaatgcgtttcagttcaagaagaatggaaacagtttcaccatctctgctactgggagctaatgtggattaatgttttccaacaaaactggatgcaggcatattactattcagatctgctttgcaaagagagtaaatggtccaacttatgtgttcttgaaagcagcaattttgagtatgcttccagaggaggatgtagtagcaacgaatgagaatgtggtaactttattcagacaggtggacagcttgaagcagagaattgccgggaaatctatccctactgagaagtttgctgtgaggaaggctcggcgttactccgcctccttacctgcacctgtgaagctcatcttacctgccctggaaatgatgtatgtctggaatggtttttcaatagtgagcaaaagaaaagacctttctgaaaatctgttagtaactgttgaaaaagctgaggcagctttacaaagtcaaaattttaacagcttctctgtggatgatgagtgcttagtgaagttacttaaaggatgttgcctcaagaacttacagcggcccttgcaagctgaactatgttacaatcatgttgtggaaagtgaaaagctactgaagtatgaccactacctagtgccgttcactctatttgaattggcatctttgtataaaagccagggggaaattgacaaggccataaagttcctagaaactgcaaggaacaactacaaagattactccctggagtccagactacacttcagaattcaggcagctcttcacctctggagaaaaccttcctcagattgatcagaacttgaaggatggaatttttcctcaattagcatcggcatctgctatagattcaaccttatattaaagtggaaaaatgatcttgtg

SEQ ID NO: 1666 - DNA, 2093 bp, Homo sapiens
agtcacatagctgcgtggtacgtgactggaggtgtatccttgtcctcgtctgaatcacgctgatgtggccccaaccccacctccctccccaccccatgatgtcagaaaaaaccagacagaacaaattggctgaggccaagaaaaagtttacagactatcgtcagtggaacattgctggtgttggtaccggagcaactgacaccaaaaagaagaaaataaatcatggcactaaccctgagacaaccacttcggggggctgccactcgcctgaggatacacaacagaaccgagcgcagctgaaagaagaaaagaaggcaagccaccaacatcaggaagccctaaggcgggagatagaggcccaggatcatacaatacgaattctcacgtgtcagaaaactgaactggagacagcgctctattacagccaggatgctgccaggaaatttgaagatgggaacctgggcaccccatcatccttcaacctggcactttcacaggcctttagggggagtcctttgggctgtgtctcaacctctctcattccaggagagtccaaggatctcgccggccgcttgcatcattcctggcactttgcaggagagttacagcgggctctctctgctgtgtccacacggcacaagaaggcagacaggtacatcgaggagttaacaaaggagagggacgccctgagtctggaactgtacaggaacaccataaccaatgaggagctgaagaagaaaaatgccgaactacaagaaaaacttccacttgcagaatctgaaaagtctgagatccagctcaacgtgaaggagctaaaaaggaaactggagagggccaagttcctgctgccacaggttcaaaccaacactttgcaggaggagatgtggaggcaggaggaggagctacgggagcaggaaaagaagatacggaagcaggaggagaagatgtggagacaggaggagagactgcgggagcaggaggggaagatgcgggagcaggaggagaagatgtggagacaggagaagaggctgcgagagcaggagaaggagctgcgggagcaggagaaggagctgcgggagcagaagaagctgcgggagcaggaggagcagatgcaggagcaggaggagaagatgtgggagcaggaggagaagatgcgggagcaggaagagaagatgtggagacaggaggagaggctgtgggagcaggagaagcagatgcgggagcaggagcagaagatgcgggaccaagaggagaggatgtgggagcaggacgagaggctacgggagaaggaggagaggatgcgggagcaggagaagatgtgggagcaggtggagaagatgcgggaggagaagaagatgcaggagcaggagaagaagacgcgggaccaggaggagaagatgcaagaggaggagaggatacgggagcgggagaagaagatgcgggaagaggaggagacgatgcgggagcaggaggagaagatgcagaagcaggaggagaatatgtgggagcaggaagagaaggagtggcagcagcagaggctgccggaacagaaggagaagctgtgggaacaggagaagatgcaggagcaggaggagaagatatgggagcaggaggagaagatacgggaccaggaggagatgtgggggcaggagaagaagatgtggcaggaggagaagatgtgggggcaggaggagatgatgcgagagaaggaggagaggatacgagatcagaaagagaagatgcaggagaggctgccagagcacgaggagcggtgctcagagccctgcctccctccctccaaagttctttgtaatatgagccacactggcagtgtggagcctgcaggaggagaggctggggagggttctccgcaggacaaccccactgcacaggagatcatgcagctgttttgtgggatgaagaacgcccagcagtgcccaggattaggcagtacctcctgtatcccattcttctaccgaggagacaagagaaagatgaagatcatcaatatctaaaagttggcactgtcaacaaggcctacagaagcataagccgccatgtcactgtgtgaatatagtctgagcacaaacttg

SEQ ID NO: 1667 - DNA, 2556 bp, Homo sapiens
gacattctaaatgcaaagctagactgagcaagggaagtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagggatcacaagaatcatcactgcggaagacagactctcgagggtaccttgtgcgcagtcaatggtctagaatatcccggagcccatccaccaaggctccatccatagatgagcctagaagcaggaacaccagtgctaaggtagagctccccagcagccctcgctccagccacccgcgtcgccccagctgccccggtcgctggactcgcggcctcccacgcccccagagcccgatcctggctcccggcgcagcaccaaaatgcaagagaatccggaggcctgggcccaaggcatcgtgcgggaaatccgccagacccgggactcgcagccgctggaatattcgcgcacgtcccccaccgagtggaagtcctccagccagcgcagggggatctaccccgcctccacccagctggaccgcaactctctgtccgagcagcagcagcagcagcgggaggacgaggacgactacgaggctgcctactgggcatccatgaggtcgttctacgagaagaacccgagctgctcgcgcccctggccgcccaaacccaagaacgccatcaccattgctctctcatcctgcgcgctcttcaacatggtggacggcaggaaaatctacgagcaagagggtctggaaaagtacatggagtatcagctcaccaatgagaacgtcatcctgaccccgggcccggcgttccgcttcgtcaaggcactacagtatatcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcagggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggttaggttccatcgcagcttatggctttaataaaaaattcagtagttaggggcagggaggagaaataaagtggtgatagtctggtgttacagaagccacttcttttggctctctaggataattagataggtatttcagaaaattggaccttaaaactttgcttctttggaaaggttttctcctgattttttggaaaaccttttgaaccctcaagttaccatcaaactacttctctttgaactaccaatactgttgaatgccattacacctatctctgtgtaagtcataatgatgactctttaggataagtttagaacttgaatatttgcatgcttaaggcactgttttagaagcttacttagttttataaacactgctcatttttggatgtttgtagataacaatgaattgttacccatcagcattgtagaatagtgtcttcaaaggtagaaggagtatggttaagcacactcttgaaaactggagctttgtattctgtgactgctatggctagctttgtaaccaaagcaaaatgagaatttcactctacctgcatgagtataacaattttgatgctgctcatttagaaataaatcatctggttgttcctccagggtactttctaagataagccttaaacagaaacccctaagaaaggttctctgaaaattatttggtgggttaaatgcctctgatccacagagtttcatatttgaagtctccggctttgggcctggcaggctggcacatccatatttgtatggaaaaaaaaaaaaaaaagaccctacgctaccacttcaaaaagtgacatgaagtgtagtatcctggcccttcattgtcattctctcatgatttttgttttgttttcaacaaaaattggttggtcattaaatatatcatatgttaggcacagtg

SEQ ID NO: 1668 - DNA, 1719 bp, Homo sapiens
acaatcaggtctaccccagagaggtcctagggctggtggacatggccgccctggagaatggggagctggggccccttctctcccctggcaccctgcggggtttggaggatgaatgcgtcacagatgttaaggctcagacccgggctgcccttctccgtgtgctgcaggaggacgaagagcactgggggagcctggaggaccagcccagcagcctggcccaggatgtgtgtgagctgctggaagagcacacagagcgagcaccccgcatcagccaggagtttggggagcggatggcccactgctgcctaggcgggctggcagagttcctgcagagcttccagcagcgtgtggagcgattccatgagaacccagcagtccgggagatgctacctgacacctatatcagcaagaccatcgccctggtcaactgcggccccccactgagagctctggccgagcgcctggcccgggtggggcccccagaaagcgagccggcccgggaagcatctgctagtgctctggaccatgtgacccggctctgccaccgtgtcgtggccaacctgctgttccaggagctgcagccacacttcaacaagctgatgcgccggaagtggctgagcagcccggaggccctggatggcattgtgggcacgctgggtgcccaggccctggccctgcgcagaatgcaggacgagccttaccaggcgctggtagccgagctacaccggcgggcgctggtcgagtacgtgcggcccctgctccgtgggcgcctgcgctgcagctcggcgcggacccgcagccgcgtggccggcaggctccgggaggacgcgtcgcaactgcagaggctgttccggcggctggagtcccaggcctcgtggctggatgccgtggtgccccatttggctgaagtcatgcagctggaagacacgcccagcatccaggtggaggtgggagtgttggtgcgcgactacccagacatcaggcagaagcacgtggcagccctcctcgacatccgtggcctgcgcaacacagccgcccgccaggagatcctggccgtggcccgggacctggaactctctgaggagggagccctgtcaccccctcgggaccgtgccttctttgcagacatccctgtgccccgcccatctttctgtctcagcctccctctcttcctgggccgcctccccctctcccggctggccaggcccagtttggcctgtctgcctcggccccggcctccgtctctagcgcgacctcgggcccagcgctgagggtcacccaaccgccggccttagtgaccccatctatgctgctgacaagccaacctcccgtacggcgcccctcctgactccctgcctgggaccacacacccctgggatagaaagacccttagatgtcttctcacgcaaccccaaactccctgtacagaagggaaacaaacgccaggcacggtggctcatgcctgtaatcccaacactttgggaggctgaggccggaggattgcttgagcccaggagttcaagaccagcctgggcaacatagtgagacctgccccctatctctacaaggaataaaaaattagctgggcacggtggtgtgtgcctgtagtcccagctactggcgaggctgaggctggaggatcactggagttcgaggctgcagtgagctatgactgtgccactgcactccagcctggtcaacaaagcaagaccctttctc

SEQ ID NO: 1669 - DNA, 2036 bp, Homo sapiens
tattgtaggtggggtgctcacttcagcaacacatatactaaaaaatgttgtaggcggggttgaaatggatgttagggaagtaacagtgtccactagactagggtctgggaggtgcgcgatagattttgttcttcacccccactatttctttctttctttctttcttttttttttttttttgagacagagtttcactcttgttgcccaggctggagtgcagtagcactatcactgcaacctccgcctcctgggttcaaacgattctcctgcctcagcctcccaagtagctgggattacaggcatgcaccaccactcctggctaattttttgtatttagtagagacagaggtcagcatccgccaaacactgcagcatcttccccagcgttgagatccattggtgagacacatccagtggacgcccagggagatggaggtgtacatcaggcacttggagaaggtgttaaggcgctatgtccagaggctgcagtggctgctgtccgggagccgccgactgtttggcaccgttttggagagcaaagtatgcatattgctggacacgtcagggtccatgggcccctacctgcagcaggtgaagacagagctggttttgctgatttgggaacagctgcggaagtgctgtgacagttttaacctgctcagctttgcagagagccttcagtcatggcaggacacgctggtggagaccacagatgcagcgtgtcatgaggctatgcaatgggtgacccacctgcaagctcagggcagcacctccatcttgcaagcattgctgaaagctttcagtttccatgatctggaaggattgtacctcctgaccgacggaaagccagacacaagctgcagccttgtcctaaatgaagtccaaaaactcagggagaaaagagatgtgaaagtgcacaccatttccttgaactgctcagacagagcggcggttgagttcctgagaaagctggcttccttcaccggcggacgctatcactgccctgtgggtgaggacacactctccaaaattcacagcctgctgaccaaaggcttcatcaatgaaaaggatcccacattgccaccatttgaaggagatgatttaaggatcctggcccaggagatcaccaaggccagaagcttcctctggcaggcccaatccttcagatcccaactccagaagaaaaatgatgcagaaccaaaggtcactctttcctagagaagtgttctcagaaaagtcatcctgcaaaggaccactcactgagcaaatctcagccccgagggcaggatgggatgaaatgctgtgacctgcaggaaacatgattcctggtaccaggactctctggaagctgaggaaggaaagactttgtcttttgtgtgaggggccattcccgggtcttaatctaactctccagccctgtcccgcagcgcactctactctccagccactagattgtccctctctgggaagccctaaaccaaccccctgcctaaatggtggtgcttcttgcaaaccaaccccctgcctgaacggtgcttcttgccccctctgcctggagactcctgctcatccatcaaggcacagctcaaatgacatcagctccctgggacctatctagagcgaggggcctccagtctttctcttgcagcatcctgaccacgcagacctctcgcactcagcactctatgtcacgccaccttgctcgctgatctaactcttctccttgatggtgagctccttcgggatgagactggtgtcccaggatctgcaggtccccagaagctgccacataggagacacatggtgaacagtgagcaggcggctgagctgtgagagcctagctctggaaagcagctgatggggtggtctccaccctggttcataagaggctaatgcagagtcacagtcagcccatcctgggggaagaagaaacaagtgagcctcagcaccaccctccatccctgcccaaccaaactgaagtgaaggctgctcatctgggttcattttctaaaattaaaaacaattaattttattct

SEQ ID NO: 1670 - DNA, 1847 bp, Homo sapiens
aaagatgtaaaggcagctcaatagaagaaacacagccttttaaaaaatggtgttggaccaattgccatagcaacttatgaagttggaattgaagaactccaaaagcctgggaagaattttccctatccagaacctagtgctaaacatgaagataaaaaaatgaaggaaaaacaaccatgtgaattgaaacctaaaaacacagaaaaggaaccatattcaaaccatgttttcaaggtagatgcctgtgaagggacacctgaaaaaattcagatgaccaacgtccacacaggtagaaggaacatgttggctggaaagcaagaggccatgattgacatcatccagacaaatccctgccctgagggcccaaagctggccaggcactcccaaggccactgtgggcatctggaggttttggagtcaactaaagaaactccagacctaggggtctctaagacaagttccatctcggaggagatatatgatgatgtcgagtactccaggaaagaggtaccgaagctgaactactctagctcacttgcctcaagtagtgtttagatggaaaagaagcactcaaaagactgcagcaattcttcaagaaagaaaaggatagatttaaaataaagaaaaccaagtcgaaagaaaacttaagaacttaagtctcaggaagttattatttatgatgatgtagacctgagtgaaaaagagtcaaaagatgaagataaactgaaaatgtggaagcccaagtttctgacaccaaaggaaaaaaaagagaaaaacggtgctgaagaatcagaaagtttctctcctagaaatttcttcaaaaccaagaagcaaaacttagaaaagaacagaatgaaaagagaagaaaaactatttagagaaaggtttaagtacgacaaagagattattgtcatcaatacagcagtggcctgttccaataattcaagaaatggaatatttgatttgccaataagtcctggagaagaattggaagtcattgataccaccgaacaaaatctagtgatatgtcgtaattctaaaggcaaatatggatatgtgctcattgaacatctagatttcaagcatcaaagttggtcaccttagaaaaatcaagatcaaatgctatggactgcacaaaggagaactagtcctaagatcctagtcctgcgttacatcagtttcagtttacatgtcaaaattttgagatggtggaatctgtggaaactttcgttctgaacttaaaagagaaaaataaaaacaaatcctcaacatttagatgttggttttactcctaaaaggttatctttcaatgtctatttcagtatctacttcactgtcagttcaagagaatgtgaaacagtatgtgttagcatttgagcacttatttaatgagccatatccaaagttagaaatcatgccttatggcacctagtcagttgtgcagatggttagtttgcttctaattattagtatatgagcatttgtaatttctagatgttgtgcactcaaacttggtataatttaattctgaacagtaaacagtgtaaccaaggtcttttaaatactcaagtttaaggtataatcttaattatggctcagtctttaaaaaagtataaatgtccttttactttatcacaaaaataatttattcctaaattcacccatcattttaagaagtgcccaaatgtatttaacaaaataatatatatgctgtattactttaaaacatctttttgtccaaaataagaacaattgtcattattttgtctatgcccaaataactattcaaataatagcattcatatgtactttcatttatatggaattaaataaaaatttaaaagctg

SEQ ID NO: 1671 - DNA, 2258 bp, Homo sapiens
acttgcctgccgcctcactaactgggcgctgggcctggaggcggtggggaaggcccctccaggcctgaaggctgcctctccagccctagcctgaggcctgcactgctctttggagctgaggccccacagccaagaggagacattcttctccccagtgttcatctgtctggcttctctcccaagcccctggcccacctagcactaggaagcaagcaccttctgtctaatgcctggcatgttttgctgtcaccttctgccctggaactcagggttggatgagcccctgaaatcatagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcgtctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatcc

SEQ ID NO: 1672 - DNA, 2244 bp, Homo sapiens
ggtctcatgctttcatctcccagtgggtgtgcagacactggagagacccagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaacgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaggctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgaccttttcacattaccttatgtatacaacaggagctgcgttgttt

SEQ ID NO: 1673 - DNA, 2091 bp, Homo sapiens
atcccatctaggaagtgaggagcgtctctgcccggcctcccatcctctgagatgtggggagcgcctctgccccgccgcccggtctgcaatgtgaggagcgcctctgcctggccgcgaccccgtctgggagagacttagagagctcagaagacaggaagatgtgggaaagtttggaacttcctaaagacttgatgaatggctttgatcaaagtgctgatagtgataaggatgatgaagtccaggctgaggtggtctcagatggagatgaagaacttcttgggaactggagtaaaggtgactcttgctatgcaatgagactgctggaattttgcctctgccctagagatctttggaactttgaacttgagagagatgttttagggtatctggtagaagaaattcctaagcggcaaagtactcaagaggaggcagagcataaaagtttggaaaatttgcagcctgctgatgcaatagaaacaaaaaccccattttctggggagaaattcaagccagctgcagaaatttgcataagtaacgaggtgccaaatgttaatcaccaagacaatggggaaaatgtctccagggcctgttagagaccttcacagcagcctctcccatctctggcccagagacctaggaggaaggaaatggtttcttaggtcaggcccagggaccccctgctgtgtgttagcctagggacttggtgccctgcatctcagccactccagctgtgcctaaaaggggccaaggtacagctcaggccatggcttcagagagtggaagcctcaagccttagcaacttccatgtggtgttgagtctgttggtgcacagaagtcaagaactgaggtttgggaacctttgcctagatttcagaggatgtatgaaaatgcctggatgtccaggcagaagtttgctgcaggggcagaaccctcatggagaacctctgctagggcagtgaggaagggaaatgtagagttggagtccccacacaaagtccccactggggcactgcctaatggagctgtgagaaaaggtccaccatcctccagaccccagaatggtagatctaccaacagcttgcaccatgcgcctggaagagctgcagacactcaacaccagcctgtgaaagcagccaggagcggggacgtaacctgcaaagccacaggggtggaactgcccaaggctgtgggagcccacctgttgcatcagcacggcctggatgtgagacatggagtcaaaggagattattttgcacctttaaggtttaatgcctgccctatggattttggactttcatggggccagtatcccctttgttttggccaatttctcccatttggacttggacttttgggttaatgctggaatgaactcagacttttttttctttttttttttttattttgagacagagtcccactctgtcacccaggctggagtgcagtggtgcaatctcggctcactgcaacctccacctcctggattcaagccattcccctacctcagcctcccaagtagctgagattacaggcacctgccaccacacctgactaatttttgtatttttagtagagacaggtttcaccatgttggccaggctggtctcaaactcctgacctcagttgatccacccacctctgcctcccaaagtgctgggattacaggtgtgagccaatgtgccctggaatgagttaagagtttgtgggactgttgggaaggcatgattgtgttttgaaatatgaggacaggaagtttgggaggggccaggggcagactgatatggtttggctgtgtccctactcaaatctcatctcaaattgtagttcccataatccccatgtgtcgtgggagggacccggtgggaggtaattgaatcatgggggtggttacttccatgctgttcttgtgatagtgaatgagttctcacgagatctgacggttttataagcgtctggcatttcccctacttgcactcattctctctcctgccgccctatgaaaaggtgccttccaccatgattgtaagtttcttgaggcctccccagccatgcagaactgtgagtcaattaaatttctttcctttataaatt

SEQ ID NO: 1674 - DNA, 1787 bp, Homo sapiens
ataggacgtgcgttgatggagcaggcggcgggctagggggttcgaatcccagttccccgactcccactgtgggatttggcctgggggcaggaggtggcttctgctttcggagcctcagtttttccatccgagaaacgggggaatcgttcccctgttctgggatggaagagagggtcaattagaatccgctctccctgcatccctctctgccttcctctgtcccaccgcgtgcctggccccgcagttccgcgagcgggatgccctggaggccgtattccgcttctgggctggcggcgagaaagggccccaggcgttccccatgagccgcctctgggactcgcgcctgcgccactacctgggctcccgctacgacgcccggcgcggtgtcagcgactgggacctgcgcatgaagctgcatgaccgcggggctcaagtcattcacccccaggagttccgacgctggcgggacacaggcgtcgcctttgaactcagggactccagcgcctatcatgtgcccaaccggaccctggcgtccggtcgcctcctgagctaccgtggggagcgcgtggcagcgcgcgggtactggggggacatcgccacggggcccttcgtggccttcggcatcgaagcggacgacgagagcctcctgcggacgagcaacggccagccagtcaagacggccggggagatcactcaacacaacgtgacggagctgctccgcgacgtggccgcctgggggcgcgcgagagccaccgggggggacctggaggagcagcagcacgcggagggaagcccggagccagggactccagcagccccgaccccggaatctttcaccgtccacttcctgccgctcaattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccacc

SEQ ID NO: 1675 - DNA, 2185 bp, Homo sapiens
cagacctggacctcccgggccgaagcctcgccacccctgcgccttcctgctaccttctgggcagcgaacccagctctggcctgggcctccagcccgagacccacctccccgagggcagcctgaagcggtgctgcgtcttgggcctaccccccacctccccagcctcctcctcaccctgtgcctcctccgacgtcacctccatcatccgctcctcccagacgtctctggtcacctgtgtaaatggactccggagcccccctctggcgggagatctggggggcccttccaagcgggcccggcctggccctgcatcgacggacagccatgagggcagcttgcaacttgaagcctgccggaaggcgagcttcctgaagcaggaacccgcggatgagttttcagagctctttgggcctcaccagcagggcctgccgcccccctatcccctgtctcagttgccgcctggcccaagccttggaggcctggggctgggcctgggaggcagggtggtggccgggcggcaggcgtgccgctgggtggactgctgtgcagcctatgagcagcaggaggagctggtgcggcacatcgagaagagccacatcgaccagcgcaagggcgaggacttcacctgcttctgggctggctgcgtgcgccgctacaagcccttcaacgcccgctacaagctgctcatccacatgcgagtgcactcgggcgagaagcccaacaagtgcatgtttgaaggctgcagcaaggccttctcacggctggagaacctcaagatccacctgaggagccacacgggcgagaagccgtacctgtgccagcacccgggttgccagaaggccttcagcaactccagcgaccgcgccaagcaccagcgcacccacctagacacgaagccgtacgcctgtcagatccctggctgctccaagcgctacacagaccccagctccctccgcaagcacgtcaaggcccattcagccaaagagcagcaggtgcgtaagaagctgcatgcgggccctgacaccgaggccgacgtcctgaccgagtgtctggtcctgcagcagctccacacgtccacacagctggctgccagcgacggcaagggtggctgtggcctgggccaggagctgctcccaggtgtgtatcctggctccatcaccccccataacggacttgcatcgggcctcctgcccccagcgcacgacgtaccttccaggcaccacccgctggatgccaccaccagttcccaccaccatctgtcccctctgcccatggctgagagcacccgggatgggttggggcccggcctcctctcaccaatagtcagccccctgaaggggctggggccaccgccgctgcccccatcctctcagagccattctccggggggccagcccttccccacactccccagcaagccgtcctacccacccttccagagccctccacccccgcctctgcccagcccacaaggttaccagggcagtttccactccatccagagttgcttcccctatggcgactgctaccggatggctgaaccagcagccggtggggacggactggtcggggagacccacggtttcaaccccctgcggcccaatggctaccacagcctcagcacgcccttgcctgccacaggctatgaggccctggctgaggcctcatgccccacagcgctgccacagcagccatctgaagatgtggtgtccagcggccccgaggactgtggcttcttccccaatggagcctttgaccactgcctgggccacatcccctccatctacacagacacctgaaggagcccccacatgcgcctgcccatccagcactgcagatgccacctcgcccacctgctgtcgctcccaccctccgtgcacctagcaggagtgccaggccacagccggaacagccaggccatgacccaggggagccagcgctgccaccccacccagcgctgccagggagccgccatccgagcttgagctgggcgcacagaggtgcccgccaggatctgtggccctgtaacattccctcgatcttgtcttcccgttcctccccgcagtggttttgaaatcacagacctcgtgtatataaaatatgcagaacttgttttccgttcccctgccagttttatatttttggttttacaagaaaaaacattaaaaactggaaaggagatgtg

SEQ ID NO: 1676 - DNA, 3138 bp, Homo sapiens
gcatttccagccccggcgttggttgtggatgctggacatccaccgcctccaggcagtttcgccgtcacaccgtcgccatctgtagccaaagcaaaacatatcctaactgagactttgcagctcttgtggccactctgggctcaccgggaacatgagtggaagagcccgagtgaaggccagaggcatcgcccgcagccccagtgccacagaagtggggcgcatccaagcctcgccattgcctagatctgttgatcttagtaacaatgaagcatcctctagcaatggcttcttgggaacaagcaggatctcaaccaacgataaatatgggatatcttctggtgatgctggaagtaccttcatggaaagaggtgtgaaaaacaaacaggactttatggatttgagtatctgtaccagagaaaaattggcacatgtgagaaattgtaaaacaggttccagtggaatacctgtgaaactggttacaaacctctttaacttagattttccccaagactggcagctataccagtaccatgtgacatatattccagatttagcatctagaaggctgagaattgctttactttatagtcatagtgaactttccaacgaagcaaaagcattcgacggtgccatcctttttctgtcacaaaagctagaagaaaaggtcacagagttgtcaagtgaaactcaaagaggtgagactataaagatgactatcaccctgaagagggagctgccatcaagttctcccgtgtgcatccaggtcttcaatatcatcttcagaaagatcctcaaaaagttgtccatgtaccaaattggacggaacttctataatccttcagagccaatggaaattccccagcacaaattatccctttggcctgggtttgccatttctgtgtcatattttgaaaggaagctcctgtttagtgctgatgtgagttacaaagtcctccggaatgagacggttctggaattcatgactgctctctgtcaaagaactggcttgtcctgtttcacccagacgtgtgagaagcagctaatagggctcattgtccttacaagatacaataacagaacctactccattgatgacattgactggtcagtgaagcccacacacacctttcagaagcgggatggcaccgagatcacctatgtggattactacaagcagcagtatgatattactgtatcggacctgaatcagcccatgcttgttagtctgttaaagaagaagagaaatgacaacagtgaggctcagctcgcccacctgatacctgagctctgctttctaacagggctgactgaccaggcaacatctgatttccagctgatgaaggctgtggctgaaaagacacgtctcagtccttcaggccggcagcagcgcctggccaggcttgtggacaacatccagaggaataccaatgctcgctttgaactagagacctggggactgcattttggaagccagatatctctgactggccggattgtgccttcagaaaaaatattaatgcaagaccacatatgtcaacctgtgtctgctgctgactggtccaaggatattcgaacttgcaagattttaaatgcacagtctttgaatacctggttgattttatgtagcgacagaactgaatatgttgccgagagctttctgaactgcttgagaagagttgcaggttccatgggatttaatgtggactaccccaaaatcataaaagtacaagaaaatccagctgcatttgttagagctatacagcaatatgttgatcctgatgttcagctggtaatgtgcattctgccttctaatcagaagacctattatgattccattaaaaaatatttgagctcagactgcccagtcccaagccaatgtgtgcttgctcggaccttgaataaacagggcatgatgatgagtatcgccaccaagatcgctatgcagatgacttgcaagctcggaggcgagctgtgggctgtggaaatacctttaaagtccctgatggtggtcggtattgatgtctgtaaagatgcactcagcaaggacgtgatggttgttggatgcgtggccagtgttaaccccagaatcaccaggtggttttcccgctgtatccttcagagaacaatgactgatgttgcagattgcttgaaagttttcatgactggagcactcaacaaatggtacaagtacaatcatgatttgccagcacggataattgtgtaccgtgctggtgtaggggatggtcagctggaaacacttattgaatatgaagtcccacagctgctgagcagtgtggcagaatccggctcaaataccagctcaagactgtcggtgattgtggtcaggaagaagtgcatgccacgattctttaccgaaatgaaccgcactgtacagaaccccccacttggcactgttgtggattcagaagcaacacgtaacgaatggtatgacttttatctgatcagccaggtggcctgccggggaactgttagtcctacctactataatgtcatctatgatgacaacggcttgaagcccgaccatatgcagagacttacattcaaattgtgccacctgtactacaactggccgggcatagtcagtgtcccagcaccatgtcagtatgctcacaagctgacctttctggtggcacaaagcattcataaagaacccagtctggaattagccaaccatctcttctacctgtgatggcatgaactactggcatcactagatggacaatccaagaagaaattggtatactttgtgcaaatctgccataagctcaaggctgtgactggggaaaaagattgagcttagttttcatgtctaggaaaaaaagcaaaacaacttaatctgaaacagttttaaaaaatgtgtgttattttgttttaaagagttgtatgcttggggtaaattttcattgtcatatgtggaatttaaatataccatcatctacaaagaattccacagagttaaatatcttaagttaaacacttaaaataagtgtttgcgtgatattttgatgatagataaacagagtctaattcccaccccaaattctgctgaggttttcttaatgttgtagagcattttgtagagtggtttaaatagttgaaaataaagttcagaacatc

SEQ ID NO: 1677 - DNA, 2257 bp, Homo sapiens
acttccgcttacgcgccccacttccgcttccggccccgggctgtggtgactggcggtgtggggtgggtcagagggcagtaggtacctccaggcgggagcagcgtttgcaccgcggtgggttcctgcgagctggtgcagaggggccccggcgggccggccccggggcacatgcgacgacctccacccctgggccccacgacggcctcagggcctgaaggcaatgtgcgaaaccaccagaagcggcaggcgccagggccaggcgcggcgggaggctgtggccctgaggccggggggcgccgggaaaataagcaaaagaggagaatggtggcccgggccacccctgggagaggcgaggtggaaagtgataagtcggttgcagcatcaggggctggaaaggccgcgaggcgtcaggtggaggggcgcaggggccaggtgagcccgtcagactcgtcagacccgcgaggcctagaagcagcaaaggaggctgaactccccttgcaaacggaaagacacaccaaggaaaaaagaaaagttactgaagcctcaagtgatgatccacagccagggcttgacttggtaagaaaggaatcattaaccagttcggaatctttccaaacagtggaatgcttgcagtctttgggtaaggaaagtataatagaaggtattaaaagaagaattcgaaataaaaaacttaaaagcttagaaaacccacctctcaaaataaccgaaaatgaggctacacaaaatattaaggttgaattccaagatgaactgtacaagaatactccaaaatattcttgtaatatcttgtcacctgaagtagaaaataattccgttttaaaattacgtgattgcaattgtttcccccattccaagggttgtaatgatgaaaacaacctgccatataaacctgatggtggatgtatgcatgtagcagaaaatttctcaaagaaagaaaaccttaggagtcttgcagagaagagtgacacaaatagtattcctcagctcttacaaacagaagaaaatgtaatgggagtaaataagttactaccagaagagagtgatttataccaaagtaaaaccaatggcttgctttcctgccttcaacatgaaaaaaataaatattcaatagaggagagcagtgttgggcgaaaacccaggaaaaggatgaagttgtctgaaaaagcagatgaaacagttactgagatgaacttctctaatgagtataacaagtctgagttgatgttgcaagaaaatcaaatgattgctgatggtaaagaagcagagactaaaagtcctttaaatgttttgagaaaagtaagccataatacagtctctttgatggatcatttattaagtgtcccagaaacagtagaaaaagaaacaagttctgaacatcatgtaaatgctgtgtttcagaaaaccattgaaccacttttgaaagaagaaacagagaatgcttcagagccgttaggttatgaaagcatggcatcgaaagaggattttaaatcgatgaaaagcttcatagggaaatcacctaatgagtaccatattgaaaggagatcttcacgggaagacttaagaagtgcatctgaagaattgaagttaagctgtcagagaacaatacctatgactggtaaaagaacttggccctattattcatgtgctagaatatctgcctggtgttggaaaaaggcttccttgccagaatcaagttactttcttcgtgggtctcaggaaagttgtaggcaagttgatgtccctaaacaccaaacaaaccagacccatttaactgactccaaattattattacaaagttccttaacagaaacaaacactgaatcttcaagtaaagaaaaattagattctaattctaattgtttgtcttcagtttctgcagtagaacctactttaatggttataaaggaacctataatcaaggatgataaaaagataaaatcagaggaactgagcagaagagggtcagaggtaatttctaacactactgaagatactcaattaaccagtgagactcaaagcttaacgggaaataaaaaaaaagctagaggaaatttaacgaaacttaatttgacagcgacttccaaagatggtcaggaagcaaataactctgcaggcaaaactattcatcgaaaagcatgcattgctcaacaaacatttatagttccagacttggttaaaatattgaacacaggacggctgactaattttaaaattcctttacttaagaataaatcag

SEQ ID NO: 1678 - DNA, 1898 bp, Homo sapiens
aactttgtcttgaggagatgtcctggactcacacggaaacttagggctacggaatgaagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagtgagtaaccccggcccagggcgcagatcacgaccccccacctccatgccccacggacgccccgggtactcccgagtctccgggtctgggatccaccccgaggccgcgggacccgcccagaccctctacctgggagaaccccaggcgcctttaccaaaatccctgcgggtgggtccgggcgagggcgaggctcggtgggcggggctgaccgaaggggtggggccaggttctcacaccctccagtggatgattggctgcgacctggggtccgacggtcgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaagtaagtatgaaggaggctgatccctgagatccttgggatcttgtgtttgggagcccatgggggagctcacccaccccacaattcctcctctggccacatctcctgtggtctctgaccaggtgctgtttttgttctactctaggcagtgacagtgcccagggctctaatgtgtctctcacggcttgtaaatgtgacaccccggggggcctgatgtgtgtgggttgttgaggggaacagtggacatagctgtgctatgaggtttctttgacttgaatgtattgagcatgtgatgggctgtttaaagtgtcacccctcactgtgactgatatgaatttgttcatgccttccctttgtgacttcaagaaccctgacttctctttctgcagagaccagcccaaccctgtgtccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtat

SEQ ID NO: 1679 - DNA, 1669 bp, Homo sapiens
tagcccgcccggcccgggtccgagttccagccccgcgatggcctccgcgggcagcaccgctcggcgggcgggctccggaagctggcactcagaaaggggagaagggagaggtgctcggccgcagccaactccaagtggctccatgcagcaggcgaacaaagtctccttgaaggccacctggactgacgcggagtccaagcagcccagccagcccctgcccgacctcgcagaccacctcagtgcgcaggcgactgccctcgccaggccgcgccgccctgcctcgctcaccccgccccgcgctgaccccagccccagcaaggagtccgaccagacggcaatcgaccagacggcgatcgggagctactaccagctgttcgcagcggctgtgggcaacgtggaatggctgcgattctgtctgaaccagagcctcagggaaatccccaccgacgacaagggcttcactgccatccacttcgccgcccaatggggcaagcttgcatgcctgcaggtcctggtagaggagtacaagtttcccgtggacctgctgaccaacaatagccagacacccctgcacctcgtcatccacagggacaacaccaccgtggccctcccctgcatctactacctgctggagaaaggcgcagacctcaatgctcagacatgcaacggctccacgcccctgcacctggcagcccgtgacggcttgctggactgtgtgaaggtcctggtgcagagtggcgccaacgtccatgcccaagatgccatgggctacaaacccattgacttctgcaaaatatggaaccaccgtgcctgtgcccggttcttgaaggatgccatgtggaaaaaggacaagaaggactttgcccgtgagatgacgaaaatgaagatgttcaagagccagctgaccctcatggagcacaactacctgattgagtatcaaaaagagcacaaaattctcagagaagctgctatcagaaagtggctccacggcaagctgcacccaggccactctctagtctccaataccaagcaagcccgggccaccgccctctccaagaccccagagcaacgggaatcgcagcgttccaggagcttccacccctctgtggatgcacgcctgcaatgcattccacagcccacggagatgcccaagcccatctacaggaagcccacggtcaagcggcccacgatgtggaatgttagcaacaaccccgccagaccccccaccacccagatcagccactcgcagggcatccgcctgggcgtgcatccagaccccactccggagcacgacttcagcagcttcctggaggtgaggcctgatgggctcggcggtgcgcggctgcacacagtggacggccactgggtggcgcccgtgccgcggctgccttttgaggtgctgctgcgcatgctgtacccacgtgtatggccatacagaatgaaggtgccccagggcttttaccccatcagcatgagggaagtgcccaggaagcggcacctgggtgacaacaccttctggaccgacactctggccatgaacctgcgtgacacattcgatgaagccttcctggcagctgtgcgatctcatcaaggactccccaccccgccctccccacaaaccaacccataaagttattatggctacctctccccctgaggcagcccagtg

SEQ ID NO: 1680 - DNA, 1976 bp, Homo sapiens
agtgcggtgttgcgggacggggccgaggcccggtcggttggggcgtgggggcggagaggatggagcctccgaggcgttaggcgactctgtcatctctgggcgtgcagccgtcgtttcctggcgcggcccgtgtgatggtgccgggaggaaggaagcgcagtgacagtgcctaagttggagccggggttccgggggtgaggaggcccgcggacggcggatctggcgagctggccgcgggctgggcgagcagtcacaataggaggcggcggcccagcgaggatccgcgggagctgcccggcagggtggagcctcccctcgcagagtgaagatagtccaagtcctaagagacagcgcctctctcattcagtctttgattatacatcagcatcaccagctccctcaccaccaatgcgaccatcggagatgacatcaaataggcagcccccttcagttcgaccaagccaacatcacttctcaggggaacgatgcaacacacctgcacgcaacagaagaaggttacctataagcatattgccagattttctcccagaaacaggctgtgccaagcagatgcagtttttaacaataatctagcaggatttcagttacagagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacggggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttc

SEQ ID NO: 1681 - DNA, 1886 bp, Homo sapiens
gatgacagtggcgccggaagccggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcagggtctcactctgttgctcaggctggaatgcagtggcataatcatggctgactgcagccttgacctcccgggctcaagcaatcctccgtcccacctcggccttctgaggagctgggaccacaggcgtgtgccaccatgcccagccctccaggggacccctctctcagccaccctctctctggtgatgtcacagtgctgccggaagatcaaagatacggtgcagaaactggcttcggaccataaggacatacacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaacgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgt

SEQ ID NO: 1682 - DNA, 2252 bp, Homo sapiens
catatacgtgcttttctgcaggcatgttatactccaataacacgtttgcttttaaaacatggctggcagggggatgcagggtgatgagaagtttggtctgagtaaccctgaacccctagctctaatttgtttctctgtgactctacaattctacctgctcccctcagtaaataaacacagatctggattaaacatccaaaataaattttaaaatgagaaaaaaatgtgtagacatttaacagagcaattctacctctgagaattcatcctacagagataacccagcaagaacacagaagattcattacagcattgtgagaatgcaaacccgaagccagacgcacaccagcaggatgacaaacgtagactattaagcagccgtgagaatgatgatacagtctgagctactggcacggaaatatagacatggtaaatttaaaaactgaagctgcgaaacggcacggatagcagaaccccatttatataaaattgtgtgcacacacacacacacctagagaagccccgaaagaagtcaccacaatgttgacactggtcatctctgagggatgggatttcaaacgatgtttggctatgtgtgtgtgcatgtgtgtgcgtgtgtgtgtgttatttaaacagcctgcagagtaggagtatcctggatctacagtgcaccaaggaatgaccatgggaagaaaatgaaccttgcttcattcacaatcaaccgtttttccctcattcacagcaaatcctagagaaataacagctgtgtgccacaatccctacgagaaagtacctgcctccaagagaagccacccgcctgctttcatctccctcaaatatggttctgaatctgagaagcacaggaaagtgactgtgtgtaatagtccgcaactggaaacagccaaattatggttacaaggacgagtcagcggtggcctattcatataatggaatatggaatagtgacgagtagcatccagccgtgaacactgcaatatcccctgggagactctcacctgggagtctcccgggtatattggcgatgcctagagacgtatctagttgtcaaacctggggaggggctgctggcatcaagtgggtagaggccagggatgctgctccacaccctccctgcaatgcccaggccagccccacagccacagtgccccaacaccaatgcatctcaacacagcagaaccagttcccttggaagattaagccccagaaacacaagccaacttcaaaaggccaaagtctggattccactctatgcctgggaacctcctctgttccggggtgacatggacgctggagctccacacggtcagaaagcgctccggagctcggctccacgcggtcaggaagtgctctggagctcactcccttccaatgccctgagagatcggacagacgattgctgacgtcagtggcaaagggctgacgtcagtggcaaaggactcccgcccccccgcagacattaaaatgagccctttgggagaataagggattccatccagctcagaagggcaggagtaatgaggccacccagccctctggagggcaccgggaaaggctggaagcagggtctgtgccctgagacacagtccactgagacacagtccatggcccagccacacccgcggctgccccgtttgtctgtagagtgcaggctccccagcaggggagaagcacagatgacacctcactgaccattcccacttgccctctgcagcctgagggcccagacacactgatggcactggcgcaattgacatgaaccaggcacagtgacacagtcacgtgtcccaggacctccgtgggcttccgtggtgcagccctggggcatgtggagtgcccagcctcacccccaggctttaccaggtgccccctcagagcctccaggatgggcctgcaactctgtccctcacaccctggggagcttgcaccccattctgtgccagcaaaagaaggtatctcaggccaggcacagtggcccacgcctgtaatcccagcactttgggagacggaggtggatggatcacttgaggccaggagttcgagaccagcctgaacaacacggtgaaaccctgtcactactaaaattacaaaaattagcagggagcatgcccgtaatcccagctactcaggaggctgaggcaggagaattgcttgaacccaggaggtagaagttgcagtgagccgagatcgtgccattgcactccagcctggatgacagagcaagactctgtatc

SEQ ID NO: 1683 - DNA, 1691 bp, Homo sapiens
gcaaaatgagaccatcagcaaagtctcttgtttgtggcaagcactggagtgacggggccagccagtggttcgcctctctggtgagcggctgcaccctccttgtgaaggtcttctctgtggtgcacagcgtcctgcacgtggatgtgtaccagtactcaggggtccaggatgccatcaacataagagacgtcctcatccagcagggctatgccgagctcacggaggagtcctacgagtccaagcaaagccatgaagttctcaagggcctcttttccaagtcagtagaaaacatgacagatggctctgtgccctttcccatgaaagacgacgagaaatatctcatccggattttgttagagagcttttctaccaataaactgggtactccaaactgtaaggcagaacttcacgggccttttaacccttatgaactaaagtgccatagtttgaccagaatatccaaattcaggtgtgtttggattgagaaggagagcatcaactctgtcattatcagtgacgcccctgaagaccttcaccagagaatgctggttgcagcttccctttccatcaatgcgactggatctacgatgctgctgagagaaacctctctgatgcctcatatccctggcctcccggctctcctcagcatgttattcgcaccggtgatagagttaaggattgatcagaatggcaagtactatactggagtcctttgtggtttggggtggaatccagctacaggggcttccatactgcccgagcacgacatggagcttgcgtttgacgttcaattcagcgtggaggatgtcgtcgaggttaatattctcagggctgctattaacaagctagtctgtgatggaccaaatggatgcaagtgtcttgggccagagagagttgcgcagcttcaagacattgcccgtcagaagcttttaggtttgttctgtcagtcaaaaccaagggagaagattgttcccaagtggcatgaaaagccctacgagtggaatcaggttgatccaaagctggtcatggagcaggccgaccgtgagagcagcagagggaagaacacctttctctaccagctccacaaactggttgtgctcggcacctgagcatgtccacaggtggcctccagcacacccctcgggaagctgtggaggctggattccaggctccctccgcagactgactttcctctgtgtctgggtgttacagtctgtgcccactgcatcctaaaggccttttctttcttcttttctctttgggtgatagtcagagagtggtgtttttgttcaggtgggaaggattggaaactctagtcttttctagaaacagaaaatcactgtattaaatattttggaaagattgttctgaaagaagtctgtttggataaagagctgtattttgctttaaatttattaaggtaaatataagtagttaatcttagatgtaaggttccagaatgtgcttacatattctgttctgttacagtgatttaaaccagtagtataggaaaaaacttaaaaaacaaaaaaaccatgtagtattttctgatttttttttccatgagggaaaatatctaatttttataagactaagttgagttatacttcttggttcacattttggaaatcagagattacagattacatggccatagcttatctgtgttaaaacaataaaagcattaaatg

SEQ ID NO: 1684 - DNA, 1652 bp, Homo sapiens
attaaatggactaatgatgggattgttcttcatatatggaacatacctaagtggtactgaactgggaggtcttattacagtactgtgcttctttttcaaccatggagaggccacctgtgtgatgtggacaccacctctccgtgaaagtttttcctatcctttccttgtacttcagatgtatgttttaactttgattctcaggacctcaagcaatgatagaaggcccttcattgcactctgtctttccaatgttgcttttatgcttccctggcaatttgctcagtttatactttttacacagatagcatcattatttcccatgtatgttgtgggatacattgaaccaagcaaatttcagaagatcatttatatgaacatgatttcagttacccttagtttcattttgatgtttggaaattcaatgtacttatcttcttattattcttcatctttgttaatgacatgggcaataattctaaagagaaatgaaattcaaaaactgggagtatctaaactcaactgctggctaattcaaggtagtgcctggtggtgtggaacaatcattttgaaatttctgacatctaaaatcttaggcgtttcagaccatatttgcctgagtgatcttatagcagccggaatcttaaggtatacagattttgatactttaaaatacacctgttctcccgaatttgacttcatggaaaaagcgactctgctgatatacacaaagacattattgcttccagttgttatggtgattacatgttttatctttaaaaagactgttggtgatatttcgcgtgttttagctacaaacgtttatctaagaaaacagctccttgaacacagtgagctggcttttcacacattgcagttgttagcatttactgcccttgccattttaattttgaggctaaagctgtttttgacacagcacatgtgtgttatggcttccttgatatgctcttgacggctctttggctggctttttcgcagagttcgcagagagaatgttatctttggcattctaacagtgatgtcaatacaaggttatgcaaacctctgtaatcaatggagcataacaggagaatttaatgatttgcctcaggaagaacttttacagtggatcaaatacaataccgtaccagatgctgtctttgcaggtgccatgcctacaatggcaagtgtcaagctgtctacacttcatcccattgtgaatcatccacattacgaagatgcagacttgagggcttggacaaaaatagtttattctacatatagtggaaaatctgccaaagaagtaagagataaattgttggagttacatgtgaattattatgttttagaagaggcatggtgtgttgtgagaactaagcctggttgcagcatgcttgaaatctgggatgtggaagacccttccaatgcagctaaccctcccttatgtagcgtcctccttgagccgagattgtgccactgcactccagcctgggcgacaaatcaagaccccgtctccaaaaaaaaaaaaaaaaaaacttgattgggatccaaaatcatacaactatacactaaaatcagtgaatattaccttatgtaaattaaaaattaggaaatcaaaagaaaagcatacatataaaaaccagttttttctaagc

SEQ ID NO: 1685 - DNA, 2423 bp, Homo sapiens
acccccgctgggctaggctgggccgggttggactgggctggggcgaggggtgaagagcggtggggaaccagggagcgctggggaggaccagggaggctgtgtcccagcgagggtcagggacggagcctaaggggagggggctgccaggagccctggtctgggggactccagcccgcgctcttccgcacccctccagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaaggagttcccttttgtgtcagggtccagagccactgggaaaagtagtgatatcagggccaccaaatatatttggcgggttctggaatacctacgagcgtggccaaggggccagcggcggctgaaatccagcccacaccagcctcctgggctcctaccatcccggtgccttccgtggggacaagtggagctgctgccaccaaaaagacgagacagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtgggagaggaggcctgggtcccgggctctgcatccgtccactgcgagatcgggcctctggctgaacgatgggaccctgagccctgctgtgcacctgcagggacctaacccaaggaatgctggcccctccaggagctctgggcagaaagggtcccgtggaccaggtggtttgggaaatgccacgtgatgtgtgtgatgcatatgagtgaattcgctgaaggctctaaggaggcccgaaaacacgttagaatcccatttctttttatttcttcttcttcttttttttttttttttcagacacagactttcactctgtcccccagactggagtgcaatggcacgatctcagctcgctgcaatctccacctcccagggtcaagcaattctcctgcctcaacctccccagtagctgggatgaccggcactcgccaccaagcctagctaatttttttgtattttgactagagatggggtttcaccatgttagtcaagctgctcttgttttgttgttgttgttgttgttgttgttgtttgatactgagtctcgctctatcatccaggctggagtgcagcggtgcaatctcggctcactgcaatctccgtttcccaggctcaagtgattctcctgcctcagcctcccaagtactacaggcgcaagccactgcacccagtcagggctgcgataggacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtc

SEQ ID NO: 1686 - DNA, 1922 bp, Homo sapiens
actcactgcctccagcttccagacttttctgtcctgtctcttggcccctgacagccaagtgaggcctgagtgaaggccccacattgacccctcttcacttgtaatctcttttaatggagtccgggagagtcacgatggctgtcctcttggggacaaggagtcttggggagaatcgtggggtctgcctctttcacgcgcctgtctcccacttaaccccctcccccaactcccgcacaggccctgccccacgcggctccggacacggaattgcagctgcggtagagatgagatgtagcaacagttctgcagtagtgtggtggtgacttgggtgtgttctcctcctgacattcacctgcacctttttctgcgcttttcagtatgtatgtatttaatagtatcactcaacaaaaaggagtttatcaggccgggtggctggctcacgcgggaggagagcttgagccctgcaggagttcgagaccaggctgggcaacattgggagaccccccccaccaatctctacaaaaaaataaaaaataaagtttataggctgggcgaggtggctcacgcctgtaatctcagcactttgggaggccgagatgggaggatcgcttgagcccaggagttcgagattaacctgggcaacataatgataccctgtctcttaaaaaaaaaaaattatcaaataacagcaccagaggcatagctgtggttatgatggtcaccaagaaggctactgacgtggagggtgaggcggaggagggctaggtctttctctgtgcactgggagccactctcctgaagccccaactgcgtcctcatctttgtggccccagggcccagaccacagcctgcagcacaggacgccccgggaagaattaatgcagccggagagaccagtccacctcctcgtgtcgcgtgtccgcgtggggttgtgggtggtcagggagaggtagggtggatgacccaggaaggccgccctcccctggctctgtctaggaacaatccttgccccaggcctggtccttagaaggcaagacagcccccttccagctgggggatcaatctgctgttggctgcgccagggtgcggctccctcgggtctggcctggtcgtggatccagttccttcacagctgcggcctccccgggtccattaacgaaggtggggaagggcggagaaagggtcggagtctgggaggagagcagctgcgggcgcgccagggcgctgacagtctggctcttggaggtaagatgggcgtggctgatcccgaactccgcctgcgtttgcagaagcgaagggaaccgagcgagcggagctgagctcgggtaggccgcgcgaggtccctcctctccgggcgtccgtgcgcctagctctgcgctgggagcctcgcgccctttgacagcagttagttgctgactcggatgcagagagtcggtaacaccttctccaacgagagccgggtggcatcccggtgtcccagcgtgggccttgctgaacggaaccgggtggccacaatgccggtgcggctgctcagggacagtccagcggctcaggaggacaatgaccatgccagagacggtttccaaatgaagctggatgcccacggcttcgccccggaggaactggtggtgcaggtggatggccaatggctgatggtgaccggacagcagcaactggacgtcagggacccggaaagggtcagttaccgcatgtcacagaaggtgcaccggaaaatgctcccgtccaacctgagtcctaccgccatgacctgctgcctgaccccctccgggcagctgtgggtcagaggccagtgtgtggcgctggccctccctgaagcccaaacaggaccgtccccgagactcgggagcctcggctctaaggcttccaacctgacccggtaaacaaacgacgcgatgtgcagc

SEQ ID NO: 1687 - DNA, 2817 bp, Homo sapiens
gagaggacggtaggcggtggataggagagctggcgcagctgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgatgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcctctacaagccccggatgagtgccagggagcgctatcttaccttcaaggccctgaatcagaacaacacacccctgctcagcctaaaggacttttacgacatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactct

SEQ ID NO: 1688 - DNA, 2624 bp, Homo sapiens
agaggtgggggcgggggccttaccccaccctggcaccggcaggcgcgggcggatggggggatgtcgcctagagccccccggccggcccacaaactcccgtcccccttccggctctgcctggacgtccctgcgggccccgggggaaagcacccaacttctcccgcctcggcttctagcagaaacgtgacggggctggactttgatcgccgagggctctctgctcttcagagtctgcttggaacgggataagagggatggtgccatccagggaagctctgctgggaccaggcacaactgccattaggtgccccaagaaattacagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaaggacacaagaagctctgacgaccagaaagatgatattcccgtggagaactatgtggctcagcgttacattgaaaatccttacctgataggaggccgcaagtttgacctgcgtgtctatgtgctggtgatgtcggtgtttgctgaatgcctgctgtggtctgggcacaggagacaggatgttcacctcaccaacgtggctgtgcaaaaaacatctcccgactaccacccaaagaagggctgcaagtggacgctgcagcgcttccggcagtacctggcgtccaaacacgggcccgaggcagtggagacactcttcagggacatcgacaacatctttgtcaaaagcctgcagagtgtgcagaaggtgatcatcagtgacaagcactgcttcgagctgtacggctatgacatcctcatcgaccaggacctcaagccgtggctcctggaggtcaatgcgtccccatcactgacagccagcagccaggaagactatgagctcaagacctgcctcctggaagacaccctgcatgttgtggacatggaagcgaggctcacgggaagggagaagcgagtcgggggctttgacctcatgtggaatgatggccctgttagcagagaggagggggctcctgacctgtcgggaatgggaaactttgtgaccaacacacatctcggctgcgtcaacgatcggaagaaacaactgaggcagctcttctgctcccttcaagttcagaagaaagcttccagttgatccccagctgccaggaggaaatcagccttagcaggccttgtgtttgagattgggagctgagccagaaaccggaaaaccctgggctcatgggcaggacagcttcgggagttgagtgtcaagcccgaagggaagacttttggaaggaaaatactggcaaatccaagaagtgaaccagccgactttaggaaagccagaagccaggctactctagaccttctgccttcagagcatgaggacttctcccactcatccctgtacctgaggcacaccaacccagacaggtccaggcatggactccaggttccctatttccagaaggaatgcgattagctttttttggcccagcacccaccctgccagggaggaaggggcaattttccagtgatgaaattgtgaatcaggcagtcacactggacaacatctagcaaggtgaattctgcaactccctactttatttacattttaaaataagcaatatattcatacggtttaaaatccaaagtttacaaaagggtatagggtgacatctccttccctcccacctgtgccccccaaccctgcaggtgctgttctgagggaatcacactgtgcttgcacaaaaattattagcttataagacaccagccttccccttgctttcctcacttgatgtatcttggagcttgttccttattcttgattatagttgtatggtattgcactatctggagctaacacctgtgacccacactcatgttttaaaagtttctgcattagtcaaaaatatttaaaaggagattcaactttacaacccatatgtctagcttctcttgaaaacacgtaagaactggccatgacagcctgtgtttctatgtaactatgagccagagccaaggagcggggggaccaggagaggtgtgcccctgccatgctgccatttgttatcacccgcctgtcaaatcacaggtttatttcaaggcaagaaccatgttcataggttgtattctaaatggagtggcgtgcccttactgaaggactagatgaggcaaataaagactagttgctgctatt

SEQ ID NO: 1689 - DNA, 1811 bp, Homo sapiens
agcggcggtggcggcaggtggggaagcgcggctgggcctgctcgcgcggggcgtctgagccctccatttcccggttctaaccgcgcagcagggcccaaccgggaccttgagtgcggcgaggcgtggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtctgcatagtgaaaaagcacatgatcttggaattacctgctgcgatttttcttcacagccagtttctgatggagaacaaggtcttcagttttttcgactggcatcatgtggtcaggattgccaagtcaaaatttggattgtttcttttacccatatcttaggttttgaattaaaatataaaagtacactgagtgggcactgtgctcctgttctggcttgtgctttttcccatgatgggcagatgctagtctcagggtcagtggataagtctgtcatagtatatgatactaatactgagaatatacttcacacattgactcagcacaccaggtatgtcacaacttgtgcttttgcacctaatacccttttacttgctactggttcaatggacaaaacagtgaacatctggcaatttgacctggaaacactttgccaagcaaggagcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgaatctctaggactgcgtagtaaagtgctgaggaaaattgaagagctcaggaccaaggttaaatccctttcttcaggaattcctgatgaatttatatgtccaataactagagaacttatgaaagatccggtcatcgcatcagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaacacatggacttactataaaagcctttttgtactagtgaaaagaatcttcagctatatagaaataaagttatacttt

SEQ ID NO: 1690 - DNA, 2491 bp, Homo sapiens
agccagaccaggaacccaccagaaggaaccaattccggacacataacaagcagcagtgaggacaccaaagacacagacccagatgcagaggcagaggcagccacacagcccctcccagccacaatcacaacctcatattcatataatcacagaccctccaccccacatagtgggtggaatcctgccagcgcattccactcacacacacacaaaatcccattctcacacacgtgcacccaagcctcgtcccgcacacacaacatgacaggccacagagccggctgagagtctcagcacgcatggacgcctgcactgcgcaggttgcagcccaggctgcaggaccacaggtggcagggacgacacagcaggtggccggccagggagtggcagtggcctccatcctccctgctcagccacagcccctgcttcagcgtctgccagtccaactgtcaactcatccactcaactttacaactggaatgtgggggcgttcagggccctgccactggtgacggccactctaagtcctacccaatgctgggtaggtcctttaagaggcccaagtcctgggcgttactatgaggttctgtacgtgcacagtgatggctcatgcctggccgaggtgagcccactcagtctgggtggcacagcctaatctaggaactgctctgcggttctacatggctctcagcagcccagtgagtgtcctctgcaccgggcgtgtccctcaggtgctcctagccagaccctcccttgacacagtagggcacaaaccgctattggagcggcactggcacccgagtgtacaagcgtcagcatccctgctgccttccccacccccagctgtccccacctgctgattctgcccctggggtcacacttacaatttagggtcctgtcaggagacaaaaatcacgtgagtgacatcagctccctcatatgtaggtgctgggaaaagggcttgtggggtgcctgtataaactggccataaaaatacgggaataagttgtggaaagccacaaaaggcctctgaggaggaaagcctcctaattgccatcatgttcccatgctcagagcaagacccgctgtcttctctgtaaacactgtgctcagggagaaagacacttctttgaaacactggaatgtggacagacgtgcaggctcccagtcaaggccgctcctactagctactctccaacaagttaaagttatgctgtttgagcacaaaggagactcatttaaactgctattgctatagattatgcctgtgatgcactgccaccctttcactgtttctccctgaacatctgcttcttagatcgaagggactgtactcaataaatagtgtggagaccagagctcggcaccttttgcagcctccacattttgcactggccccctggctccccacctttcactcttaacttgtcttttctcaatcctttgtcaccaccagacttcgggtaccctacgggtagtgttgaggctggtccccaacatgtaggatcccttcactgtgtcacatgtgtccctaacacacttgctacatctcatgtcctttaggttctgtgttttactccagataatgttctttgaatctaaattacagtttactgatttctcaaaagctgcacctaatgtgctatccattcagacagacatactcacttagcaaatgtttgttgagccagcactcagtggcagattctgtgctagggcgtgccaagtgcagacacacgtttgccaagacacagggtcacatgtgcatgcacactcagacttgcaggcttacaccagtgttcagcctgctcccaatcccagggagctccagggaggacagagagaatgtcacaacacccaacccctcccactgcatgctgagtccagttcccgatacgctgccaccccaacagcatggcccagggccgagggtctctctgcagacctgccctgaccacattcacacacacacacacacacacacacacacacacacacgaagaggcatgtgccttgttcagatatacataaagctcacccatcgccaaattccctgcctgtgcctgctgggaccagactccgctgtcatgagggtgacatccgccacctgtgctcttctgctggctctgatctgcagcgtccagctgggggatgcctgcctggatatcgataaactgcttgcgaatgttgtgtttgatgtgtcccaagacctcctgaaggaggagcttgctcgttacaaccccagtcccctgacagaggagtccttcctcaatgtccagcaatgctttgccaatgtctccgtgacagaaagatttgctcattcagttgttattaagaagatccttcagagcaacgattgcatagaagcagccttctgatctgaggacccctgcagatcagatattggccctcctgccttccttggggctccccgcgttcctggcctggctctgttcatcactacagagaccccaatgaacacctgcagctc

SEQ ID NO: 1691 - DNA, 2569 bp, Homo sapiens
tcacaggaagttgaggcccagagagaggaaggggctggtttgatgtcccatatagagaggtggcacagccagggctgggtatcccagtcccgtgtcgtgtccagcattttagtgcagactcacatgcacatcaaatgcacaaccatgcaatgacagacaagcagctccacaggaggagtgcacaaccagaggggagaggagagagcctggacagcctctgtcctcacctcctcagtggccatgtggtgacggctgggttttttatttttttctccctagatgagcttcacatctcaggtaactggagaagtcttcagcttgtcttgtcctctccacaggtggggtgcccactgcttcaacaggggccagaacagtctgccctcttccatagctgtaaacctctgcttggcccagcaggagtgagggtagaggggagtagggctcaaggtgccctcgctacctagtagatggtaggagagcataaccaaaagccaaagagctgtttacatgactgggttctccctgtggccttctgagattgcaggagatggaaagggggagaccggatcctaggggaacccaatattcaggttttcctgggttcctgagatgcaagatttccaattttaagacatgggaagttgtaggcagactgggatgagttggtcacctgggtcttccatagctcccagtctgagaaaatgagactcacccagtaataagcagaagatttggctgggtgaggtggctcatgcctgtaatcccagcactttgggaggccgagacaggcagatcacaaggtcaggagtttgagaccagcctggccaagatggtgaaaccccatctctactaaagatataaaaattagccgggcgtggtggtgggtgcctgtagtcccagctactcgggaggctgaggcaggaaaatcacttgaacccgggaagcggaggttgcagtgagccgagatcgtgccactgcactccagcctgaagacagagcaaggctccatcttaaaaaaaaaaatgcagaagatactatggaatgggccaggagaaaaaggaaggatcagggatgggagagacacagtgagccacacagtagctggcattctgcatggtgggcctgggcagcctggctcttcatttgcatatgggtctttcccaccccagtcaaatctgctggagccaattctgcttccttccaacaaagatgcccagacacctggcggtagtgtgttacttcctgctcccagctcctctaacacccctggagagctccatgcccacaggtcttaccttcacccactttcccaggctcttagatcaaacatcaggcacagtgcaggcaatggggccatcctcccaagtcccaaaagccttctgtttccagtagagatgggagaagcctgaactaagcaggtttctcacttccttatggaggaagaagagctaagagaggtgactgattttagtacaaagggcacagggcacagaaacatgcaggaatacattagctgcgtgcactccagtgatacatagcctctgtaaacctgtttccttatcctgaaaatggggacattgttcctatcttgtgattgtattaaggatcaaatgagcagctgctcaacagaggtttctggagaggtccttctccacacagacttgggaggagatgcttgtcctaggtccaaatctcatccaggtttcccgattttttcaggtcttctgctcaactcaggtaccagctgacacccacccagtccctggtgttgccttcaggagcagtggcaagatgggagctggttggggaaggggatcctagcgcaggggggaggaggagagaatggaatggctggactttgagatgagaagacagttggatggggaggaggcaccatttgctggaactgaagggttctcagtaggggctcgaggcaggatgtatctgtgatatctggacctctggagtcccttaagcacaaggaggcaagtgtgtggcagtgaagacattctgccttgggcccaagcccaagacaggtctccctgagccctgggcagaccatccgacctatggtcattggaaggacccacctcctccctatcccaggcctgtgtaaacgccaggaaggcaggtccctttctccatgcaggccctgactggggcagtcagcaccattaagttcttcctctctgaggctttcctgggtcaacacttcgaggctgtgtagttggagggcagggagcctgagccaggagacgtcttcctgttcaggctgattccccccacctgacgctggtgcggggcccacgttggcatatactgtggccatggagagatcatccactttgagggtgagtgcctccagcagaaacacaggcccaagtctgcggagaggctgcccagccaagccacgccccaccagtgagctggctactcggggataaagactgaagtcccaggctgggggtgtcaatggacgtggacgtgtccccggattaagcatgaccttggccctcctgggtggacgtggaggcttcagaaagattcattaaactactttccaaagctt

SEQ ID NO: 1692 - DNA, 1899 bp, Homo sapiens
attctcctggaacatggcgccaatccaaacattaaggatatctacagcaacactgctctccattatgctgtgtataataaggggacttcactggcagaaaaactgctttcccaccatgcaaatattgaagcactaaacgaggagggaaacactccacttttgtttgctataaattctaggagacagcaaattgtggaatttctgttgaagaaccaggcaaatttacatgccattgacaatttcagaagaacagccctcatgcttgcagtacagcataactcatcaagtatcgtcagcctcctccttcaacaaaatataaatatcttttctcaagacctgtttggccagactgccgaggattatgctgtttgttataatttcagaagcattcaacaacaaattttggaacataaaaataagatacttaaaagtcatctttgaaatgataatcaagaaacagcagctatgaagccttgaattttgaaaaaaagacaagaaggtgcaaaagggattcaagacgtctgactagaggcatctagcatttgcctcctccacaaagaagaaccaaaatagtgagtgatcacacttctaatagataatctaaaaaagaatactggaattcaacagagaagtaacaggaaacacctaacgcaaggaaagagagggaagagaggcagcctgcctggctagggttggctgggaacctcaaagaggctccacaatgtgggaaaaagtctttaatcctggcagggattcacgggcgcacacacacacactcaggattcagatcttgttgaaagctgcgatatcgacactctgcacgtgctcctcaaacttggtgatctcctccagcaagtctgtccccaccttgtcgtcctccaccacacactgaatctgtagcttccggataccgtagcccatgggcaccagcttggaggccccctagaccagctcttccagctggatggagcacacacaggcctccagctgggccatgtcagtctcatcgtcccaaggcttgaaatccagcaggatggaggacttggccaccagttcaggcttcttggccttcttctccgcgtactgctgcagccgctcctcctgcagctgtgccgccttcttgtcctcctcctcattgtcgctgccaaacaggtcagtgtcatcatcgtcgtcatcctctgctggtgtgaatggcttcttggccaggggctccacttggcgcatgggagacatgtgctgggtctgtggggccgtggcccggtggccaggcgagttcttctccagcacgttcagccgggcctccagcttggagatgacctgctgcagctcctgtaccacactgcgcaggctctggttctccactttcagactggtgatccggacgacgagctcgctgtggtctccgctggggccgctggaggccccggggcctgagtttccggccagggatttctggatgttctctctggctctcgcgatgtcacggaggatcacgctggcgtcgttctcttggcgggaggcaccggccacaggcccattcatctgctcgtagaatctcctttctgcgtcgtcatatttgaacttgtcgaaccagatcttctcatgtactaggaagtttgtagccatttttctgacgcctgccaaggacgcgacgaccagggaggaggaatcggcggacgcgggacacctgaggaaaggctaaagtctgtagttaagttgctgctacttttgagtcaataacatcaagaccagtgttggtgaatcttttggcctttccccaatgcttgaaagaagatcaccactgctggaggcataatgtacaaggcaggaaaagggatggaattgatggtgacagctaagtctgtcttttttcttaggaaataaaggttttcctaggat

SEQ ID NO: 1693 - DNA, 2089 bp, Homo sapiens
tttactggagttgtgcgcatgcttgcttgaggcatttttctcttaaccagcgcaatgtacttaggaggtcatgcgccggttaaactctgccattatgcctcttactgggcatgcttgagcccacgggcccaactcctgagatcccattcggaagctgctgatcaccagtttcaagtgtttctgtttattgggagactgccttcctctggcactggcagtgaccaattattattttagagagactgttaacggcctgaccatcacctgatgaatatcaggaatgtggcctgacattcctggtgtgtgtggtgtggggtacgaggggagctctctcctacgctgctcatgtctgactagttggattctgcagagtggaagtgggaaactccttctgaccctggccacctgtctccatgtgaaggcagatccatttgagtgacagtccgaggcaatacctcaactgcctctcacttcccaagacaaataaacccacttgaccttgatgtgctttttgtgaatacattgtgagattggactttcggatattttatttagaatttctgcgtctatattctttgggaggtacacggagcgccttcttttcgtttagagcattggtgtctccacattagaagcatcctatgtagctgttctgcttgcagctgcccaagtctgcctgggcctcctgcatgaggtcatgagtcttaataaagccactgacccacacatttggaatcgtactgacttttcacaactaacagccaacacattgccaagaagcaattcaattgttgaggatatcacatcatgccagggaaagagagatggaattcagaaagcctgggatattgcagttcagataaattgcacttggtcaacggaaatgtcctaagggcactgcagctgcagctggagaatgaagaagacataaaattagggcttttgtcactgtcgcttgatttcattaaagggcattagttctcggcgagatatatggggttggagaggacaggagccagaagctcccagtgcagcagcaaggctggcccacgtgagcacctggagcatcatttctgctgccacatgcttgggctgccccaccccgccgtgccctgctcagccgtgccctgctcagccgtgccctgctccatctccctcgccaggcctgagaccggcccccagtgtgttgtgactcctgaggtctctcagctctccctcaacccccaggagaattgctctccactccagaagccgcctgatggggaggctgacccctctccaggactgactgatccaggtttatcctgacagtaacctctccccaggtcggaagacctctcaggctctgtttctagggaggctgacctgctgacaatgctcctagctggattttgtaagcggtcttgaataaagtcttcctcactgttttaacaagagacaaggtaatgttcattgaacatcttatacaaagaggaaacctggcacagaagtggacatgcactcggagggaaaatgccaagtgacaatgaaggcagagatcaggtgatgcatctgcaagctgagcaacatcaggaattgccaaaaaccaccaggagctggagaggcctgggacagagcctcccacggagcctcaagggagccagccctgcccacgccttgatctttgacgtccgacctcaagaactatgaaagaacccatttctgttggtgaaggctccccgtctgtggtcccctgtcctggcagccctaggaacctgacctctggtccctctgcatccctggcatcactctgcctccctctctttttctccagtgaatccaacacactctcagtgagacagccaggtggcaaggggttctcggagaaactccagccggcctgctcgctgggcatgtacactggagtggagccacagaagttcacggtgtttgcagcagggaggagcctggccactcctcttcctggttggaacctggaatttattttgtgaggcgggaagcctatactggggagactcttgctctgctgagtccccattccccctttattttcctttttgcccaataaatcctattattctcagtcttc

SEQ ID NO: 1694 - DNA, 1645 bp, Homo sapiens
ataacaacataggaacaggtcacccgcgtgttactcaaaactgtaggacggcagtgagggctttgctaatcccagaacagaggtgtaacctggctgcatatccagcctcgagaaaatgtctacagcagatctgatggagaacctcagggaggaactcacctgtttcatctgcttagactatttcagcagcccagtgaccaccgagtgtgggcacagcttttgtctggtgtgtctcctcaggagctgggaggaacataacacacctttatcttgtcctgagtgctggaggaccttggagggcccgcatttccagtcaaacgagcgtctggggaggctggccagcatcgccaggcagctccggtcccaggtgctgcagagcgaggatgagcagggcagctacgggaggatgcccaccactgccaaggcgctctccgatgacgagcagggtggaagcgccttcgtagcccagagccatggtgcaaacagagtgcatctctccagcgaggctgaggagcatcacagagagaaactccaggaaatcctgaatcttttgcgtgtaaggagaaaggaagctcaggctgtactaacccatgagaaggagagagtgaaactgtgccaggaagaaacaaagacttgtaaacaggttgttgtgtcagaatacatgaaaatgcaccagttcctgaaggaagaggagcagctgcaactccagctactagaacaggaagagaaagagaacatgaggaagctgaggaacaatgagatcaaactgacccagcaaatcagaagcctaagcaaaatgatcgcacagattgagtcctcaagtcaaagctcggctttcgaatctcttgaggaagtgagaggagccctggaaaggagcgagccactcttgcttcagtgtccagaggccaccaccacagagctgagtctgtgccgcatcacgggaatgaaggagatgctaagaaaattcagcacggagataacgctggacccagccacagctaatgcctatctcgtgttgtcggaggatctgaagagtgtgaaatatgggggaagcagacagcagctacccgacaacccggaaagatttgaccagtctgcgactgtgctgggtactcagatcttcaccagtgggagacactactgggaggtggaggtgggaaacaagaccgagtgggaagtgggcatctgcaaggactctgtgagcagaaaggggaatctccccaagccacctggggacctgttctcactaataggtttaaaaatcggagatgattacagcctctgggtctcgtcacctttgaaaggtcagcacgtcagagagcctgtgtgtaaggttggtgtcttcctggactatgaatctggacatatagcattctacaacgggacggatgaatccctcatctacagcttcccgcaggcttctttccaagaggccctcaggcctatcttttccccctgcctcccaaatgaggggacaaacacagaccctctcaccatctgctcactgaacagccacgtctgaggggcgtgccctgagccgtcacagcgggcgatgtctgagaccaagacacaactattaagacgatgaaggcatcgacagtattaatgtcaggtgatctgaaataaactcccgtaaccccacccc

SEQ ID NO: 1695 - DNA, 1898 bp, Homo sapiens
acggatgtttattatcaggatcctcgaggagcagctccgccatttgaaccagcaccttatcagcagggtatgtattatactccaccaccacaatgtgtgtcccgctttgtccgacctccaccatctgctcctgaacctgctcctccctacttggatcattatccaccctacctccaagaacgtgttgtaaactctcagtatggcacacagccacagcagtacccacctatatacccatctcactatgatggccgtcgagtgtaccctgctccgtcttacacaagagaagagatattccgagaaagccctatacccattgagattccacctgcagcagtaccatcgtatgtaccagaatccagagaaagataccaacagatcgagagttactatccagtggctcctcatccaactcagatcagaccttcgtacctcagagaacctccttatagccggcttcctcctcctccccagcctcatcctagtctagatgaactacatcgccgacgaaaggaaataatggcccagctagaggaaagaaaggttatctctccacctccttttgcaccttcaccaaccttgcctcctacctttcatccggaagaatttttggatgaagacttgaaggtagctgggaaatacaaaggaaatgattatagccaatactctccctggtcatgtgacaccatcggctcctacattggaaccaaagatgcaaaacccaaagatgttgtggcagcagggagtgtggaaatgatgaatgtggagagtaaaggaatgagggaccagcgattagatcttcagagaagagcagcagaaaccagtgatgatgacctcatcccatttggagaccgaccaacagtgtctcggtttggtgccatctcacgaacttccaaaactatatatcagggtgctggtccaatgcaggctatggcacctcagggagctcctacaaaatctattaacatttcagattatagtccatatggaacccacggtggctggggagcttctccatattcacctcatcaaaacataccttctcagggacacttcagtgagagggagagaatatctatgtcagaagtggccagtcatggaaaaccccttccatctgctgagagagaacagctacgactagaattgcagcaattgaaccatcagattagccagcagacccagctacgtggaccagaggctgttagtaacaggctggtgttgcagagggaggcaaacaccctggcaggccagtcacagcccccaccaccgccacctccaaaatggcctgggatgatctcaagtgagcagttgagcttggaactgcaccaggtggaaagggaaatcgggaagagaacacgggaactgagtatggaaaaccagtgttctctggacatgaaaagcaaactgaatacaagtaaacaagcagaaaatggacaaccagaaccacaaaacaaggttccggctgaggaccttacattgacattcagtgatgtaccaaatggatcagccttgacacaagagaatatcagcctcctatcaaacaagaccagctctctgaatctgtcagaggaccctgagggaggaggggataataatgactcccagagatcaggagttactcccagttctgctccttaaaatatgaggagtcctacttttatcttctgctcctaatcagtttgtcgggcataggggtaggagaacgcataacttctaaactttttctcttaagagcggtcagagaaatccaggaaattcaccagaggcaatgtgcacaaacaccactactaaaaacaaaccctgcacatagttcacattaatgcatttttttaatttaaagaaaaagaaaattagcagtatctgcaagcaattcagattaaatttgtttttgttctgtg

SEQ ID NO: 1696 - DNA, 1926 bp, Homo sapiens
atgtgtgtgtgtgtgcatggccagagcagaccctgtccccaaggccaggccatggggtgaacatcagcaccagttccggggccgtgccaacctgcatgtgtttgaagactggtgtggcagctctatccagcagctcaggaggaacctgcatttcccactgtacccccatattcgcacaaccctgaggaagcttgctgtgtcccccaaatggaccaactatggcctccgcatctttggctacctgcacccctttactgatgggaaaatccagtttgccattgctgcagatgacaacgcggagttctggctgagcctcgatgaccaggtctcaggcctccagctgctggccagtgtgggcaagactggaaaggagtggaccgccccgggagagtttgggaaatttcggagccaaatttccaagccggtgagcctgtcagcctcccacaggtactacttcgaggtgctgcacaagcagaatgaggagggcaccgaccacgtggaagttgcatggcgacggaacgaccctggagccaagttcaccatcattgactccctctccctgtccctcttcacaaatgagacgttcctacagatggatgaggtgggccacatcccacagacagcagccagccacgtggactcctccaacgctcttcccagggatgagcagccgcccgctgacatgcttcggcctgacccccgggacaccctctatcgagtgcctctgatccccaagtcgcatctccgccacgtcctgcctgactgtccctacaaacccagctatctggtggatgggcttcctctgcagcgctaccagggactccggtttgttcatctgtcttttgtttaccccaatgactatacccgcctgagccacatggagacccacaataaatgtttctaccaggaaaacgcctactaccaagaccggttcagctttcaggagtacatcaagattgaccagcctgagaagcaggggctggagcagccagcaggttttgaggaaaaccttctagaagagtcccagtatggggaagtggcagaggagacccctgcctccaacaaccagaatgccaggatgcttgagggaagacagacacctgcctccaccctggagcaagatgccactgactaccgcctccgaagcctgcggaaactcctggctcagccccgggagggcctgctggcccccttctccaagcggaactccacagcgtccttcccagggaggaccagccacattccagtgcagcagccagagaagaggaagcaaaaacccagccctgagcccagccaagattcacctcattccgacaagtggcctcctgggcaccctgtgaagaacctgcctcagatgagggggcccaggcccaggcccgctggtgacagccccaggaagactcagtggctgaaccaggtggagtcgtacatcgcagagcagagacggggtgacaggatgcggcctcaggcccctggaaggggctggcatggggaggaggaagtggtggcggccgcaggccaggaaggacaagtggagggagaggaagagggggaagaagaggaggaggaagaggatatgagtgaggtgttcgagtacgtacctgtgtttgacccggtagtaaactgggaccagaccttcagtgcccggaatctcgacttccaagccctgaggactgactggatcgatctgagctgtaacacatctggcaacctgctgcttccagagcaggaagctctggaggtcacgcgagtcttcttgaagaagctcaaccagaggagccggggctctgtggattttcctattccggacatcttatgcaaatggaaccatgtaatgtgtggcctttatatcgggctttttgcagaatattcacttagcacaagtttcattcgtgttgtagaatctattaaacacttcattcctcg

SEQ ID NO: 1697 - DNA, 1820 bp, Homo sapiens
tccgtcctcatctctaaactctccactaaccaatttaaaggatcttaaaagcttctccaggagagagacttaggaaaaaaaaagatttctgagtcagtgctaatgagtccagttactgaatttgtgaatagctattccctggcttctggatgttagcccaagttgaatagcatagatgtggttgagagtggggtctgggagggatagagagcccaccccccacaatcccatgactgagtggagaccaaccagcctggccaattcaaaggcaagaagatttgaggggggaaagttgtccacgtttccctctctgcttcccaccccatctctctcaacttcttagtggtcctgccatactttcctagcacctctctttcacccggggagcccaagcgtcctctagctccatctcctcgcctgctccctgcctccttttcagggctgccctgcacactggctcaccactgttggaccctgcacatggccaccttccacagatggcactccttgggagcagggtccttgtctttgtattccagtgtccccagcactgagtgcaaggccccatgcagggtaggaaacctgaggtttcaagctcagggttttaagctgtgcagtgcactaagctctctgccaaaaaacaaacaaaaaaaggtttctgtggttaaataagtttgggaaatgctgcaccagacgtcccctttttatagattcacaatacacatcagcatatttgaggttccaagaagtcctccagtaaagaacttggttaacccaatgttttctctcactgaattgagcccagagcccgtttccttacagattgcttttgagccttcctggggcaccctctgcgtgaaatgtcaccgtgtgccctccctgtggagccccactccccagcctcctcccctctgtggtcattttggattttctgactacttccttctagccatagctggggccgagggctggttcacagtctggccactgggcgtcctgtggtgaaggccagatgcagccctccctgagtggctctccctcccactcagtcactactgagctaagtactgattcaatttggggtgccaaaggttgggggtaggatatttttaagctctccaatttaaaaaggaagggcctctcctgtggaaagggaaggatggcagagtcgtgagaaaggtgttgtcaagggaccaaaaatccttggctgttcagtcactgcggtcttgatccagccccagggggatgggcttcactggcagagctgggtactgctgtgcttttgccattaaaattctgttattaatgactcatcatcagtgccccagaggaagtgtgagaggacgagagggaggtggctcccatcagcagggccagcctgggtcaggatgctgggttaaagcccggcgccctcaccaatgagacctttgtgggaagctctactgcctcagtttccctatccggagatgctgttttcagggagtcctgacactatgatgggaacaaggctatttggtttactatatcattagtgctaatatagtgtggggcactcagatgttcagtaaatatacattcaacaaataagtgagtgattatactcaactccccccacccaatgcccagcaccaagcctacccagcacatagtaggtactttaagtaatttgaatgaataattttaaataacttgaatgaataattctgtattgccccccactcgccgcctatacacacgcacacacgcacacacacacacacggtttcctgtgctacttctggcacttagtaattattcaataaacacaaaatgtttgttgc

SEQ ID NO: 1698 - DNA, 1713 bp, Homo sapiens
ctgttagaagcccggggttatggaagagaagcgtggaaaccagcgaccagcgttcaggtagattaggaccaaccccggcacttagctgcacaggaacaatggcgagcccctttgggcgcctcactgatcagaagggcagaggacaccctgctggatctggaggagtggaagtcaatggcgggtctgcgagggcggcgttcagcggtggtggacggagggtgttgagcggtggtggacggacggccttcggcggtggtggacggacggccttcggcgatggtggacggacggccttcggcgttggtggacggacggccttcggcggtggtggacggacggccttcggcggtggtggacggacggccttcggcgttggtggacggacggctttcggcggtggtgaacgagtctcactcttgtcaccaggctggagtgcattggcgcgatcttggctcactgcatcctctgcctcccgggttcaagcgattctcctgcctcagcctcccgagtagctggaactacaggtgctggacaaagatcagaccagatgtgaggaatgctgaaaatgaaagtctcttctgatatgttcaccaaagaaagcgatcccttagcccagatcttggcaagaaccagtgtcaaagggatgttcatccagtaatcctgaattgttggacacccaagaagagaatcaagatgaaaatctgtgcagttctgtgagatttctgtagtactttgttctgcttacacttcaaaagcaagctagactttcaacttagtatagcattgtcatttccactgatgtatttcctgagtatagataccaactctcctgatttcctcaggactaaaggagtttctgggacaagaaaattatagttttaaaaacaggacagccccagcaaactgggacaagttggtcacactatgcatgaggatgtgtatatatgcatatttttatgtatgctaattcatattataatttacataccatatttatactaggaatcaggtgtgttaaatcccatgatacacatatgtttatactccaaaatctatgtaattaccatctatttctaaaaaacattctagaaacaaaagtaattatgaaaggctattttactatattttggaccatatatcatcataccatatttaggacctcatttgttaaggctaactacctgaatatcttgagcagccacaagtttagcccatttcatgggactcattatagcaagtgttcatttctcccaccctctgttcatgtccccagttatatgaacaggaattttttgttagaatagaacaaattctttatttttgctatgttacagataatggaaaagcttgcatacatggccactttggaggatagacacttttcctcatttaacaaaatagtgtgaatacataagaccatgccatcatttttattaatcaaagctgttaccttttctgaaagaattgttctatttccttgagctcattgtgatgaatcttgagtctcccctcaagaattaagctgtgttctggaagatgaaaagcagccctccccaaagttataccaagacatattggaatatgcttttctattatatctagatatctggatggaaaaattagactggggatttattttaaaaagagagacatttcatacttggtatttgaaaatacgctagcacagctcttggaaataaacagtaatctaac

SEQ ID NO: 1699 - DNA, 1878 bp, Homo sapiens
agtgtgtaagtctacagttgtgtacagtagtgtcctaggccttcacattcattcaccgctcactcacccagagcagcttccagccttgcaagttctattcatggccgaaatagaactatttgtgaacagacttgattcagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagatggtcagaggttctgtaatcctggatttcctattggctgttacattacagataaaggccgtgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcgcaattctgtactttggttataccatgataatggttttgatcttctttctttttacaggaacaattggcttctttgtatgcttttggtttgttaccaaaatatacagtgtggtgaaggttgactgaagaagtccagtgtgtccagttaaaacagaaataaattaaactcttcatcaacaaag

SEQ ID NO: 1700 - DNA, 1864 bp, Homo sapiens
aaccccgttaccccccagcccacacaccaccaccccagttttgggtggggagaaggcaaagggagagatcatctctcaaaaagctcccatcagagcaaccattctgggactttgagcagaatgcttaaggcagtggttctaaaattccacaccacctgttcttccagttgtgtcctctctgagctgcctctgacggtcacattccatggccatgtgccacagcagacttgtgatactgattttagtgttgtccttggccattgggggaagggaggaaggagagagaagagaaggggagagaagaagagaaatgggagtggggtccattcatccatctctcttgtcattaggggcccagcagttcccactatggtacctaggaaactagcttggacctggaggccatccagtgacctagtctgggccagtaaagccaccaggccattttcctgcttcggacatgctttctcagctgccctcccccttagctaaggctgaaatgactcatcttcccgtgccctagttccacggggtttcatctctgtgactcgggacagaggccttggttgccaccaaaggcagcttatggtgtagcttcaggtctggcctgactcagtggccttccctcagctattcactacagaggcagttaatgaagaagacacaagggtagcaggcctgagggataacttcaaggctaacgtgtcttttttccagtacttactcttcttttgaattttaagaattccagattttattctaagtcagagaatactgtgagaaaggattttattgtatccactctctccaaatggtgtgaacatctggatttgcatccttcccatgacagatatcacaaattgggttgggttttgcatgctgaggatgatttttggtattcagctaacacccttcctttaaggaagttagaacacttgataaattttaagcttttgatcctcagtagtacccctggaaaattaaggtccagtgaggtaaattgtcttgattaattatatgacatgcactgctttttggtggctcttttgttgtgttttgttttttctttctccttcattttgttaaaatgaattatgtgaatgtccaggttagcagtgttctattttcataggataagccccatctctagtactgtttatttccattgtgcctatttttcagggaactctgtgcatttccacatttccatcaccagctctaagaagaaaatagaaaatgagatattagaaggaaatagaacaaaaactatctgccttcaaggagctcacagtctagttctggagactggacataagcagtctctgctctctgcttggactggtgtcactgtgatcattctaagttacagagacagttgacggctttggagtgaaagctaggagccaaggagtcctgagaaaactataaatgggcatggaatgtcctggataattctgtggtggggaaattaattctgaaccactaagtactattaagaagctgatgccaactaaataggcagaaatttttacaaaagctgccagagtttagaaaccacccagtgtgccatagcttcaggggagcaaaactacccactctaccaagttggaaaaaatgaagaatgcttcaaactgaatccagctgatcctggaggccactgaccctgtcctaatggagacaaaaagtgacagtatttcgaaaaaagcctggttttggtacagctcttccagaacccacgggaagaacctgttcatcagctcatccatccgtctgctgagtaaatgcttattgagcatctgctgaatgccagcactgttctttgttcttggaatacatcagtaaacaaaataagaaaaacaaaacc

SEQ ID NO: 1701 - DNA, 2357 bp, Homo sapiens
tttagtaaaagttcccaccttgcagttcatcagagaattcatactggagagaaaccttacaaatgtaatcgatgtgggaagtgctttagtcaaagttcctctcttgcaactcatcagacagttcatactggagacaaaccctacaaatgtaatgaatgtggcaaaacctttaaacggaactcaagcctcactgcacatcatataatccatgcaggaaagaaaccatatacatgtgatgtatgtggcaaggtcttttatcagaattcacaacttgtaaggcaccagataattcatactggagagacaccttacaaatgtaatgaatgtggcaaggtcttctttcaacgttcacgtcttgcagggcaccggagaattcatactggagagaaaccctacaaatgtaatgaatgtggcaaggtcttcagtcaacattcacatcttgcagtgcatcagagagttcatactggagagaaaccttacaaatgtaatgaatgtggcaaagcctttaattggggctcattactaactgtacatcagagaattcataccggagagaaaccttacaaatgtaatgtgtgtggcaaggtctttaattacggtggatacctttcggttcatatgagatgtcatactggagagaaacctctccattgtaataaatgtggcatggtcttcacttactattcatgcctagcacgtcatcaaagaatgcataccggagagaaaccttacaaatgtaatgtgtgtggcaaggtcttcattgacagtggaaacctttcaattcataggcgaagtcataccggagagaaacctttccagtgtaacgaatgcggcaaggtcttcagttactactcatgcctagcacgtcatcggaaaattcataccggagagaaaccttataaatgtaatgattgtggcaaagcctatactcagcgttcaagcctcactaaacatctggtaattcatactggagagaacccttaccactgtaatgaatttggtgaggcttttatccaaagttcaaaacttgcaagatatcacagaaatcctactggggagaaaccacacaaatgtagtgaatgtggtagaacttttagtcataaaacaagtctggtgtaccatcagagaagacatactggagagatgccatacaaatgtattgaatgtgggaaagtctttaactccactacaaccctggcaaggcatcggagaattcatactggagagaaaccttacaaatgtaatgaatgtggcaaggtcttccgttatcgctcaggcctcgcacgtcattggagtattcatactggagagaaaccttacaaatgtaatgagtgtggcaaagcctttagagtacgttcaattctgcttaatcatcagatgatgcatactggagagaaaccttataaatgtaatgaatgtggtaaagcttttatcgaaaggtcaaacttggtttaccatcagagaaaccatactggagagaagccatacaaatgtatggaatgtggcaaggcgtttgggcggcggtcttgccccactaaacaccaacgaattcattctagtgaaaaaccttataaatgtaatgagtgtggcaaatcttacattagtcgctcaggcctcactaaacatcagataaaacatgctggagagaaccttacaactaaactcaatgtggaaaggccgttagatgttgtcctaacctctgggatccccaaataatttatacttactcatatagcttgtatatttgtcctttccctttgaagtctcatgtggaattgtagtaatctccagtattggaggtggagcctagtgggaggtgattggatgatgggggtggctttctcaagaaagttttagtaccatccccttgttgctgtccttgtgatagttctcatgaggtctggctcatgcctgtaatcccagcactttgggaggctgaggtgggcggatcacttgaggtcaggagttcaagagcagcctggccaacatggtgaaaccctgtttctgccaaaaatacaaaaattagctgggcttcgtggcgggtactggtagtaccagctactcgagaggctgagtcaggagaattgcttgaaccctggaggcggaggttgcagtgagccgagatcgcgccactgcactctagcctgggtgacagagtgagactccatcacgcacacgcacgcacgaaagtgaatggcacctccctcttgtttgttcttctggccatgtgacatgcccttcacctcccaccatcattttaaccttcctcaggtttcccgagagggtgaacagacgtcagcgccatgtttcctataaagcctgcaaaattgtgagtcaattaaacctctttatacatt

SEQ ID NO: 1702 - DNA, 2337 bp, Homo sapiens
aagaaaccaaggaaggcttaagatgcagaaccttgcttctctctgaggactgccttttaggaggccatttggaaagtaattttgaaacactgctcctttgccagtatctgaaaggtgctggatggtgtcagctggaagatgaggggcaacctgaggtagctgaaaaaactttggattaggtgtcaaaagggtgccaggtctcatctccaggcctttcctctaggccaggcagtgtggaaggaagcatttgctgggacgcagtatgaccaggacccagaagggaaagacctttctcccccattgcttctatcagtcactgcccccacgactgggatggggcatgattttaaactactcaaaattgaaaggcaaggaggagtgtgcctctgtctccagtgtgcctatggtcttcttcagctcacagtaccgtctacaccgcaagagccaatatttgaaaatggctgctgcaaaccttaccttctctcaggaggtggtgtggcagcgaggcctgcccagcattccttatagccagtacagctttgaccacctctacaataccaatgacatcatccatactccccagatcaggaaggcccggcctcagaaacctgttagcttcaagttcctgggttcctcaagtcccttaacaggagacacctccctggctgtgaagacagaaagctctgccaatcccgaaaagaagctgaagaaatcaaagccagccagcaccgtccgggaagcaccccgccctctcatccatcatccctgcatgcatccagatatgctgggtcggccaccttctctagatgtgaacctggaggaaagagaagcctggcttctgcctcctgagaaggaggccagagcgtgggaggccactgtgctggaaaagctgaacgagcgcacagcccgatggatccagagcaagcgtcctcgaaggcctggggcatcccccaacaagtggcagagcttcctgcgccagcagtacgactggagtcacattcgggatgagcttacctctgccagtgacctggagctcctgaaacagctggaggcagaagagacagcagagtttgaggatcaaagtgtcatcctgcccccacaggaaaagaagaagccagaactgctgcttcccgtttactacagattgcccagttacttccaacaagcagagacagttgagatcatgcctggcaacaagagcactgaggatatccatgaaaagacgagcctctcccagccccaaacccagagctactttcgccaggtgactccccgagctggaaagtttgcctactccacagacaacacctttgaacaggagatttactttgatgaagtccagatcatccaccagattggtgcaaagagagaccagattgtcctggaaaacctaaatcggtacaacaagcagctatctaaggtcttccctgaaactccagaaaagtggagtgcccaggcaattcctgaagcatcttacagacctgtgcaaggagccctgcgctggactgctttgcccacccccgccaaggatatgctgctgcaggtgggtgagaaggatgtgcctattaagaccaggtgtacggctggaagcttgccgtagcatcctagccctgaaacttcaaggggaccgggtcagggacaccttcctagacgtgctgctcctggagaaccacgatgctgttctaaaggaaatgtaccagacaatgaagatactcaacttaggaaatgaaggaaaccaagaaatgcttcaggagatcaagaacaggattaaaacactaagccaaaaggacttgctgacacacaaaatactcaagctggagatggtcatgggaaaagtgagggaggaagcaaaacgtgtttacttgaaacccaaaggagaacaaggaccactaacactccagactttactccaagaaacttttcaggatgagatggttcttcctagaagaccttccgaggtttgtgacactgaagcagtgataaagcctgtgaagccccgcgcaccaaatccctggttacaaagttcagtcccaggcctaaccacacgaagcaaagttcgttcatcacttgtcaaagatctacgcacctcccccgagaaaaggattgctgtgggaccatttagatccgactacccagctctttatctgggtaaattctcagagagaacatttttttctcccatcatgtcttctccctctggaaagaaaggtgctcatctctaagctgaacacttgtcttacttcaagatgcaggaagcagtggacctggtcacattgggtctttttaattgatactgtacaatcttgttgtcactatgtttataaagagaaattattt

SEQ ID NO: 1703 - DNA, 1857 bp, Homo sapiens
actctctgctgtcgcccgtcccgcgcgctcctccgacccgctccgctccgctccgctcggccccgcgccgcccgtcaacatgatccgctgcggcctggcctgcgagcgctgccgctggatcctgcccctgctcctactcagcgaccacggccagacgtcctcgctgtggtggaaatgctcccaagagggcggcggcagcgggtcctacgaggagggctgtcagagcctcatggagtacgcgtggggtagagcagcggctgccatgctcttctgtggcttcatcatcctggtgatctgtttcatcctctccttcttcgccctctgtggaccccagatgcttgtcttcctgagagtgattggaggtctccttgccttggctgctgtgttccagatcatctccctggtaatttaccccgtgaagtacacccagaccttcacccttcatgccaaccgtgctgtcacttacatctataactgggcctacggctttgggtgggcagccacgattatcctgatcggctgtgccttcttcttctgctgtctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcatgtgaaacttaacactttataaggtaaaaatgaggtttccaagatttaataatctgatcaagttcttgttatttccaaatagaatggacttggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcatttcagctaaggcttcatgttgactcgatatgtcatctaggaaagtactatttcatggtccaaacctgttgccatagttggtaaggctttcctttaagtgtgaaatatttagatgaaattttctcttttaaagttctttatagggttagggtgtgggaaaatgctatattaataaatctgtagtgttttgtgtttatatgttcagaaccagagtagactggattgaaagatggactgggtctaatttatcatgactgatagatctggttaagttgtgtagtaaagcattagggtcattcctgtcacaaaagtgccactaaaacagcctcaggagaataaatgacttgcttttctaaatctcaggtttatctgggctctatcatatagacaggcttctgatagtttgcaactgtaagcagaaacctacatatagttaaaatcctggtctttcttggtaaacagattttaaatgtctgatataaaacatgccacaggagaattcggggatttgagtttctctgaatagcatatatatgatgcatcggataggtcattatgattttttaccatttcgacttacataatgaaaaccaattcattttaaatatcagattattattttgtaagttgtggaaaaagctaattgtagttttcattatgaagttttcccaataaaccaggtattct

SEQ ID NO: 1704 - DNA, 1492 bp, Homo sapiens
cttgtttcctgagttgtcctgtgctggaggtctgctcagacgaaggtctccatggcgttagaagtcttgatgctcctcgctgtcttgatttggaccggtgctgagaacctccatgtgaaaataagttgctctctggactggttgatggcctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtagtttctgaggaaactctcctttttcaaaccgagctgtactttaccccaaggaatatagatcatgaccctcaggaaatccatttggagtgttccacctctaggaaatcagtgtggcttacaccagtttctactgagaatgaaataaaattggatcctagtccttttattgctgactttcagacaacagcagaagagttaggattattatcttctagtccaaacttgctctgagctaaaggagaaatggaaacttgaagctggtgttatgtattttgcagggaaacagtttcattttttcatagcaaaaatatagttggtgtatatctctccttaagtctctggtttctaaaaaccctacttcagtaaaggtcctgattagttgattagtgaatgtgtatttctaaatatttgtattcagtaggggtatggctgattaatttaacattaactattaggtaattcatattatacatttaagttctttctgttctgtgtagaagattcagaaatatgtcttcaaagacaatgacttgatctaattgataagaacctccaataaatatgttctaatatttttcaggaagaataaagaatagagagagacatataaatgtgcaagaggcaaaactttgagcatagtgtaaaatttaacatattaactctcacgaaaggcaaaatccttttatgtgcagatactttaattcatgtagattttcctattaatcagtaaagttgaatcctaacaataatgccatgtgacaacctatttagattattccagaattaaattcaatttattttctagagctcaagtaaccactaccttaactgaaatttgatgttaggtttcccttgttcctccgaatggttcttccacactcaaaataattgaatggttgagttggttaagcaaagagttatcctgccacctaagagcattcattaaatgattatttattaccacctactttatactatcttcctttctttaaacatggagtctaaatatgtaatatatcaaaaaatacttctgatttggtagatttcttatatcaagggtgagaattgaactgtgccattggctattcaatagcttattgaatgtatgttttggatgccacatcctcctggaagcaaattttgccaagatactgtttattattatttttaattaaagtgatactattccattttc

SEQ ID NO: 1705 - DNA, 2006 bp, Homo sapiens
atcgttgggtagcagcggggaggcgtgggaggatctgaggcctgcggtgggccttggtcccttctctccccgccccgaagccgcctgctcaacctgagggccaccggcctctatccgtcggtgccgatgctccttgcttcccagccagagcgtctcatctctgggcccggagccccaggctcgttctcctcagcccctgccggcggcggcgctcttgcagccattcctgtgaggtcgtttttcggagcagccgggccggccgaggaataaatgaaatctgcttaacatttggacaaattctttgttgtcagcccatatgcttcaacagcttactatggcgtttgtcccaagaaatctaccgtaagttgaaatatggaaaatatgagagccacacccgtgttcacacaggtgagaagccctttgagtgtgatatttgtcaccagcgctattcaacaaagtctaacctaactgttcacagaaagaagcacagtaatgaaacagaatttcataagaaggagcacaagtgcccttattgtaataaacttcatgcaagcaagaagactttagccaagcatgttaagagatttcatcctgaaaatgcacaagaatttatttccattaagaagactaagagtgaaagttggaaatgtgatatttgtaagaaatcttttactcgaagaccacacttggaggaacatatgattctacattctcaagataaaccttttaagtgtacctattgtgaagaacattttaaatcacggtttgctcggttaaagcatcaagaaaagttccatctgggtccttttccatgtgatatatgtggtcgccagtttaacgacactggaaatttgaaacgtcatatagaatgtactcatggtggaaagagaaaatggacttgctttatctgtggaaagtcagtacgagaaagaactactttgaaagaacatttgagaatccacagtggagaaaagcctcacctttgtagtatttgtgggcaaagttttcgtcatggaagttcgtatagacttcacttacgagtacatcatgatgataaaagatatgagtgcgatgaatgtggaaaaacatttatccgtcatgatcaccttacaaagcacaaaaaaatacattcaggtgaaaaagctcatcagtgtgaagaatgtggaaaatgttttggtcgtagggatcatctcactgttcattacaaaagcgtacaccttggagagaaagtgtggcaaaaatataaagcaacatttcatcaatgtgatgtttgtaagaaaatttttaaaggcaaatcaagtctggaaatgcattttcgaacgcattcaggtgaaaaaccatacaagtgtcaaatttgcaatcagtcttttagaattaagaaaacattaacaaaacacctggttattcattctgatgcccgacctttcaactgtcagcactgtaatgcaacatttaagcggaaagacaagctgaaataccacattgaccatgttcatgaaataaaatctcctgatgatcctctcagtacttctgaggaaaaacttgtatccttgccagttgagtactcatctgatgacaaaatctttcaaacagaaacaaaacaatatatggaccagcccaaagtttatcagtcggaagccaagacgatgttacagaatgtatctgctgaagtatgtgttccagtaactctggttccagttcagatgcctgacactccgagtgacctagtgcgtcatactaccacactcccaccatcttctcatgagattctgtcaccacagccacagtcaactgattatccacgagcagcggatttagcttttctggaaaaatatactcttactcctcaacctgcaaatatagttcacccagttcgacctgaacaaatgctagatcctagagaacaatcttatcttggaacattactgggccttgatagcactactggtgttcaaaatatttctacgaatgagcatcattcatgagtaaatctaaacattccacag

SEQ ID NO: 1706 - DNA, 1767 bp, Homo sapiens
aaaaactcagagaaagatgaacaaataaaatggcctcaggggaaataggaataacgcaagaaacaaaaaagaacgaaagaatagttttttatactctatttataccttcccagggattcaagggggcattggatgcatcaaatacaactggatggtatgaggaaaaaagaaacagagacccagagagagctcttgaaaattcaagaaatatatatgcttttaaatttaatagaattgttggccgggcacggtggctcttgcctgtaatcctggcactctgggaggccaaagcgggcggatcacctgaggtcaggagttcaagactagcctggccaacatagtgaaaccccatctctactaaaaatacaaaaattagccaggtgtggtggcacacgcctgtaatcccagctactcaggaggctgaggcaggagaatcacttgaacccaggtggcggaggttgcagtgagctgagattgtgccactgtactccagcctaggtgacagagcaagactccatctcaaaacaaacaaaaaattttaatagacttttaaaattaaggaaatttctcagagtgaaataaaaatataaggaggtagaaaacataagacataaagaatcaatccaagaaataaaaaatccaacaaatgggaattcctgcaaaaacaaataaaaatggaaaagatgaattatttaaagttacaataaaacatttctcataaagttcaaaattttccatattgaaagagctatgtacccagaaaatgaatgaaaaaattatctacactcaggtacagcatcctaacatttttgaacacagggataaagagatctaaagctttcagatgggagcaaaatgaaaataaagaaaaaaaggtcaaaaaggaatgagaatcagaatgacttcagaattctcagcaatactagatgctagaggacaatggagaaatgcttcaactgctcagagaactgaactttccatctagaattctatataggctgaactatcacttttaaggatataataaagacatatggagatacataggagtcagaataccttcatcatctgcactgttccttaggtagttacctggagagtgtgccccagaaaaacaaggaaatacaccattaaagaggactttcaaagagactggacttcatgcagaaagccgtgaaaggaagtcagacgacagatgtccagcaggcttgcacactagcagaccacactgaagtaggataatagagggccttgaaaggaagtctctggggaaaggaggagaccaggtgaaagagagactagataaatattagggaaggataaaggcagttagaaactgaggaaaagaaaaggtgtggctgggagtggtggctcacacctgtaatcccagcactttgggaggccacggcgggcggatcacctgaggtcaggagatcgagaccagcctgggcaacatggtaaaaccctgtctctactataaatacaaaaattagccaggtgtggtggcgtgcacctgtaatcccagctactcgggaggctgagacaggagaatcgcttgaacttgggaatcagacgttgtagtgagccaagatcgcgccactgcactccagcctgggcgacagagtgagaccctgtctcaaaaaaaaaaaaaaagagggagtccatatgtgttaccattgtgcaaaaagcaaaggagctatgctgctctgcctatggagtagcctttcttttgtttctttactttcttaataaacttgctttcacttt

SEQ ID NO: 1707 - DNA, 1881 bp, Homo sapiens
aaccgtcactctctgttcttgctatctaatggccgctgcttccgccatggctgaggcttcctctgagacaacctcggaggaaggccagagcatccaggagcccaaagaggccaactccacgaaggcccagaagcagaagaggcgagggtgccgaggctcccgcaggcgccacgccaaccgccgtggggacagcttcggggacagcttcaccccctatttcccccgggtgctgaagcaggttcaccagggcctcagcctttcccaggaggccgtgagtgtcatggattctatgatccatgacatattggaccgcatcgccaccgaggctggtcagctggcccattacaccaagcgcgtgaccatcacctcccgggacatccagatggccgtgcgactgctgctgccggggaagatgggcaagctcgccgaggcccagggcacgaatgccgccctcagaacttcattatgtgcgatatggcaacagagaaagtgaatatgctgatacaagaagcaagaaaccttccttacttccaggtgtgtgtcagtaggattacggagtgtccacggaaacagctcatgccctagtgtacagtggtacagccaatgagtgacctgcagtctatgagcaacagtcattgacccaatgtggggggagtgacccaagctgaacccacagcagccttcctgttatattcaacctggtgtttaaaggaacggcagtgtgattctttacctgatgtttttgtttgcattgcttgtaatcatgatcttttagggatatgaatccaaagctaagattagaatatgtaccttgtccctaacatcaagttatacagaacattggcaaccattagtagaagtcagataacgcttatttcctcaaaagattagcatatttatattcatgttaatattaatataggctacctttcattgtgctctcttctgggtcccaagtcttggcattttaagcatttttttctataagtgtattgctgaatttcagagcaggtgctcactttcccattgctttccttttccattgatttccagtcgcccgagtatgtggacaagagaacatactctgggactgcaacccacaggaatttattatgttgtgccttgaagctcaacatgtggccatttttgttaaatgtttcccgtaaattttgaaacatctcataaacaacccttctccttcatatgtagaaaccagtaaaggatggcactctcagtcaaaccatgaaacaaaagctggataaatgacaaaaatcaaaattttcttgagcccatcagaagtgggaaagaaccaccccagagggcccaacacatagccacatagattattccaccatttaaagaggaccccttggtcaagagggaaacagggtcagggcaagatggtagccagagcttccctgagtagtgcagatgggaagaggggaaggtcacctccagagctccacttgggatccatagagaaatgatatagaaccaagaagtccactcattgggatctgttactttctgtttttccagattattagaaaaatattacagaaatagctgaagagaaatgttatgaaaatagttgaagttgtgcttattgcacgaggagaccaagaaaaaccccacaaaatcagctgcaagtaaatccttctggatggtgccaccaaatgttcctacaagtccggaacaacccttgccaaaccaaagacccttgccagaaccctgcttcttcccagagacagagctgtgtacctgacaaaacaccacatctcactcagtgacttatttctcattatgctaattgttttgctgtaaaatgccaatgtttctgtgaattaagacatacgaataaatttctgaagttacccttgc

SEQ ID NO: 1708 - DNA, 2558 bp, Homo sapiens
cagccacatgctggctttctaaggccaacatcccttccacgtctgtctgtggttgctggttttgatgcctgtttagagcagacagatctcagcgcagtggggagtgctgaaatgggttcccttccaaaagggaaacccccagaggggcagtccttgggagaaacaatttagcagcaagtactgtgaaattaaccctgcacctttgaccatgtgatcccagttccagatttttcatctctcttttgtgttataagtaacacccaaaatgatactgtttcataggaaaagtgttcaaatatagagcccctggaggagaggaattgaaagcaatgtgtctgtggcaggtggaagtgctcagagccttcctcctgagaacagggtggtgtgggctctggagaggggacctggatttgggtcctgactcaagttgggcaaaccgcctgccgtttctgctcatctgtgaaatggagtcacgcatccctgctgtggaggagttgggtgaggacttggttgaatcagcgatgggtcacagcctgcagaggcactcaagggtgtgcgcggcatggggtggcgatggagcctgctggaggaagggaagggtggtgagggtctcattattctgaccgtcctcgatatcaggtgtcaggaggaggcagaggtggtacctgtcacagggcgaaggccagggggctgcttcctcacctggctccttccccaggtccctgcttccccttctcggtgagcgcggaactggatggggtggtctgccctgcgggcactgcgaatagcaagacggaggccaaacagcaggcagcgctctctgccctctgctacatccggagtcagctggagaacccaggtaatggagggagggccaggcagctgagccgcagctggggacaagaggcctgaggctggcagtcccgtggggaggcggaagtggctgtgcgtgtgagcaggaggtgggttgctgtacaaaccatctgagcatcaggacgtcacctgcagggagctggggcggggtacatgtgccggtccctgctttcacgtcctctggggacaccgggggtagggactgctagaagagcagctcgtgtaatgtcctgtgtctggaagatgaaaacttcctctccccgcctccttggcttcctgagggacggagggtgggccttggcacccacaccagcccgccctccttgcctctttcagagtccccccagacctccagccggcctccactggcccccctgagcgtagagaacatcctgacccatgagcagcgctgcgcagcgttggtgagcgccggctttgacctcctgttggacgagcgctcgccatactgggcctagatcccgcgtgccaggggccacgtgaaggagatctacaagctggtggctctgggcaccggcagcagctgctgtgctggctggctggagttctcgggccagcagctccacgactgccatggcctggtcatcgcccgcagggccctgctgaggttcttgttccggcagctcctgctggccacacaggggggccccaagggcaaggagcagtccgtgctggccccccagccagggcccggacccccattcaccctcaagccccgcgtcttcctgcacctctacatcagcaacacccccaagggcgcggcccgtgacatctacctgccccccacctcggaaggtggcctcccgcacagcccacccatgcgcctgcaggcccatgtgctcgggcagctgaagcctgtgtgctacgtggcgccctcgctctgtgacacccacgtgggctgcctgtcagccagcgacaagctggcacgctgggccgtgctggggctgggtggtgccctgctggcccacctggtgtccccactctacagcaccagcctcatcctggctgactcatgccacgaccctccgactctgagcagggccatccacacccggccctgcctggacagtgtcctggggccatgcctgccacctccctacgtccggaccgccctgcacctgtttgcagggcccccggtggccccttccgaacccacccctgacacctgccgtggcctgagcctcaactggagcctgggggaccctggcatcgaggttgtggatgtggccaccgggcgtgtgaaggccaatgccgccctggggcctccctcccgtctctgcaaggcctcctttctccgggcctttcaccaggcggccagggctgtggggaagccctacctcctggccttgaagacctacgaggctgccaaggctgggccctaccaggaggctcgcaggcagctgtctctcctcctggaccagcagggcctgggggcttggccctcgaagccactggtgggcaaattcagaaactgaagccagcctcggcgggaccgaggtcccggagccaagctgtacccctgctgggggagtgccctatctgaggagcgttgtggggagaacatgggttgtgcggggtgaaactggggctggagggaaggaggagcctgctgtggttgggaggcggctgctgcacgtttgggcttgaataaagaagtatttctggtt

SEQ ID NO: 1709 - DNA, 1901 bp, Homo sapiens
cagggctagggatggtgaccactggctttcctagcccacagcaggtgggcagagggcggagctgagtcagctttatcaggaggcctcatgatttggcttgggcagccacattcccgaatgtcaggccttcccctgttgcttgggagtgagaggccgcctccctggccagacagagggtttctggaatgtgtgaggccaggcgtcctgagggtgggcagaggtgttcagagctgcctctttccctcatcaatgttaggggcagagacacaccgagactcgtagccctacctccccgccagactccttctgcaggcctccaccccggcgtgtcctgagtccacgctttcctaacccaaactcagggcttctgcttgcaattcttgctctgtggagccaggttgggtccactctgccatctgatggcccccaggccagaggccctcatttccttctgctaggggctgggtccccaatatcacagccctggccccaacctgagtcctatcttgccccagtgaatgtggggaccaccgggcccagcctccctgcctcatcccctgcaggagtctctcttcccagcccgagtggtctatgacctcctgttcttcttcatcgtcatcatcattgtgctgaacctcatctttggggtaatcatcgacaccttcgctgacctgcgtagtgagaagcagaagaaggaggagattcttaagacgacatgcttcatctgtggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggcttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatct

SEQ ID NO: 1710 - DNA, 2650 bp, Homo sapiens
atgctgatgagccatggttaatacaattttatctcactaaatgtcgtcaggatttaagggaagaccttcacacagatttttctgtatctacgtgatgatcattttcctgcttttcctttctgtcccatcttcactcctccacagtcatgttacactagtatagtcatgtgagtgtgcccatgagtgactccaagttgagttctaaaaagcagatttcacttagccagctgcccttgtcagtttcagccttgggagtcaccttttggtatcttttcccactgcttcttcctcctttctcaaccatcatttctcctctccactggattctactcacagggtttgtaatctcccagatcattcagcatctgaatgaattcagccgccaaggggaagatcactggcagatcccagtgggggtacttaccccttccagactcttcctgaggaaagcaagttaccttccatgtagcaggagtacattttatactagtttggccttgtgactgttagagtgggaagtctgagggaactggagaagagatgcagttttaacagaggaaaaacatttagtagagactgtcccttctgccttcgggcgtgtccctcttctgggcatcttttcaggatttcattcctacgtccaactgccgttcacaactgccctttccaactgctccagaactcttggccctggcattccgtgatgtaaattattccacacatggctcaaaagggtgtgaagctgtgtgccaggtgtcggatcactagtttgtcatggatgatgatgatgactcgtgtctccttgatcttattggagacccacaagcattgaactactttctacatggacctagtaataaatctagcaatgatgacttgactaatgcaggatattctgcagccaattcaaattcaattttcgccaactctagtaatgctgatcctaagtcatccctcaaaggtgtaagcaaccagcttggagaagggcccagtgatggactgccactttcaagtagcctccagtttcttgaagatgaactcgagtcttctcctcttcctgatctcactgaggaccaacctttcgacattcttcagaaatccttgcaagaggccaatatcactgaacagacattggcagaagaggcatatttggatgccagtataggttcaagccaacagtttgcacaagctcagcttcatccttcttcatcagcatcctttactcaggcttctaatgtttctaattactcaggtcagacgctgcagcctataggggtgacgcatgtgcctgttggagcatcgtttgcaagcaatacagtgggtgtacaacatggctttatgcaacatgtggggatcagtgttcccagccagcatttgtctaatagcagtcagattagtggttctggtcaaatacagttaattgggtcatttggtaatcatccttccatgatgactattaataacctagatggatctcaaatcatattaaagggcagcgggcagcaagccccatcaaatgtgagtggagggctcctggttcatagacagactcctaatggcaactccttgtttgggaactctagttccagtccagtagcacagcctgttaccgttccatttaacagcacaaattttcaaacatctttacctgtgcataacatcatcatacaaaggggtcttgcaccaaattcaaataaagtcccaattaatatacagccaaagcctatccagatgggtcagcaaaatacatacaatgtgaacaatttgggaattcagcagcaccacgtacaacaagggatctcttttgcttctgcaagctcaccccagggctcagtagttggtccacacatgtctgtgaacattgtaaaccaacagaacacaagaaagccagtcacctcacaggcagtgagcatcactgggggcagtattgttattcattcccccatgggccaacctcacgcaccccaaagtcagttccttatacctacaagcctttctgtcagttccaactcggtacaccacgtccagactataaatgggcaacttcttcaaactcaaccctctcagctcatttctggccaagtggcctcagagcatgtcatgttgaacagaaactcttccaacatgctcaggaccaaccaaccatatactggaccgatgcttaacaaccagaatactgctgtccacttagtgtctgggcagacatttgctgcctctggaagtccagtgatagccaatcatgcctctcctcagcttgtgggtggacagatgcccttgcagcaggcatccccaactgtattacacctgtcacctgggcagagcggcgtttcccaaggaagacctggcttcgccaccatgccatcggtgacaagcatgtcaggacctagtcggttccctgctgtcagctcagccagcactgcccatcctagtcttgggtctgcagttcagtctggttcatcaggatcaaactttacaggagatcagctgacccagccaaacaggactccagtaccagtcagtgtgtctcatcgtcttccagtttcttcttccaagtctaccagcaccttcagtaacacacctggaacaggaacccagcaacaattcttctgccaggtaatgccctttcccaaataaatatttggctgattat

SEQ ID NO: 1711 - DNA, 2063 bp, Homo sapiens
gtttccaacaacagaggctgcagccacccagccccgaagcagggcccagcgagacagggcccagccccaagcgtgacccagctgcagagaagctgagacggtgattcggactgactggactctggcctccaggtgtctgcacctcacactggacccacctggagactccacgggctcccggcagctccggctgcttgggtggatccgggtgcccgcaggggctgtgggagggccccggggcctgcactgctcccccgatggcctgctcttcctcacggccggggctgcaccctgtgtccacgtgctagatctggagggacgccccatctgcctcctgccctgccgcactccggggagcggggccttcgttccagaggacgtggctgtgacagcgtcagggcttgtggtggtcagcgatcccatccatggggctgtccatgcactccagcacacagcccgggaccccgggggccactgggtgacagtgggcaccttcctgtctccccgagggctggctgtggatgccctcaaccgcctcctggtgacggactacttgcctggggctgtgcacagcttctcgttgggtcctgcttgggagcccctggccccagcctccatgctgggtctggagggcccctgctgggtgggcccagggcctgatgggggccttgctgtgagtgaggagtttggggatgtgaggctgtttggcagtgcccgccagcccctgggctccctggggggctggacggggcacactttcggctgcccagcgggcatctgctccaactcagagggcaatgttattgtggcagacgagcagaggcgccaggtgaccctgtttccccgggctgggccgcccatctgcctggtgtcagaggggcttgggcagcccttgggagtggcctgtgcaccccagggccagctcctggtggctgatgccaaggacaactccatcaaggtgtaccagggcctcaaggagctggcctgacctgaggctgggttggagcagccctcctgtgcctgaggccagctcccaggcccttggatcaccgcgggaggaaccctcaggatgggtggagcctccaggctatgggcattgcctgcctgatgccagcaccacctgggctgggccctgggcttggctcgagttctcctgctggtgaggctccggatctcaggagcagccctgagtctgcttcccaggctgcccctgccaggcctgcagcctccccagccagggctgctctctgctgtccccattcagtgccctggcccctgcattcatgccccccacaccccctcaggccctgtgcctggactttggggctggcagctgaagccttgagatcctgggccagctgccggcacacagctaggcagactctcccaccaggtgcccctgcccaggcctcctaatcgggggcagacaggcagggagggtgtggctgggctgggctgggcggggcggcctggggcaggggtgtggcccctaaatgtccccaacctcagagggacctagagtcctgagcctccagtagcttctctgggcctggcagaggtaagggggaggcaaccctggagtgtctggaggcccatggctggctgaaccctggatgccttttcttccgcgtccccatgaatgaaagctgtctgggccttcattctgcagacagggacaaacagctccatgctgtttgtcctcccagtgcagccgtgctgggagggtctgggggagcttcctacaaggagagactcctgctgctttggaaaactgagaaaaaataggggtctaaccctctcctcccattttacaagtggggaaatgaggcgtgaaaggagaggcgtctgggttactccgtgggtctggggtccagggaagggcctgtatgggggagggagctgggaggggacggtgtctggctctacccctgtggggtggggaggtggggctcccctgtatcacaggacatcccccctgagaggtccctcatatgtctgggtcctgtgggtgggggactaactgcgcaatgtagttaggtgctcaataaacggagttgccgctg

SEQ ID NO: 1712 - DNA, 2217 bp, Homo sapiens
cttatgtagattactcttagatttaagcagacagttttatagaggaactaagaaaaaaatggaagctctcttgataaaaagtctgattttccctgagtaccaaaacagacctcagtaatattttggaaatgtgtctgaaaatgttttgcaagactgaagaagttgcatgagaagctttccaggatcacaatggaaaggaaaggaaaacacttgccttcatgagaaaccgtctaaattttagtgagagaacattgttaattttttgttgttgttgtctttggtttaaaagatttgaattaattggtctctttgcagcttgtctgaaaagaaatatcaattaggaaatctacttggtagtttaatttattttcgttttatgtaaagagtatcatttggttctttttaaaacctctgaactcaggtaaagagtaggattgcagagtctctcctctgttgattcctgcctcccctttgatgacccccggggaggtatgtttgttttcttaacagcatttgaatcttcctgagacatctcataaagtggatttctctgtcaaaatattcttttttaagccttcaaaaacaaaaattcttactgtcttctttgatgatttcttatgttcaggttcagacagtaactttaattccaggagatggtattggcccagaaatttcagctgcagttatgaagatttttgatgctgccaaagcacctattcagtgggaggagcagaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggccttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttaggttcatgggacggctccagacattgcaggcaaggacatggcgaatcccacagccctcctgctcagtgccgtgatgatgctgcgccacatgggactttttgaccatgctgcaagaattgaggctgcgtgtttttctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacac

SEQ ID NO: 1713 - DNA, 2180 bp, Homo sapiens
ctcccactccacaaaggtgctgggtggctctccggacaggagctggcctgactctcactcctctgaggctttcctggggcctcctcccatcctgccatgagcaattgtttgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcagatacagatagatctgggcttagggaaggagagaccttattccaaagcacgattgcagaaggggaaagggaatattgcaaaagggagaggaaggggccttatgggaatagtgaaaaggctcagaccgaccgatggcaagatctgcaagcgtctcaaagcccaggcagagagggacttttcttttgttggaagaagtaaacatggctagaaagaaccacgttcagggaatgacgttgtgcccagccttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaattttttttttaagggccttggagccatctctaaaacaaacctcaagggatttagtgccctgtctccctgtctctagaagccttagcctgggcacctggctcaatcttgtaactgcctgctagccatagattcctttcagccttgctggcttctccctataaaggtaaagcctttttctgccccagctctgggacacttgcagatcttaaggtctgagacttgctgattttctggttggagtgtttttttgtattgccatggtcccttccccctgaagcagtggcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgtt

SEQ ID NO: 1714 - DNA, 2412 bp, Homo sapiens
ataatgttttgatcagttcattgcttacttgcatgtctgtgggaggaagaggaagtctcatcaggccaagtcatgtggtgaggctggaaatccataactgagattagctacccacagtgagcatgggagtgagtgctgtgagccacagtggtactgacatcgactttctaattcccacagtcacagaatctcaaggactctgagccaattcaaagaaaagatcctgtacagtttgaatatgtaacttagcttaagagtaccctgcagtcacaagatttattaataaaagggtttggctttttaatttgtatttgtttagtttatttgttttatgcagcctgggtcttgctatgttgcccaggctggtcttgaactcctggcctcaagcgatccgctcgcctctgcctcccaaagtgctgggactataggcatgagccaccatacccagccaataaaggggtttcaatatatttctttttattttttattttttgagatggagtcttgctcttttgcccagggtggagtgcaatggcacgatctcagctcactgcaacccctacctcccaggttcaagtgattctcctgcctcagcctcctgagtagctgggactataggagcttgccaccacgcctggctaattttgtatttttagtagaaatggggtttcaccattttggccaggctggtctcgaactcctgacctcatgatctgcccaccttggcctcccaaagtgttgggattataggcatgagccactgtgcctggctgggttttagtatatttctcaattgtcctgatttcctcctgaagaggaaaaataacctgaaatgtgttggtggctgttgtttttttaacatgtctgttgactttcaggccctagactggagctggttacagacggaagaagaagagcacagctgcctggagcaggcctcatgatgtggggggactcgaccccctgacatggggcagcccatagcaggccttgtgcggtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggggatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttgg

SEQ ID NO: 1715 - DNA, 2016 bp, Homo sapiens
aattctaatagcataaagcatttttttttcccctgggatgttatcgtccctaagttttacatgttttaaactaagctgtaaatttagcttgaacaattttaataacatttccaaagatgtatcttaaaaaggaatttaaaagaaatactgagcttttgaagtcaaacacaaccccctttcttacaaaagcagtcaacttactttaactgaacatttctttgtcctgaagttagaaataacttcagcaaaaatttctccacagggttgatattttaatgatgggaaccttaggttaatatgttcattttatactagtcgtttatagtcatttgtgaatggaatggtgattgacaaatacatttgctttaatgtggagctggactataatatatatggatcaacttcaggtgttcatgtctgtctgttctccatgtcgagtacgattgtaccttctcttccctcctgcactgctttttgtcgtggatgaccaggctgtgagttcttccagatcaaagatcatatcatgttgtgtctgtagccccagcatgtagagcaatgctaggcagcagtatgtggttaataaatgttggttgaatgaatacatgattgactgaatgcatgtatgtctaacagtgtttgcaactgacagcctttttgaaaaaattattttgaatagttataagttcacaggaattccccctcccattcctcagacacaggagattccttgtctcctccctaccagttttccccactggtagcatcttacatgacgtaatacagtgccaaaactaagaaattgacattggtataatccacagatcttcttcaggatcactgactttacatgcactcatttgtgtgtcctttgtatcagttctaggcagttttatcacatgtattgatttgcatggctaccaccagaatcaagataacagatcttgtgtatgtggggttccatgcccacaaggcttcctgtgctactgttttgtagctaaccctgacccctcataacaggattttaatcatcctgaccttgtgctttacattagcttctgcattaactatggcatgaagaactataagatgtttctgttattaagagacagcagcagtgattttatctgtattcattgcccagtccacagatcatccctcatccatgatcagtttacacattttctgtttaaaaaaattatcttaaagttggctttcctagagtaatgaattgtcaacattatcataatgggagtccactcctattaatcagaacttagagaccacatgttgtgttcattatccagaaaatgtatcgagttgcaaaacttaagtagaatgctaaaaattgggatccacagtattaatgagctaaaaattgacaagtgcatcttagaaaatgcttctgtgagcaaaaaaatttgcaggctcatacgcaatgaattggagtgttcaacacggtttaattggcggctgtggatgtcttgtgcataattgaggttgtaaagatggatgcatgtggtaggcatggggggtctaaatgggtgagtgtgtattgtaagggaatccgtcccttccgacatactgcaggctgggttgcagatacagtgatccatgtttatgtaagcaaggtggaaacttctgatctagaagggaaaaaacaggtgcttttgtatgtttttctttcaggaaatagttcacattttccagaaagaaaagtttttttttttttttttttggagacggagtcttgctctgttgccttggctggagtgcaatggcgtgatctcggctcactgcaacctctgcctcccaggttcaagcagttctctgcctcagcctcccgaatagctgggattacaggcgcccaccaccatgcctggctaatttttttattttcagtagagacggggtttcgccatcttggccaggctggtcttgaactcctgacctcgtgatccacctgcctcggcctcccaaagtgctgggattacaggcgtgagccacggctcctggccc

SEQ ID NO: 1716 - DNA, 2169 bp, Homo sapiens
ttccaagtccctgcaaagaagcaccactctagactggcaagggcctccacagtgtggaggtcccattttattatttttttttttcgagacactctgtcacccaggctggagtgcaatggtgcaatctcggctcactgcgacctctgcctcccaggttcaagcagttctcctgcctcagcctcctgagtagctggcattataggtgcccaccaccatgcctggctgatttttgtatttttagtagagacggggtttcgccatgttggtcaggctggtctcaaactcctgacctcaggtgattcgcctgcctcggcctttcaaagtgctgggattacagacatgagccactgtgcccggcccccattttattttagttttattttgagacagagtctcgctctgtcacctaggctggagtgcagtggcgcaatctcagctcactgcaagctctgcctcccgggctcaccccattctcctgcctcagcctcctgagtagctgggactacaggcgcccgccatcacgcctggctaattttttttttttttgtattttaagtagagacggggcttcacctgttagccaggatggtctcaatctcctgacctcgtgatctgcccgcctcggcctcccaaagtgctgggattacaggcgtgagccaccgcgcccagccccattttattttttactttaaatgcctgccaaggagcagcctcaagcccagagaagactgaggctacggggaacttcccttgctgcaggctgttgtaacactttaagggccccaggtctccactgccaagcaggacttggcacatgagcacccaccccacagcaccatcaggcagcacccatgggctccaccagcccagctctgtccctcccctaggtaaagatcacactgaagtcttcaagtccccagcaaccaagttgggggtggtttccttcctcttcaggcagccaggcccatggctggaaggccgggctggaggcccagggaatcggttactgatgtggccaccctattcccacatggggagcaccaggagccctggagccccttccacccaatcccatctcgcaggagagcagggtctgggctcctgcctcaccgctggttcagcagcaccctccccgccgggtcccaccttgccttttgaagaagagcccgcataatgagtggacggcagacagctatatttagtggtgcctcgacactcacgaaccgccagcgtggcgcctggatcttgcccagctgccagctccccccaccaggactgtggttcctcagtttctcctgccagccccggctcatctcagggcaaagctatagacatggtagatctcatcggggaggttctcctgcctctcctcggccaggaggctgaggcctgcactgcagatgatcctgcggaccacgtcaaggtcccggcacacgctgctgtccacgtcgtccagaatcacgccctcctgggccatgttgtctttgatgacgatgatgccgttggggcggaggctgcccttgcagcgccgctggaactcggccaggtgctgatcggtgaggtggcctggggagggcagaggcaaggttaccagggcaccatgcaagcggatgtcggcactggatgggatgtacttctcagccccgctgagcccctcatttgtgcccagcattttgtgtgcacacatggcctcattggctctcagtcccgagagatttactaaaccccaattcatagaataggaaactgtggctcagaggtcatctacctaaagacacattaagccagaatttgacttgatgggatggcttacaagtcctgcctgatacctacacaccatgatgccccacccctgccaggcttggatcggaggagtgaacctgggctaagagtttggcattgcaggagctcccagagagactgccttccctacactagaagtccccacaaaggcttctgagaccacaaaatacaaggccagacctagagtgtccacagcaggcctgtgctgcccgcctcaggaggtggccgactgctgctagcggcctgccgccacgtcagcagcccagggcacagcgctcgaggtgtgctgttaggctaagagggtgcagggctagacacgaagcttaaactattcatcttattaaaaataaaacccttataaaactc

SEQ ID NO: 1717 - DNA, 2283 bp, Homo sapiens
aaggtaaggtggccgtaagggcgcggtgggctccacgacggggtgatctctgggaccactggatgtgggtcccggcgcgaggcagcttccgggtcgcggccagctccggccgacctcccgcccggccctcaggctgctcccacagttcccggtccctagacaaccctggctctgcccgcccacttcgcgtgttcgattggcttgtccttcccctttctaagaccggagactaaggcctgttagacgtttctgtgtttctgcacctgagtttttttggtctaggctccgtctggtcaaatctcgctgattcccacagcctcttgtcctttgctccacctcattgcacccgtaatgttgtattgtcattgtctgtttactgtcccttttctctaaggcgtgtgagttcctcaaaggcaggcacagtgtcttattcgcctctgtatccttagctctctgcttggcatctagactctaggatgagcgttttgaattcacgacttggcggctgtccttgactgtgtctctttccttctaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtatcgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccag

SEQ ID NO: 1718 - DNA, 2250 bp, Homo sapiens
cattaacggcatcctcttcattcctctcaggtgaggcctccgccccactcgagtgtctcccggttgggggttttttgtgagtcggagtctcgccctgtcacccgggctggagtgcggcggcgccatcccggctcactgcagcctccgcctcccgggttcagcgattctcctgcctcagcctccccagtagctgggattacaggtgtccgccacctcgcccggctcatttttgtgtttgtagtagagatggggtttcaccacgttgaccaggctggtctcgaactcttaaccttgcggtccgcccgcctcggcctctcagagtgctgggattccaggcgtgagccatcgcgcccggcccgccccgcttatcttccccggcatcctcgcattccgcgagtgaagaccttggtgtttctgcttcacacaaagtatcttggcgttttcccaccagtccctaagaagcggcttcattccctccccacgcttcccatcctgcggcggggggggctgaggagcaggccccgggctccccggggtggccacaagcagtgtggcctcctgtggggagtggatttggtcagcaaggcgtggcagcagccccccaactccgctttcctccccctgcgctggagggaggccaccgagggcagcgaggggagccccgaggccgggtcaggtgcggggtccttaccttctccgtgttcagggaccttccgccttcaggagagaagcgcttgttcacacacattccccactgaatagagcgcagagcctgagcttatcccacaggaaagccgggaggcgggtggagcccccaggactcctctgagagccacctccatccccacccttatcctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccctccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtggccagctcccttcctggtctgagactagctctgggggtggcgggggcccccacacgctgctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcg

SEQ ID NO: 1719 - DNA, 2056 bp, Homo sapiens
acttccgccccctccgcctgccattggaactagctgagccgaactagttgcggccaccgagcagccggctctcggcacctcctcctccgcctccctgtctcctgttccattcgcctttcctcttctttcctggcccacgccgctccgaggcctcgcgaccgccgagcctgcagcctgccccgcggccaacatgagcttcttgtttggtagtcgctcttctaaaacttttaaaccaaagaagaacattccagagggttctcaccagtatgagctcttaaaacacgcagaagccacacttggcagtggcaaccttcggatggctgtcatgcttcctgaaggggaagatctcaatgaatgggttgcagttaacactgtggatttcttcaatcagatcaacatgctttatggaactatcacagacttctgtacagaagagagttgtccagtgatgtcagctggcccaaaatatgagtatcattgggcagatggaacgaacataaagaaacctattaagtgctctgcaccaaagtatattgattacttgatgacttgggttcaggaccagttggatgatgagacgttatttccatcaaaaattggtataattaatttttgtaagggggatccatcatgatttatcttttatatgtttatagaattttcctccctctttccactatatctagtcggagagttctttatggctgtgttgatatatgtatatgttacgcagttcccaagaagaggcacaaaagtttgttaacccagtggtaaaataagcaagtgatcctgtgtgaattgagcttttcccctttaacttagtgcttttaaatgcttaattagctgaaagtataggtttattagaaaataaatgatctccctctcttaaggtaattatttttgatgatattctagattaaagtatcactgagtttattttcagacaatgatagcattttttaacactttaaaaaaattatgatcatcattgagaataaacttacttccctgaagtaagggaaaggcttaagaagccctttcagtagaaagttctagatggagggttattcctattctaggaaccatggtaaattaccatacataacatatatttttaatcttatgcacttacaggtgttctatgtttttcataccaaatttatcatgaacattaaggtaaaccctctattttattttatttattttaatctaaatttttcattttttgggagacaagagtatctctgtattgcccaggctggagtgcagtggcgtgatcttggctcactgcagcctccacctcccgggttcaagtgattctcttgcctcagcatcctaagtaactgggactacagacgcgtgccaccacgcccagctaatttttttgcatttttagtagagacagggtttcaccatgttggccaggctggtctcgaactcctgacctcaagtgatctacccacctcggcctcccaaagtactgggaaccctctctataattttaaatgatgagatcagtatatctaggatagtaacaaaatctggcccaaaaaacagaatggatattgagtagattgctaataacatctgccacagttgtatctacttatttagggaagttcatatggcttctatccagtgttatttagtaatatatttgtgatcaaaagggagtttgaatttatgacccacaatatgaatcttacagattcagatattaagctatgtgagaagaaaacaagatttgaggggttgctgtatcatcggctgagtgactttgcttttttgtatttacttttaagggcagacttatcaagtagaaattgtttacgtttagatagtcatgtttttgccttctcaaacttctgacaactgattgtctcaaaaagctaagaatctgctcctgtaatgttagaactttttgacattttacgattttttttgaaaaaaaaatgtgacaacaatataaatagttgttgttatggagtactttaaacatatttattgaatgcattaaccacttggaacttttttaataaaagagcaatttttcaag

SEQ ID NO: 1720 - DNA, 2167 bp, Homo sapiens
acaggagaactcactggttgaggaatttgacatgagcccagttatctccccagtgagtagaaaaagccccttctatgtgaattaggtagaatgccaggtttggttcactttcagtgactttatggtattaatattttaatgagttcccagcattttgggggaagcagatctgctttcattctaggcctaaacttgtctgagagcaatttaaccctttgctctgtgccagtctcccttcccacccgatccctggttcccaagggaagctgcaccagaggtggttggtcacccagcagccgctcagagtgccagtgagtgtgcacatgcccctcggtgtctgacctttttctgtaaacaatgaggggtagaatttttgtgtatcttcacgtctgagcatggctcttcgaattcatacgtaaagaggcaggcacagataatgttaactggcttgtcgaaaagcccgcagagagccagccccagaaagcagtctcctgatttcctgtcctggtgcctgttaccctggcacaggcccgtggggcattggtgcccctcattttctctggctggtcttgaaggaattcttatctccagctcagtggttggggggcactaggggaggagaggccctctctttccttctctccacattctccctgccccgctagttgtgtctcctgtggaactgtctgctttccaatgtctttctgaggaaaagtgccatgtttggcagaggctcaggaaaaagcttcaaggggcagaaaagctctgtttgaatcgactcaccgggacaggcagctgaggaaggagcgccatggaagccacagatgggatgactctgctgaagcaggaatgcacccagccgggaggccgccagccctgccagccgtcagcacacaaaggcaccgctgtctgctggggaggtcgggagcaggccctgtgtgcctaaatgtgcctgtggaggcagcgtgggctctccaagatggggcgtgttctgtgtctgcacctgctggtctctctgtgctggctgagctgagcacctactgtgtgtgtgccgggcactctgcagagagtgtacagacagcaggctggggcctgcctggaggaggtgactgtttcgtgctcagagacaggcaaatcagcttcaaaatgagagccagagactagcacagaggaggggcgccccaccgagcctcgagagcttctggggtgggtacgggcctttgatagatgacacagcacttctatagggcaccaaaaaggggctgctgggcctgtctcagccttagacttgggaatagtgccacgtattgcctttgagcaagaggaagtgtgtcgtggaggagagactgtgggttttggactagacagagcaggaatctgcctctttcgcttcctaactgcaacctggctgccacagcctctgccaagctttgtctttggggcttgctgcagaaacctggcctacggaagatacgacaccactgggagggttgtgtaggtgccaggggaccatcgtggttctctagggcgctgtggaaattgggtcttgggctgagtggcatctggcagtcatgggtaacacttgcttttccagttaatgtggccatgtgattccaagtgtcatgttgctttgtggcaagattgttgtgtgacttgtttttttgtttttgtttttgtttttttaaaggaaactatttgtgggctataggaaactttctgatgcctccggattgtgttagtagtagccatcaggagggtctccaactaaaacacttgttcctgcttgctcctttcccctctcattgttcagcattcttgtcaagttgcccagcttggagttgtctgtcacgcacatgtgtcctgtggttatagctagaaggacaggagtctcctgctgatgcgtgatagcttaagcttggggagaaggtcttttccactgcctagctaagcagtctggggagagcatggggatcatttctatgtgtgtgggtaatctggtcagtaagattgagacttagttaagattccccttggaaattccttaatgtttattagcttctaactagtgttgtaagtccgatgccagaatttggagatttgagttcttcttttcatggcttttattcactgtgactaataagcttcctaataaatccttgccagactt

SEQ ID NO: 1721 - DNA, 2350 bp, Homo sapiens
tgaaaacagtagtgccttgatgatatgatcagtcagtgatcccatgccacattggtcatgggagaaaaaaatcaaatttgtaattaattgcaggggtgggatcatctctcccagctagtggccggttacaaatttgtgggcagatgttttaattgctgttgttaaaatgacacccctactctctgcatgccctctttgccattccgtaatttagagggaaataaagatgggcaaagaaataccaggatagtgctggtaatggaggaaaagggaggtcatagtttcaacaaaaaacagtctacagaggcaggatagcatgatggagcagagtgtccagagtctggttcaaatcctgaattgctttataaactcagagacctttccttttccttttccttttccttttctctttccttttccctttcccttctctttttcttttcattttccttactgggtctggctctgttgcccaggctggagggcagtggtgtgaacaaggctcactgcagtctcgacctcctgggctcaagcagtcctcccacctcagcctcccaagtagcttggactgcaggagcataccaccacgcgtgactaacttttgtattttgtgtagagatgaggtttttgtcatgttgtccagactgttcttgaacttctgagctcaagtgatctgcatgcctcagcttcccaaagtgctgagattacaggtgtgaggcactgcatccggcctccagagctgttttctaaaggttacaagtcttctaggcgtttgagctgaaaacatttggatagctggggtttaaatgttgccctaagctgctttgaatcataaagaagaatgagcagaacactgttctgagtaatgcaggtctctttatttgataattaaataacttggtttattatttttaggtttttttttttaattaacctctcaagcttttatttaaatgccatgacccaggatggattttagattttgttgaaagcagccacatccatggactgcacatagtcttcaaaagcagtgatctgcttctccagcttatctgttccaactttatcatcttcaacttcacaacgtatttgaagtttcttaattctgtatcccacttgaactagtttagatgagccccagactaagccatctgcttgaatgcctctgatgcactcctctaattttgccatatctgtctcatcatcccaaggtttcacatctataagatggaagacttggcaacgagtgcaggttttttggctttcttcgattcatattgtggaaggtgttcttcccttagcctcttcgtttcttcacttttctcctcccatcagctccaaagagatcaatgtcatcatcatctttactatctttagctcctcttcctatagtgtcttccatatccacaggaccatacttgaccaaagccttcctcactcctggaaggctggccttttctttttcgtaagacttgatgtgattataccaacgaagggcataacacaagtcagcaggcggtgggccagatgctgcttcaaatactgccacatctgcttgtgatggcacatacccctcgatgtagctcttgtccgccaggtaattgttgagcacctggaggccggcagggcttttcaggtctctgaaatccatggcatcagctgtacctgagagctgaggagcagcagaaagagctcaagttgtgggcaccctgtgctgaaagaggaaaaaaatattcttaggtttttaagagttcttcagaaatctttactttaggggccgggtgcagtggctcacgcctgtggtcccagcactttgggaggccgaggcaggtggatcgtttggggttgggagttcgagaccagcctggccaacatggtgaaaccccgtctctactgaaagtgcaacaattagctgggtgtggtggtgcatgcatgtggtcccggccactcgggaggctgaggcaggacaatcgcttgaacctgggagacgaaggttgcagtgagccgggatcatgccactgcactccagcctgggcagtagagcgagactcagtcttaaaaaaaaaaaaggccgggcgcggtggctcacgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctc

SEQ ID NO: 1722 - DNA, 1623 bp, Homo sapiens
atcttcttcctgcccgctattttggttccatctcttctgcatatttatgcttgcctgttacattccctggcctctgagtgtcctttggcagtttccaaagcacttgggcaagaaggagcttgggcagcttcacaacagatggggacgcgcaggggaggggccgcggccggaccggcagagtttcaagggctggcgcgccggcggactttccacactgtctttcgggactggggttaggagacagcccttggccaccactgtgtccttactttgtcgctttacttggggctggacctcccctttccagctctggcgtgtgaccccgcaacgagcgtggtgtcgagaccaccaccagctggggcggtgggagcgaaggtgccccaggctcggggaaggtggaaaccttttccccgctccccaagtgattgttgcgcgctccggtgaggggacagtggtacctcgacttcccgtgtgccagcttcgggactcagctgtgcttttgtgtctctttgattagcaaaagcaaaacgaattcctccccgaacactaagcttcctggaaacttccctagacctaaacttgagaaccgcatataaatgggccttgagggttctgtcgtcagtagcgggttacgtgattgcaaacgagcaagtttaaaacggagtgggctttgggctgcagagccgcctggcattctgacagctgagcaggaggcagaggtgagagtccaagatggactaaaaatgtcccagcagctgggagcccaacctcggcccaacctcgttgaaaggaggaacattcggtgcagccgtcggaaccttattatttatgaaaggggacagctcacaggattacatttttctaagccaatcctgtgaccatcctccatgaaattctctattttggttgcatgtggtcaaaactgagcctcactgaaacaattgaaaacaaatactcccgacaaatcttaagaatcgttttgaaaatcaaaaggtggggaaaatgttgtggcttctgagctttcttcagcccatattctattattctctgatgttttatggtgtaaaatcatacccattccattatgtattgattgtcaagaaggaagtaggcttttattgctatttttatgtcagtttccatttactgtctcaccacatttattgggttattgcctttgcctttgactcaacaggagctggaagggtaggaatcccaaattctgttgcctaaggcagccagttgtcagaatggactttcctcattttctattatgaggcctgaagaaagacattcagttccaaaggctgtgcctatccttttaaatagaagagagaggacccggcacggtggctcacgcctgtaatcccagcactttgggaggccgaagggggcgaatcacgaggtcaggagttccagaccagcctggccaacatagtgaaaccccgtgtctactaaagatacaaatattagccgggcgtaatggcgggcgcctgtattcccagctactcgggaggctgaggcaggagaatggcttgaatccgggaggcggaggttgcagtgaaccgaaccgagatcgcgtcgctggactccagcccgggcgacagagtgagactccgtccc

SEQ ID NO: 1723 - DNA, 2859 bp, Homo sapiens
gttcgcgcctggggctgtggtcttcccgcgcctgaggcggcggcggcaggagctgaggggagttgtagggaactgaggggagctgctgtgtcccccgcctcctcctccccatttccgcgctcccgggaccatgtccgcgctggcgggtgaagatgtctggaggtgtccaggctgtggggaccacattgctccaagccagatatggtacaggactgtcaacgaaacctggcacggctcttgcttccggcgcagtaacagtatctccaagtcccctggccccagctccccaaaggagcccctgctgttcagccgtgacatcagccgctcagaatcccttcgtcgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctgctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggagggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaacat

SEQ ID NO: 1724 - DNA, 2424 bp, Homo sapiens
tctttattgataagaaatgccacggtcagaggtcgggtgcccggctagtggcagggctgtaactatgggaggctgagttctgagcagctggccagctgtgcaagcagccacaggagggggcgggaggagggtgacaggacggactctgtgtccccggggaccaacgacctcctttgccccagcactgccaaggagatgagctcctggatcgcgcgcatcaacttggctgcggccacgcactccgcgccgcccttccccgccgctgtgggctcccagcgcagattcgtgcggcccatcctgcccgtgggccccgcccagagctccctggtacggcctccgggaaggggtggggtccggcggaactgggaatgtgcacctggagccccaggactaactcggggaggctggaggcgggctgcgcacttggcctgggaaccgaggcggccaggggggcggcgcgcccgggcccggaaagcggcggaggggacgcccgggacagcgcccctcaccgcccgctgctcgcaggaggagcagcatcgatcccacgagaactgcctggacgctgccgcggacgacctgctggatctacagaggaacctgccggggcggcggggccgtggccgcgagctggaggagcaccgcctgcggaaggagtacctggagtacgaggaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccgaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtgagggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttggggctctgcctgtaggaaggaggctgggccggagggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaac

SEQ ID NO: 1725 - DNA, 2095 bp, Homo sapiens
aaaataaataaaacatacaaacaactaattaattggacagagagctcacttgtcctctgccctaaactctccctgcttccctgagtcctgtgggcacttaatgggtggaacagaatcaacaggtgcttgggtgaagggggtggaggtgagagaagggcctgggctgcctggtgactgtattactggttccagtgtggctcagtcacatatgccctgggaggtgataattttgagtattccctcaggacatgaatagtattcctctaaaacggaggcttcatttcatgtctgttaactgggaatacagccacaactatgtcctcggggcaaggaccactggtaaaaccaccatacttctggggtgagcacagggcaaataatgtacagacatcatttcctttgactaatctttgaaatcttggctcctgaaagtagtgaaagttctttgtctaagccgagatttttaatttaggacccagatggagtagaaggtaagcctccaaaaggtctgctttcctcagtgttttagtgtcccagattcctggcaggcagcagtctcattagaaaagcagattgccttctgactcacccactcagtgcgatgcgagacagccccacagccctcacagcagcccatattcctgctggacagggcagagcgtgcaccatccattttatagctgcagtggctacagacgcctggcccaggccatggaaaaccttgagaggagatagtctgttacggacaggagctttgtcctggaatttcctggcctttgtctgtctgggataacttcatgtactgagacgcctgttttttagagtcttcttccttctgggggaagagtgctactgcctgtcctccacagagcacttttgcttctaccaaagccatcttctccctgctgcctgcccgtgatcacccatggttcggaggtgaggggagcactgtgggcaggtgtgtgtacctggcttgcagtatactcctgaaagttgcctgtcacaaaggaaaagccataaccattggacatcaaagctgtgtcttccagcccggcccattcactctggtcctaacctttgtctgtctctcatattgcagcagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaagaattttgttgcaagccagttgtcaaacacagccattataattatgtaaatttgcaaattatgttaaaaacaaggacaataaatattcaaaatgcatccctaattact

SEQ ID NO: 1726 - DNA, 2633 bp, Homo sapiens
attacatgagggacaatgactattcccagcttgatgctttggaaagtgcgtttggatttttccattttagacaaatgtcagctttcccccgaagtggcctccatcgtgcttgtttgttccaaatcatttttcaatgctgtgatttcccttctctttgctttaaacactcagtcacgtggcttgtctccaccgtgtggaggtgccgggtgcctggttgggtctctctgcatttctggcaggaagaaggcatttgtgaatactgtcagtacttgtgacaggttggtcacattggaacctttgcccctgttgtttaaaaccgaagaagactgtgactgtggaggtgccccgtgtgctcagcgctcaaatgggaaatggagaagattcccggaacgtgtttggcagtcacttctgagttttccattgagacccgaacatgaagaaaatcttctggctcctgccagttggccaacctctgtctgccttccccagctcacagggctgcacactgcattggggctgtcctccgctgctggaaaatcacgccggtgctcttcacaaacactgaacactggccctctgcttgatccatggaaccaagatgacaggatctcctgcctgttcttgataacagctgtagttttatttcagattttcatttaaacaaatagtttaaggcctcagctgggaaagaggattgaagtatccccaatggacaaagcctctggcacgccagaaagacatgtgactaagcctgagtgactttccttccttcccctcccaggttgctgggagaaataactatgggtttttgacaactctttcccaaaatgaatagtggaaggctgggaaacactgaattatgaaataaagcaaggcagttcattttgtcatccttggcacctgaatcctaaactacggtaatgagatcagccccttaacggagtactccagggtaccttgctcttaggcaatttgtttttctgtgtgtgctcttcaacagactctgcaggaagtggctgacttgatgcaaatgacttttttgttttgttttgtttgagacagagtctcactcttgcccaggctgtagtgctgtggcacgatctcagctcactgcaatcttcacctcctaggctcaagagattctcctgcctcagcctcctgtaatcccgggattacaggtgtgtgccaccacacctggctagtttttgtattttcagtagagacggggtttcaccatgttggccaggctggtcttggacttctgacctgaagtgatccacctgcttccgcctcccaaagtgctgggatgacaggcgtgagccaccgcgcccagcctgattttggagggttatagttgggaaactatttagtgcgcagatattgtctctgtggtaaacgaggaaactgacaggattccaaaagcctgctgtttgaaggggctcattcagttccaaaaagagatgggagaggcaggaaacgtgaacatatgtgctgcctgccctccattggtttgtttaataacaaattcaccctgtctgggcttgtgacccccctctcatgtttggaagcgctactgcggggttgtagagacaaatgagtcattttctgagctctaatcctgaccccagaggggcatgtggccacttctccctgacttttcccgggggtgacttgcttccgacacctgccgccttactgtttttcctcctcaagcaagcttgttgcaggcacttcttccttacttggtgctgaacttagccacaaggagctgtcatcacgagtgtgggagagggaggagaggggatcacaggggtttcagagggctcactttgagacttgctgatactgacaacagagttgacctggcccaggattcttctaatgctgcgtgtgactgtgtgtctgtgccatagtttttcagtgtgtattcatgcatgatgtatgtgtgtggggtgttgggggtggggggagggcaagagcgttattttctgggtcagaataaccttttaaaatggtaagttttccgctaggagaggaaacccattttgctcatctgtctagatgtttttcttcccctgggccatggagggctttgtttcacaagcttttctcctgtttcgtcgttcaggtggcagagatcgttgctccgccctgtgacacacagcccaccctccatgtcccacgttgggatggattacagaggatgtgccctcctagtggcccccgccagccaccagagtgaagttgatgcttgggtgctattgtgtcggaaattggtgggttcttggtctcactgccttcaagaatgaagccacggaccctcgcggtgagtgttacagttcttaaagatggtgtgtctggagtttgttccttctgatgttcggacgtgttcagagtttcttctttctggtgggttcgtggcctcgctggcttccggactgaagctgcagactttcgcggcaaatggttatagctcttaaggctgcgctcttggagttgttcattcctcccggtgggttcgtggtctggctggcctcagaagtgaagctgcagatcttcgtgttgggtgttacagctcataaaggcagtacagacccaaaaagcgagcagcagcgagatttattacaaagagc

SEQ ID NO: 1727 - DNA, 2258 bp, Homo sapiens
gtgcagagtgtgccacgtcccacccacaaatggggcttgtggggtccttgggtggcaggggttgagcatgggaaagtgagcttcaggccagagaagccacaaaagggccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcggtcatctcaaccccagcagaagcagttacatgcattctgggctgttcttcctacctggtggcttttgtcatctgacctctgcctgccccgagtcttcactcctggccttcacctgtccccttaaatgtgaccacagcagccacctgtggcttctctcccacagaagacagagccagttgtgtcacctgcttccctggggcagggtttcaaggtctcacatcccacatgtggcccacttggctctcctggagcatcctgacctggtggggtaaccatggccctggccaccccacccacagggcccagtgacattgctgcactcacaccccttcgactcaccaagagagcagggaaggagccggattccacagggacccgggagatcggctccagccttggcctcaggttcacagcaggaaaatgggccagtgtgttagagccatgttctcaaagtgtggtccctggaccagcagagcagcatccatgtcacctaggagcttgtggcaagtgggagttctagggcccgccccaggcccgtggagccagaagctctgggggcaggccagcaagctatatggacaggcctctggatgactgtgatgcctgcgcaccttgagaaccatcggcctggatagcatctgaacactgatggctcctggtgcgtctagagaagacacaggccatgtctgggacgcgggggagatggactagcacgctcccccagccacagggcagcatgatgcccagttccctcagaaggatgtccttcatcttttccttgccgtgtgtgttcaaccccaccctctcagcagcccgggaagggcaggacactgcacacacaagagggccgttcccagtcccattccagattcatctgtcaccagacccacgggaggaggcagactggttccaggaggatgacagcccttgttctgacacctgtgtctgataccagggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcaccctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcggccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctggtgtcgccggtggctcattttctggcaaatggaggcacgaacgcaggggccaaatagcaataaatgggttttgttttt

SEQ ID NO: 1728 - DNA, 2079 bp, Homo sapiens
ctccgggcccctgctgggcgggaaggcggcgccccggccgaggtggcggcggctcctcaggacggaagctcctgttttcttgtcagccgccagctgagggccattcgcagcttctccaggccacctgcattccttgtctcagagcctccctcctgcatcctccaagccagcagttgtgggatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggtgcggccggtggagacgctccgtgcctgcgaggagtatctgcggcagcatgacaagctggcacacccataccgagcagcggtcctgagggccatgaagagggtcctgagcagtcgcgccagtgagctggacaaggacacagccagcaccatcatcctcctggcctccagcgagatgaccaagacgaaggacctggtctgggactggcagcaggcggcgagtggcgtcctggtggccgtgggaagacagttcatcagcaaggtgatggaggagctgctgcgcaggctgcaccctgggaccctgccacactgcgccgtgctgcacaccctcgccagcctctcggtggccaacgcgttcggcgtagtccccttcctgccatccgtcctgagctccctgctgcccgtgctgggcgtggccaagcaggacacggtgcgcgtggccttctgctccgctctgcagcgcttcagcgagggtgccctggagtacctagccaacctggaccgagccccagaccccacggtcaggaaggacgcctttgccaccgacatcttcagcgcctacgatgttctcttccatcagtggctgcagagtcgagaagccaagctccgtcttgccgtggtggaggctctggggcctatgagccatctgctgcccagtgagaggctggaagagcagctgcccaagctcctccctgggattctcgccctctacaagaagcacgcagagaccttctacttgtccaagagcctgggccagatcctcgaggcagctgtgagtgtgggcagccgcacactggagacccagctggatgccctcttggctgcactgcactcccaggtaggaggcgggcgtcagggggcgggtccaggttctgcacacccttccgtgggaagttgctggacaaggggtgcagaaagcaagttggggtggatggctcagccacgtggggctgaggactgggcattccctgaaggtcactcgggtgacttcttagcgatgtggcgatgctcttgccctgcccagtagtggcacatgcaggtgacatagcagcccccaggatggaggtggcaggagtgggtgcccaggcccagtgcaggcccagtacaggtggtcccagagaaaggtcagcgcagctgaagtgccagctgggggagactgccctgagtttctggggactgagctcagaggagcagaggagaggccctgggctgcaggatgggggtcttgaaggccctgctggagaggaagtgatgtggggaggaggctgagcagctggggcagctgggacccctccccaggtcgggtgaatgaggctgagaacgactgagggatgcaggtgccgggtcacccgtgaccttggcactgggggtcatctgtccatgggactttctggatgagagaggagaggggcagggagctagagagggtggtgtggtgaagtctgcaaggaaactttctgaaaagaagtgtggaggtgggtttactgcttggctctgcccctcacctggcccactccagctgggccccactctccaccgcctggatggtcctggctgcatcccagaaacaaaggggaagaggggacggcagccacagagctagtaaacataatgtaagtgctgtgaacagttacatggtaacaaactgttaaaactgtatgaaatggttaggttcctagaaagattaaaatgtcaacattggtacgaaaagcaacagagtgagactctgtctc

SEQ ID NO: 1729 - DNA, 2178 bp, Homo sapiens
acacacacagccttctctcttttctcactctccttcacccttattctgcactcccagggtcccaatgcggcaagtgtccccctaaggatacctccctgacacctttggacagtgcccagaggaaagtcagcctatggcttgggctgaacctgcagaacacaggtggcagaggacaagcccaggaggatcagcatcaaggtgaggctgagcacaggtcttggagtcagactggcctggctttgcatctaggccttccccttcttagctgggaaatcagttgacgtcaagtcacctataaaatgggcatcattgtctccacctatgctgaggattcagtgagatagtgcagcaaagcgctttgcccatagggagtgcccccaccagggagctgctagcactgatgtatggggagcaccagtgggaaaaggggaaagttcaagggtgagctgaaaagagactgcgatgaggggaggagagcaaaggctatggccacagccagaggccagcttagccctatcctggacgctcttaggcagcccctttggctggatcttcaaggcctggtcaggacgcaagcccaccctgccaacccctatggagaagagtacagctccttcctcaggcagctgcagaagtgcagagggtcagagatcaccaggcacaacccccttacgggcaccacggtgaggaaactgggacttggggaagaggaattgacttgcccaaggtcacgcagagtggagcctggtctctcctaagccctaagtcagatggtgggggtaggagcaaatgtaaggggtcgaaccttgctttcagatcccagctctgccacttcgtagctgaacagcctgggattcactgtcttgcctctctgagcctacacctcctcacctgacctgccttgtagagttgtgtgttaaaatgtttattttctttcatgcctcacaagaggaaatctggaaaatgtagacaaattgaaagaaaaggaggaccgggcgtggtggctcacgcttgtaatcccagcactttgggaggccaaggcgggtggatcacctgaggtcaggagttcgaagctagtctggccaacatggtgaaaccccatctctactaaaaatacaaaaagtaatcccagctacttgggaggctgagacaggagaatcatttgaacctgggaggtggagtttgcagtgagcagagatggcgctattgcaagccagcctgggcagagcttcctgcaggcgtgaaagagaatgatgccatgcgcctggccagaggaggcatgcgataaaggggcattccctgagccttcctcagaggacttggaaagagctctggacagggagccaggagatctgggttgtggccttcattctgccattgaacttggttgccatccttggacagtgcctgaggtccctttaaacagaagctccacaacaaatcctgctcaccctgcactttgcagcccggccacaaagcaagcggccacacccagggttgggtttggagctgttccaggtcacgcccttgtaaaatgagtaagcagagggcaggcctgcccacggggctgggccccgggcatctggggattgacaggagcgggagctctgggcctggcagggctttagggtggtctgctgcaaggagactcccctgcttcttcacttgtgacccaggcaagtgacttcctttctttgctcagtttccttatctgcaaggtgcctcattctggacatcctgaccaagataatgaacgtgaagagtgccaagcagtgtctggcacacgagaggcactcagtaaaagagagaccttcttgctaagatcactgagcccttctgggagggaggtacagacagatgtacttgggctcctctgggagggttcaaagcagtgtaaaaccacagctgttactgaaacttccagtctgaaagcagctggccagaggagagtgggcctgccgcaaagctcccttccctggggggagctcagctcctaagttaggcagtattaaaaaaagtcaaggctacatagagaagagcctgctgcctgaccaggtgcattagagtagctagctcatgcctgtaatcccagcactttgggaggctgaggcaagaggattgcttgagcccaggagtttgagaccagcctggggaacatagggagacccctgtctctac

SEQ ID NO: 1730 - DNA, 1995 bp, Homo sapiens
atgtgaagaatgtggcaaagcctttaaccagttctcaaaccttactaaacataagataattcatactggagagaaaccctacaaatgtgatgaatgtggcaaagcctttaaccagtcctcaacccttactaaacataaaagaattcatacgggagaaaaaccctacaaatgtgaagaatgtggcaaagcttttaaacagtcctcaacccttactgaacataagataattcatactggagagaaaccctacaaatgtgaaaaatgtggcaaggcctttagctggtcctcagcttttactaaacataagggaaatcatatggaagataaaccctacaaatgtgaagaatgtggcaaagcctttagtgtattctcaacccttactaaacataaaataattcatactagagaaaaaccctacaaatgtgaagaatgtggcaaagcctttaaccagtcctcaatttttactaaacataagataattcacactgaagggaaatcctacaaatgtgaaaaatgtggcaatgcttttaaccagtcctcaaaccttactgcacgtaagataatttatactggagagaaaccctacaaatatgaagaatgtgacaaagcctttaacaagttctcaacccttattacacatcagataatttatactggagagaaaccctgcaaacatgaatgtggcagagcctttaacaaatcctcaaattatactaaagagaaactacaaacctgaaagatgtgacaatgattttcactacacctcaaacttttctaaacataaaccatattggtgccctagaaatgtgaggaatatgacaaggactttaaatggttgtcacgcttgattgtaggtaagataatttatattggagaaaaatcctccaagtatgaagaatgtggcaaacttttaaccaatcctcacaccttattgcacaggaaagcatttatacttgagaaaaattgtataaagaatatggaaaagccatttatatctgctcacatgtaaaaacatcagttcatacttaataaaatgcaattaccgtcaaatctttcagaaaatataagcctttaatacgaggaagagtattcttaagatgaacattacaaatagaaagagggttgtagtacctttagttttatgatagatcttattgtacacattttgtaccagaggaaaaccctaaagcattagttgctcaaactttgttcgacatcagggaatttgtattggagaaaaaccctgcaaatgtaataaatatggaaaaacattttttcaaaaactacagcttggaaaacatcagagagttcatactaaaatatatttttgcagatgcagtaaatatgaaaaatatttaatcccaaattaagtctatgtaaatatcagaattcacagtagaaatcataaggcataaggcactgatacttcagacattacactaaattagagtgttgagtataggagatccaaaactaaaattgttaggtaagttatttatatataactttaaaagaagtagaagattttttggagatttataattacattcaaagtatacttttttcttgaaaaaaattacagattttttgaaaagcaattgatgtaatttaactctcaaattcatgtttttcttcattcctattatattcacatgtgaaagcaagtgatctgttgttgctgaatcagagatatgagagattcttttttataggtgggcattatttatgcccctttctgtggaagagtaagaaaattaaaatacaagatgcatgaggaaaatgtagagatgctctttgtgattaacttagaatattaagtgctacttgacgtacatgttcagactaacattcttttgcagtatagtgagaaaaaaacattttaaaattaattatcattttgttgattgtgcttttatgtaataaaatgcagtactttaaaacatttagattgtgtgtgaacttaattttgtaattaaacattttttttagcatgct

SEQ ID NO: 1731 - DNA, 2626 bp, Homo sapiens
tagtcagattattgtacttccttcatactcttcccttttgagtgttgtttctttaaagttctaagccaagattaaaagcccgggctctggggcttaggtgtctcggacttggttatgggcgtcaccaggcttctgcagaagtaggagcctcgctggtcttcagtctgggtagacgtggtttgagaattccagtgaagctgctgtttcagaaagagatgagactgagcgttgaacactgtttttcctgctaatggaaacagttattgtaaaagatgaatgtagcagctgagaaaaaaatatcccccacctcttcctcagattgctttgggaattcactgtccatgggtttcatgctgcctccctccttgggagggaggtgattttcatgtgcgtttggtatcgaaagtctttatcaaagggctgttacctgccatgcacaccgggtggaggggccaccttgggactcaccccagggagctgtgctcctcgctgtgagggggcagctggtggcatttgccatgtgacccaccagatccccttgtctggggtcacctccagcagcctgtgagggaggagcacccaccctcagatttgcctcccagcatgggcagctcagccaaggcagggcggccctgcacgtgctgaggacaggggcgtttctaagagggaggaggctaggaagggggtggcgtgggcctgggcagtcctgacatgacatgtctgacgtgtgatgtgtgacatgttacaggcatctggagcaggggtaccgggaaaggctgagcctcctgcggtctgaggtggaggcggagcgagagctgttctgggagcaggcccacaggcagagggccgcgctggagtgggacgtggggcgcctgcaggctgaggaggctggcctccgcgagaagctgaccctggccctgaaggagcctgatgagccactggcctgtgtctcctaggaaaacagtcgcctacagaaggagattgtggaagtggtggaaaagctttcggattcggagaggctggccctgaagctgcagaaggacctggagtttgtgctgaaggacaagctggagccacagagtgcagagctcctggcccaggaggagcggttcgcagcagtcctgaaggaatacgagctcaagtgccgggacctgcaggaccgcaacgatgagctgcaagctgagctggaaggcctgtgggcgcggctgcccaagaaccggcacagcccctcatggagcccggatgggcgcagacggcagctccctggactcggcccagcaggcatttcattcctgggtaattctgctccagtgagtatagaaacggagctgatgatggagcaggtaaaggagcattaccaagacctcaggacccagctggagaccaaggtaaattactacgaaagggaaattgcggcactgaaaaggaactttgagaaggagaggaaggacatggagcaggctcgccggcgcgaggtcagcgtgctggagggtcagaaggccgacctggaggagctccacgagaagtctcaggaggtcatctggggcctgcaggagcagctgcaggacacagcccgcggccccgagcctgagcagatgggcctggcaccctgctgcacccaggcactgtgtggcctggccctgcggcatcacagccacctgcagcagatcaggtccagccagcttcttttgagatttcaagtctggggtttcttgccaagaaccaaaatttgaaattagacttaggaaacaactcagaattgctgtgcctcccgactgggtggttttcctctgggcagatgggtgagtgccaaaagaacaggtcctggcatgaggattctggctctgaatttaaaatatacattggatcatgggccatgaagctgttcactgtgtagaaacagcccagtgttctgtaccctctgcctcagccgtgcccggcagcaacattgcctccatcgctcagagacacccgcttctccagggccaggcagggtagcatgtggggagatggagaaaggcctgaagccctgaacaatgggaaagatggccagctggggttagcgaggttcccaaaaaggctcaagtgtgcaagcgagagagaaggcttacagaaagcctgtgctggtgttttatgtgttctggtgtgaggtacatgtgaagtgaccacgtctgttcttgttgggggcatctgaggtaggagaggaagtgcctggtcatcgcagacaggctgctgctcagctggcacccactgtcctgtggagagcattggccccggcttagaagaggacgggccctcccaccacactggccaggccacccccagcctgacagaaagtcatctttccggccggatgcggtggctcacacctgtaatcagcactttgggaggccaaggcgggtaaatcacttgagctcaggagttcgagaccagcctggccaacatggtgaaaccctgtctctactaaaaacacaaaaaattagctgagcatggtagcaggcgcctgtaatcccagctactcgggaagctgaggcaggagaatcacttgaattcaggaggcggaggttgcagtgagccgagatctcgccattgcactccagcctgagccacaaagtgagactcgtct

SEQ ID NO: 1732 - DNA, 2083 bp, Homo sapiens
aataaagaggctatttgcagaggtttagttaacggaagtttgaggctctagtgacagtaggaagtcattaccacccttaggcctgtagggacaaagggaggaaatggtttctagaacccactaatagctgaagccagggatgtgaagctgcccagagaggagctgttgtcttagtgtcataatcactgccaaaaccatggtggcagacgtgggaggactcacaggaaacataccctcaccttttttctaccttccattctcctgttggatgcgaaaccagagggcaaagagcttgtgggatgcagacctcggaggtcagcctcccagagcacacaatgacaaggaataggtctggggaaaggagatgcaaatgaagaacacctggtatgtggggtgaccttagactggggagtgggaagacagagcaacttagcagaataagaggaaaaccctctctcttacctcctgaatccaaacctttctggttcctgcaggctgcctgccatctccaatgttcccacactgccctgatgttaaccttcttcactggttgcctcctcccgtagggtgtcctgggccgggtctatgagacagtggtgatgttgatgctcctcactctgctggtgctaggtatggtgtgggtggcatcagccattgtggacaagaacaaggccaacagagagtcactctatgacttttgggagtactatctcccctacctctactcatgcatctccttccttggggttctgctgctcctggtgtgtactccactgggtctcgcccgcatgttctccgtcactgggaagctgctagtcaagccccggctgctggaagacctggaggagcagctgtactgctcagcctttgaggaggcagccctgacccgcaggatctgtaatcctacttcctgctggctgcctttagacatggagctgctacacagacaggtcctggctctgcagacacagagggtcctgctggagaagaggcggaaggcttcagcctggcaacggaacctgggctaccccctggctatgctgtgcttgctggtgctgacgggcctgtctgtgctcattgtggccatccacatcctggagctgctcatcgatgaggctgccatgccccgaggcatgcaggtaccaggctgccctcccaccttacctaatggtgtcctcagttgtgggcttctatagctctccactcttccggagcctgcggcccagatggcacgacactgccatgacgcagataattgggaactgtgtctgtctcctggtcctaagctcagcacttcctgtcttctctcgaaccctggggctcactcgctttgacctgctgggtgactttggacgcttcaactggctgggcaatttctacattgtgttcctctacaactcagcctttgcaggcctcaccacactctgtctggtgaagaccttcactgcagctgtgcgggcagagctgatccgggcctttgggctggacagactgccgctgcccgtctccggtttcccccaggcatctaggaagacccagcaccagtgacctccagctgggggtgggaaggaaaaaactggacactgccatctgctgcctaggcctggagggaagcccaaggctacttggacctcaggacctggaatctgagagggtgggtggcagaggggagcagagccatctgcactattgcataatctgagccagagtttgggaccaggacctcctgcttttccatacttaactgtggcctcagcatggggtagggctgggtgactgggtctagcccctgatcccaaatctgtttacacatcaatctgcctcactgctgttctgggccatccccatagccatgtttacatgatttgatgtgcaatagggtggggtaggggcagggaaaggactgggccagggcaggctcgggagatagattgtctcccttgcctctggcccagcagagcctaagcactgtgctatcctggaggggctttggaccacctgaaagaccaaggggatagggaggaggaggcttcagccatcagcaataaagttgatcccagggtttgctttgtttttttaaagc

SEQ ID NO: 1733 - DNA, 2277 bp, Homo sapiens
gaatgcattagtctaatgagatgtttgcagctggagcgcagggctgctggagactaactgtgagctactaacacgggtggaagatagcttttgcaatactcggtttgcatgtgctgaaagtcatctgtcttctgagtcaacactcccgacctggtaaacaacctgctcagggctctggtgaacaagctgtagatcaagtctcgggttctcatgactcccttagccctctcacctccgcggagtaccccagagcccgacctcagctccatccctcaggacgcagccacggtccccagcttggcggccccacaggctctcacagtctgcctctacatcaacaagcaggccaatgcggggccctatctggagaggaagaaggtgcagcagctcccggagcattttgggcccgagcagccatcggcggtgctgcagcaggccgtccaagcctgcatcgactgcgcccaccagcagaagctggtcttctccctggtcaagcagggctatggtggtgagatggtgtcagtctcggcttcctttgatggcaaacagcacctgcggagcctgcctgtggtgaacagcatcggctatgtcctccgcttcctcgccaagctgtgccgaagcctcctgtgcgatgacctcttcagccaccagcccttccccaggggctgcagtgcctctgagaaagtccaggagaaagaggaagggaggatggaatcagtcaagacagtcaccaccgaagagtacctggtgaaccctgtgggcatgaaccgctacagcgtggacacctccgcctccacctttaaccacaggggctccttgcacccctcctcctcgctgtactgcaagaggcagaactctggagacagccaccttgggggtggtcctgctgccaccgctggtggtccccgcactagccccatgtcttctggtggcccctcggcacctgggctgaggcctccagcctccagccccaagagaaacacgacctctcttgaaggaaacagatgtgcctcaagcccttctcaggatgcgcaggatgccaggcggccacggagcaggaacccctccgcctggactgtggaggacgtggtgtggtttgtgaaggacgccgacccgcaggctctggggcctcacgtggagctcttcagaaagcacgagattgatggcaacgctctgctgttgctgaagagtgacatggtcatgaagtacctgggcctgaagctgggacccgcactgaaactctgctaccacattgacaaactgaagcaagccaagttctgacgtttttaaaaagacagaagcgaaacccaaaacaacagatcccaagattatcttctgccttaccaatatcccgccaacatcacaaaatagactctcctcttaaaattaacagccacagagacgtggtctttttataaaacttgtgaatctttgccttttgaagaatttaacatggaccttttcgagaggctcctctgtgttcataatttgccaaaaaattacaaaagcctgtaatttttaacatccctgttatgctgatttctctttaagtgggtcctatttgcataacgagagagtggggaactgaatgcttatgcccaaggagagttctggagggttcaaaggatgaaagaaggacctttgtccctgcggtctctgcagggacaaccccctcagcaccatctgcctctaactctgacctggggacctatccatgtgagccttgtttgcctcagctctggaagctgacttctgaagatgactgcctcaccttgcactgtctggaaaacttgaattattttacgccgtgaaagaaaaaggaaaaaaaaaaaaatcttttctgttcctagaaaatctgaagtactgtgtttctccgctagagggcagactgctaatgaaatttcaggaccctcactgactgcagtagcaggattgttcagtactgagtggatgggttagggtgtctgtgaacaagatctagcccacacagaaacaggggatttattccacagttagcaccacagattgcgacttgggaagaaaccatcagctagaggggtctagttcgtatccaatcattattgactgactgactgatactcaactagcaaaggcaagaatttggaagcacgctctacccagatgggactttggagttccttcccttccagagtccttattgaggtgttgaagtgttggcatgccgaagaatcttagtgacatttagccatgggtgtttctttaaaaaaggaaaagaaaatgtctcaatgaaaaaat

SEQ ID NO: 1734 - DNA, 1873 bp, Homo sapiens
ttttgtctcctgtaacaatttacgcgccgtgtaactgtgaatctttcaaagcctcagttttatgaccctgtggagccagtgaactttgaagaacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcggcgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaacaggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgaacccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcagtgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacaggtaagaaacacaggctcgggctgggcgtggtggcttacaccataatcccataactttgggaggccgaggcaggaggattgcttgagctcaggagtttgagaccagccttggcaacatggcaaaaccgtgtctctacaacatatacaaaatttagctgggcatggtggtgcatgcttgtaatcccagcaacttggcaggctgaggcaggagaatcgcttgaacccaggaggcagaggttgcagtgagccaagattgcactactgcactccagcctgggagacagaaccagactctgtctc

SEQ ID NO: 1735 - DNA, 2405 bp, Homo sapiens
tatgcatgcccgttagtaccaggcagctctccgtcctgttgagtaaactctatgctccctttgctggaagatgggaaacagcaaaagtattgcatttctcatttggcctggccttgcctgtctgcctgaaaactgttcagggcaatgcctcgtctgagtttctatgttatggtgggagtttggggtatctttccttttgcattttaaaatatttttctggttttttttaagacagagttttgctcttgtcactcaggctggattgcaggaggctcacttgagcccaggagtttgagaccagcctggccaaaacaaggcgaaatcctgtctctactaaaaaatgcaaaaattagctggcatcgtggcgcccacctgtaatcccagttactcgggcggttgaagcagaagaatcgcttgatcccaggagctggaggttgcagtgaaccgagatcgtgccactgcactccagcctgggcaacagagcaaggccctgtctccaaaaaaaaaaaaaagaaaaagaaaaagaaagaaaaaacaaattccctgactgcatggggtggggcagaacatctgtttctgggcccccatccaccgtggccttccagttgtccacggtgtcctaagagcctcgccatttctgatgttcccgtgttcctcccccagatgtctcccacgtcttccccgagttcccagcgcccgacctgggcagcttcctgctgcaggacggcgtcacactgcacgacgtcaaggccctgcagctggtgtacagacggcactgcgaggtgaccgccccagcccaggcaggcagctcctgcgtgtccctcccgggaaccgccagcgctcaggccaggcgtccccgggtgacgctgaggagctggagccccgagccccccaacaagcatcctctctgaagcagcagcccctccgcatccatgtccatcgcctgctcctctcctctctgtggcctcccttgggattccagggcaccccgctgtagcccggatcacggctgctcacttgacgtgtgctgagtgcacgtgatgggcgcacgcacccgtctgtctcaccggtcccttcattcctaggcaactgtagatgtggtgatgaacctccagttccactacatcgagaagctgtggctctccttctggaactctaaggcctcctccagcgacggccccacctctcttcctgccaggtgactgccacaccctggctgggttcacagccaccccagacttaaccccctgctgacgtccacaggtaacccacaaacgaaagcctcagctctccaagaatcagggttcagacccctctgcctccatccctgtaatttttagacttggtagagttgacttgaaattcacattgccatccgcccctttgcagggtcagactgtttgaatagggaggattttagaggtgaccatgatgcaatcccaagtagaagtgaccccaacccatagctgcagtgagacgcagtatgacagtatgaccactggcaggggagggacagcgtggacagtgagggacagggggaaacacggaggcgccgggagcaacatggagggaggggacccatcgaggctcagggatggggagcaaaaccccagccccactgttgggcaaaagtcccgcagcccggctctctgctcgctcccgtggctgagtgagcccacctgggccaggccacagctcacctgtcccccctccctccacagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaagtgacccacggccccgcccggcgctgctccatcctctcttcctgcctcctctgtcctttcttacatgtacgccttcagccacctcagaccatcgctttcacagaaaacccaaaagtggccgggcgcggtggctcatgccagtgatccccacactatgggaggctgaggcagacaaatcgctgagcccaggagtttgagaccagcctgggcagcatggtgagaccctgtctctaaaaaaaaaaaaaaaaatttatctggggccaggcaaggttgctcacgtctgtaatcccagcactttgggaggctgaggcgggcagatcatttgaggtcaggagtttgagaccagtgtgaccaacatgctgaaaaccatctctactaaaaatacaaagatttagccgggcatggtggcacacgcctgtagtcccagctactagggaggccgagccaggagaatagctttaacccaggaggaagaggttgcagtgagccgagatcacaccactgcactcagcttgactctgtctc

SEQ ID NO: 1736 - DNA, 2201 bp, Homo sapiens
gtatttgcaggtcaagctgggaactaaagggtaatggctgccttcagctgcttaaagacataattggccagtgattggggtattgtggggagcaaccagggacccagggaccagagtgttctgcgcaccgcacttcgctcttctgcaaattaagcttttctcctgcttgatgctgcctgtcttcagaagcctctcaccatgatcgatagctccaagaagcagcaacagggcttcccagagattttaactgctggggattttgaaccattaaaagaaaaggaatgccttgaggggagcaaccagaaaagtctcaaggaagtgctccagctgaggctgcaacaaaggaggacgagagaacaactagtggaccagggcatcatgccacctttgaagagcccagcggcattccatgaacagataaaaagcttggaacgagccagaactgaaaactttttgaaacacaagattcggagtcgaccagatcgttctgaacttgtcaggatgcacattttagaagaaacatttgcagagccatccctgcaggctactcagatgaagttgaaaagagctcgactagcagatgatctgaatgaaaagattgctcaaagacctggtcctatggagctggtagagaaaaacatccttcctgtggactccagtgttaaagaagcaattataggcgttgggaaggaggactatccccacactcagggcgatttctcatttgatgaagacagcagtgacgctttgtctccggaccagcctgcgagtcaggagtcacaggggtcagccgcgtccccaagtgagccaaaagttagtgaatcgccatctcctgtgactacaaacactccagcgcagtttgcttcagtgtccccaacagttcctgaattcttgaaaactcctccaactgcagatcagcctcccccacggccagcagctcctgtcctccccacaaacactgtgtcctcagcaaagcctggcccagcactggtgaggcaaagccatcccaagaatccaaatgacaaacaccgtagcaaaaagtgcaaagatcccaaaccacgggtaaagaagttaaagtaccaccaatacattccaccagatcagaagggtgagaagaatgagccgcagatggactctaactacgcccgcctgctccagcagcagcagctgttcctgcaactgcagatcctgagtcagcagaagcagcactacaactaccagaccatcctgcctgcaccattcaagtacggcggggcccatgctatcctcaacgcggggttttctgtggtttttatgaggaactataagttaccaaaagttgaatgttgtcatttatttgtgctcagtaatgattttcatttctttgttatcagagcttatcacacagtgtctgaagtccacatggtgagagtggcctgcattccattccagtttctgtcctccaaaataggttctgaatttttacaagttagaaatgccttttcacaattattcatccagatttgcctattattagaacaccaaaatagtactagatgctctgagaaaagcgtaagtagtataatacctggcataaacagctaaaagaagagaaggatgggcatgaaagctggagtggtcaaaggaaagcctggtggaaaagacaggatctttgtatatagaaggctcgagaagggcctttccaggcacaggggaatgctgtgagcactagtacagaggaaggaatagagtaagtagtgcctcttcattggaaggtgagaaaaattgcctaaacaaagaatctgattaatttttaagtaaaaagtggaagacaaaaatcgagtacagccaatgtctaaggggacttgaagctgggcagaagaccttactcaacacagcagatagacaacggagtgcttcagagcaggctgctgacgcagtgaggccaaaatataagaaaaaacagctggatgctggtgttgaagggacgtctggagacaatgaagagctctggcagcagagtgagtgtttcagaagacagttaaaggccttggtgacgaacaactgcggagaaggaaggtgttttcaaagtttgaacccaactgtgggggacggaagggagtgaattctgacaatttctgaaactgaattcacagcaagacatcaatggctaattttaattacgtaataaagaaaatttctggaaaaaaaaaaaaaaaaag

SEQ ID NO: 1737 - DNA, 2141 bp, Homo sapiens
atccagaagccatttgagatgaagagaacatttactaatacaaatgaaaaccaatcacttaggcggtttccccctttgatgcataagaaatcatgatgcggtctttgcttgtctctgttctcatccggcatttttatatttgctaggcgcaaataaagtacgattccaatgaataaatagaagtgttaacacttccttacacttttacctaaaccagcttggatgaggaaaggaagtgtctttagaaatctgttctgagaagtactttcacctgaggaagctgataattgagatgagagttgttttcataagcagttgagcgtgcatggtggtgaggtatgaggagtggcggtgagagtgtgggtatcgtgcgcgtcagtgtgagcagcagtgcccgttggtggggtgtgagtgagcgtgaggatggtgacacgctcttgcctggcattgtgcctctgtgtctggtcaaggccacatttgccaagggaactggagcagactttttctacattcttgccggcagccctgggggttttaaggcccacaggaaagtactgtatgagaaattaggatctgtgcttttcattttttgttctgagtctttgtttttatgatatctttcaggtaaccatgtgtgcaagtcagaatttccattttctatcatgggaagttacttgaagaatgttgctgttccttattgtatactttagtgtgcacagtctaaagaaaaagtgagctactacaagaactggtggagactgaattactagggaagaaaattgggataaaactgttgggcaaagaagtagaaagggcaacggaaggggtattgaagtgaagataaacaattttttttgataagtctggctgcatttgctttgccaactccacactgggagagaagggctcacaccgagcagctgccgtccagtgttgctgagcaccgcccagcagtagcgtggagagtgatcttgcagggtgtgagaagaggacatggaggctcgtggaggccgctctgcagcccgctctgcctggctctggctcaggtgtgctgtgtgctctgtgaccctctgcgcctgcaggtgccctcggagcacgtgaggggcgggcgttggctcttcaaggctctccatctcaatttgcttcgaattagggaagccatgagcacatgtgtataaatgtgtcttctggaacagattgctgctgcatttctaagagctttccaattttttatagaaatacttttgtttaactttttgaaggctattttagattcagagtttgttacgtggctgtattgggtgatgctggggtttgggcttctggggtacctattacccaaataggaaacattgtacccaatgggtagcttttcaaaactcacccccatcaccttccgccttttggagtccccagggtctgtcatttccatggtcatgtccatgtgtacccattgtttagctcccaagaaaagacttttaaagataattttaaaaaccaagctttgtttcctctgtttccagcttggttcattccatagcacatctcatcttctgagtcttggtctcgcgtttagcattcgtgatggtttatgtcgttggggtgatgcagaaaccagcctttttttgatatcggtatttaacacgtgcttgacagttgacaccttacctgctctgttgggacttgctttgctcactttgttttttgccgtcgtcttctgtgcttgtttgaaaagctgtttgaagaggtaaggggtgggccattccgttgtgaacactctgagctggtgtgcatgtggcccctgcacagcagccctggccgagcttggctgtgctcctggcactcagagtcaggtagctgagcactcgctcccttttcttctccctgaaacttcaaatattttcttaaagcaattattttttacttatctgtcatttaatgacaaccttagtttcctcctctctttccagttagctgtgccaggggataggtctgtcctagggagcagctgccccctcctctcctcctccctcaggagcgtgcaggatgtctgtgcacaccagcgccagcctgcctcctggtgacacctctcatcacaggactaacaggacccaaatgacacgaggggttttattagaatt

SEQ ID NO: 1738 - DNA, 2069 bp, Homo sapiens
gagccgccatgtcggaggcgcgtggagagccagggtccgggcctgaggctggcgcccgattcttctgcactgcgggtcgcggcctggagccgttcgtaatgcgagaggtgcgggcgcggctggcggccacgcaggttgaatatatttcaggaaaggttttcttcaccacctgttctgatttgaatatgttgaagaaattaaaatctgcagaaagattatttttgctgattaaaaagcagtttccacttattatttcttctgtaagtaaaggaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgtcgctgcagtggaactattggaaaggccttcactgcacaggaggtaggaaaagtaattggaattgctattatgaaacactttggatggaaagcagacttgaggaatccacaattagagatctttatacatctaaatgacatttactctgtggtggggattcctgtgttcagggtttccctagccagcagagcttacatcaagacagctggactgcgatctacaatagcgtgggcaatggcatctctggctgacattaaggtaccatatggctctgactgaaacctggctgtgcactgaggactctgcttcctctgtagacatatcaagtggtggatgtcttttctcccctatctcgagcacgactgggcctgacagtggggctggtgcatttgttttagatccaatgtgtggacttggaacaatacttttggaagctgctaaagaatggccagatgtgtattatgtaggtgctgatgtcagcgactcacagttactaggtacttgggacaatctgaaagctgcaggccttgaggataaaattgaattacttaaaatctctgttatagaattgccattgccttcagaaagtgttgatattattatttctgacattccatttgggaaaaagtttaagttaggaaaagacatcaaaagcattctacaagaaatggaaagagtgcttcatgttggcggaaccattgtattgttgcttagtgaagatcaccacaggcgccttacagattgtaaagagagcaacatccctttcaattccaaggacagtcacacagatgaacctggaattaaaaagtgcttgaatcctgaagaaaaaactggtgcattcaagacagcgtcaacttcattcgaagccagtaaccacaaattcttagacagaatgtcaccatttggctccttggtaccagtggaatgctacaaagttagccttggaaagacagatgcgttcatatgtaaatataagaagtcgcactcttctggactgtagcaggcttgctgccatcagccgggttcaggcccttgtaagttagctgtacagcagaagtttgctgtctctaggattcatatagcacccacagagctccaagtaaccaaattcccccaaagacaggaggtgtggctgatgggtacacatgcttggtaagagtttctgctttatattctaaagtacttaatgtttttgagaaaaaagttaccgaatattttttagacttaagttttatcttctgtcagaatgtgaaaagttctgcccagtttctgagcaaaaacttcaatttcaaaataaaggttttcaggggttcacttaagtgtatcacaatcaacaccagacgggatattttaactatcagattttcggaaatgtaaaaacctttatgtgtaacttcttttgatattaaacttgatttttgagcctgt

SEQ ID NO: 1739 - DNA, 2220 bp, Homo sapiens
gcccctggtggtctggtggaaggacggacagaagctggactttcgcctgcagcagggcgcctaccggctcctgccctccaacgccctgctcctcacggcccccggcccccaggactcagcccagtttgaatgcgtggtgagcaatgaggtgggcgaggcccacaggctctaccaggtgaccgtccatgtgcctcccaccattgccgatgaccagacagacttcaccgtgaccatgatggcacctgtggtcctcacatgtcacagcacgggtataccagctccgaccgtgtcctggagcaaggcaggcgcccagctaggagctcgggggagtggctatcgtgtctcaccatcgggcgccctggagatcgggcaggccctccccatccacgcaggccgctacacctgctcagcccgcaactctgccggcgtagcccacaagcacgtcttcctcactgtgcaagcctccccggtggtgaagccgctgcccagcgtggttcgggcagtggcagaggaggaggtgctgctgccctgcgaggcctcaggcatcccccggccgaccatcacctggcagaaggaagggctcaacgtcgctactggagtgagtacccaggtcctaccaggcggacagctgcggattgcccatgccagcccagaggatgctggaaactatctctgcatcgctaagaacagtgcgggcagtgccatggggaagacgcggctggtggtgcaagtcccaccagtgatcgagaatggcctcccagacctgtccaccaccgaaggctcccacgccttcttgccttgcaaggcgaggggcagtcctgagcccaacatcacctgggacaaagatggccagcctgtgtcgggcgccgaggggaagttcaccatccagccttctggggagttgctggtgaagaacttggagggccaggacgcaggcacctatacctgtaccgctgagaacgccgtgggccgggcccgccgccgcgtgcacctcaccatcctggtactgcctgtgttcaccaccctgcctggggaccgcagcctgcgccttggggacaggctgtggcttcgctgtgcagcccggggcagccccacccctcgcattggctggactgtcaacgaccggccagtcacaggtctgggtctgctgggcatgggtgggacagagagccaggacaccgggaggttaagaagggagggcaggtggggagacccaacctagtggaaaggaagaggttgtcagccagccctgttggttctgggtcttccaacgtggccctatgtagggggacagggcaaacccagctgtggccatatgtgacaagccatatatcagagctggcaagaggccacctgagaagactcaacccagagacctcagggccaggaaggggaggcctgtgttctagtccagagctgctgctcccattgtgggaccctcagcaaaccccttttgctgggggcccgtggggactctgtcctcctaccggaaacccaggtgatgtctagggagacacagggcctgtggagtacctgctgggtactcaatgtttgctgaattgataaattgctaagtcccctccactgcaaaatgatactttcctacattaggatatgacatcacacattcctaactctgagtccccaggtgtggaatacccgtgctcacctgtggtgaaggctttgctcggctccaccacttcctggggagggaccttgggcaggtataatagttcagcctgtctgagcgccgctctccatctgtcaaatggacataaccaggggtcctgaggacagaatgacaatggaggggccgtgctcggcacaggcctggcccggagtagatgcccaattgatggtactgcttgtctgtattcctctcctagaggtgatggcccaccccaaaggaaaagttcattattagaatccttctctcggctgggcgcggtggctcacgcctgtaatcccagcactttgggaggccaaggcaggtggatcacctgaggtcaggagttcgagaccagcctggccaacatggtgaaaccccatctctactaaaaatacacaattagctgagcgtggtggcacatgcctgtaatcccagctacatgggaggctaaggtaggagaatcggttgaacctgggaggtggaggttgcaatgagctgagattgcgtcattgcactccagcctgggcaacaagagtgaaactgtctcaaag

SEQ ID NO: 1740 - DNA, 2404 bp, Homo sapiens
cagcagataatgcagctccagcagcagcagcagcagcagatctctcagcaaccttacccccagcagccgccgcatccattttcacagcaacagcagcagcagcagcaagcccatccgcatcagttttcacagcaacagctacagtttccacagcaacagttgcatcctccacagcagctgcatcgccctcagcagcagctccagccctttcagcagcagcatgccctgcagcagcagttccatcagctgcagcagcaccagctccagcagcagcagcttgcccagctccagcagcagcacagcctgctccagcagcagcagcaacagcagattcagcagcagcagctccagcgcatgcaccagcagcagcagcagcagcagatgcaaagtcagacagcgccacacttgagtcagacgtcacaggcgctgcagcatcaggttccacctcagcagcccccgcagcagcagcagcaacagcagccaccaccatcgcctcagcagcatcagctttttggacatgatccagcagtggagattccagaagaaggcttcttattgggatgtgtgtttgcaattgcggattatccagagcagatgtctgataagcaactgctggccacctggaaaaggataatccaggcacatggcggcactgttgaccccaccttcacgagtcgatgcacgcaccttctctgtgagagtcaagtcagcagcgcgtatgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaactt

SEQ ID NO: 1741 - DNA, 2184 bp, Homo sapiens
gtgtggtcccaggcgtggccagacccagacgtcctggagatctcaatgcagacacccggcggcagttcctgcaggaaggaggctgtcctgccacgcctgcgggtgacccggcctctggtgccagagcctgccatccttcctgtttgtgctgccaggctggcagggtcccttgccaccgacctcagccgcagccacagcctgctccctccctgggtggatttgaaggagcctcccccaccctccgcccctagcttgctccttgaggaccctgggcggggtggctgccatggggcccaatcgtgcgtgggaacctgcgagctggcaaacggggctcgggggttttgcccagaaatgggtcagaacgaaagcctctcagaggaaagaaaagggcatgagtcaaagagaaagtcggggggcaggggctccccctcatctcaccccacccaggcctcctgactccctgggtttgtgcggacccaggcaggcagccaaccccagctccgtggtgtgtgagcatcgtgatgatcaggacacaagctcttccccgctgagccttcactgtgggccagcttcccggtggatgcccactgaagaggcctcaacccagtgggccccactccagaccaagagcagaccattggccagctgccccctgcggacagcggcacccggggcagcagcaaggtgaggggcacccagccccagccccaggggcgtctcagggagcgggctgagcctggctgtcttcctgagccccacctgcttcatgggttggcttgagcaaggcagtccagatgcgtgtctcgagcgctccctggcggcatgctgcaaagctacatggctccggcaacaaggaagactgcccttattctcagtaacaggttgagctgggggctggagagcccctcggacctcgccttgggaaagctgggtgggtgcacggagcctggcaggtggccaaggggacccccaagtggagggattggtcgaggggcagcgcagggtggtgcagtgggtgagctcagcccctcccctccaactctcatcccattgagccccaaggcgtggggggatcacgtctgtccttgttctcctccaggtggagctgctgggtggggctctggtcctccagggacccactctgcaccccaagttttgccgggacccgctcctctgtgttgtgtggctgtaggggagggctgcagccagggactctgaacccggggccggcccacccagccacccagggtggggaacaagatcgcctcccagggccagaagctggggatgtccttgcttcctaggatgttggctaggggatcacacgccccacattctgggtcaagcatggtcctgccccagcatcttgctgggttgggggcatctctgcacagatgagtgccaccccagcgtctccgccagggtctgggcatgtcactcttgggcatctgtgctcaggaggtcaccaggtgtgggcagggcaccaagcagggaggtagccgaggctggaagatgcacatcagtgccccgctgggcttcctcaagtgggaactggtggagggggcgctaggctgccgggccagggtcagcaggctcaggccggctcagggctcagagttgagccagaaaccaaggtgaaatctgcctcttactgccgccagggcccttgggacagggacaggaacagcagaaggtaaagtggaaaggaattgagtaatgggcccccaggcaaggctgagccaggccccaagcccaggattggggtctccagagtccctgggggccccagggcagctcacccacagcctggggcctatgggagcaagggggctcctgatgggtgggggcaggagcttggacaaagttgaaggccttctgtctgaattggccaggggccaatgaaagccaaaaagctggtgtggtggcttatgcctgtaatcccactttgggaggccaaggcgggtggatcacctgaggtcaggagttcgagaccagcctggtcaacatggtgaaaccccatctccactaaaaatagctgggcgtggtggcaggcacctgtatgtaatcccaaatactcgggaggctgaggcaggagaatcacttgaacctgggagatggaggttgcagagagccaagatcatatcactgcactccagcctggctgacagagtgagaatctgtctc

SEQ ID NO: 1742 - DNA, 2722 bp, Homo sapiens
aagacagaccacgaggtaccccagatggaggaatgtgcaaagacgccggggctggagctggaatccgtcccgagacttctcaccttgacctcgaggaaggcaggaggtcggagacagggggtgggcaggctggggaaagaggaaacccgcaggacaagagggttgtggctcgtcacgtggccacttgagggcagcaagtagctgcagctggaggtagctgcctatctgattctgtttgagagtccgccaagttgggatttaaattagacatcaagaagaatttacagaccggccttgccttgttccacggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgagtccctcaacaaccaggatgaaaacacgtatgtgaattgcctggattctcagcagtgtcacggcagctcagagtcaaggcgaccttgaggatcactggagctcatgcagtcctgctagcccctacacctactcacatgggcagatgtggccttggtcctggggagctgggtgggaaggaaggcagggatgccacaaataccttcatcttccggggaagtagagggaatgggagtgcctgactacctcagcctggggaccttggctcctcttctcactatcagcagagagctgttactgaacagtgaaaggggaaggcttctttgtcaatcccatcataactctgtccttttggtcctcctgcagatgctccagtggctttgaccgctatcgccaggagtggatggactatggctgtgcacaggagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagatggttctttaggacattagtccaccatcttcttggtttgctggctctccgaaataaagtccctttccttgctcc

SEQ ID NO: 1743 - DNA, 2758 bp, Homo sapiens
actacatatggtaaattaaatgttcaaattccagctccattttctactcgtaatcttgggcaaacttgggcaagtgacttacttctctatgcctgtttccacatctataaaatgggaatacaagcaatatttctctcatagggttgtttcaaggactaaaggaggtaatatttgtagcattctaagaataatgcaggtctacagtaagtattccataaacctcttgctattgttattattataaggctttacatattttaaccctcttaatacattagtcttcctaacatcttaggaactttgtacatgctgttcactttgcttggattattcatcttcaagtctcaatagggtggcctccctcaggaagccatgatccctcaagataagtcagccttgccacctccgacttcgatagctctgtgttctccttagcattttacacagcctgtcataatacattttttattgcctgtcttcccctctggactgagtcctgtgacagcagagcctggagctgtcttggttgccaccatgtgcccaacattgtacaacatttatctgagcacctggtaggtggtcaacaaatagggagggaagggatgaattaatctgatgttacagaagttatctttaccctgaaagcacagtgagctatgggttttaagcagggcagacataatacaatttgagctccgagcattccagacctttgcacgtgctatttcttctatttactatgccttccttctctatctttgtttggctcagttctactaatttctcaaggtcttatcctttgcaggatgctttccctgagcccatcatgtttcctctgggatccctgccttgtggcctttttccatcacagccctgatcactgtgggctatcactgtcaggggactgtgtgagtctgtctgccaggactgtaaactcctcgaagggagtattagaaatgttctggtcatcactgaggaaagctttgaaaatgattattgaaggagagtggtgggctgcctgtatacccacacttacaggtatctccctacacagatgtcacctgtgagaatcccagatgtcctttctcccagctcccagcactgccctcccagctagacctatgtgagcaggtgtttgggctctcagccttgtcagtagcccaggctgtggctcagacgaactcctactacggtggccagacccctggggctaacaaagtgctgtttgttaatggggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaaggagagccagattaagggtgaagtctgaatctcataccctttccactccctgcatggtcacctcagtcctggacatacttgttcactgaacaaaagaaagcagcttgttttgaaagaagaaactcccaggaattggaattcagcacctgttccgcacgtaattggcatgtgtctgcaaacatccttattcccaacttaaagtgctttattgcagaaagttatggaaatataagtggatgattattctcattgtaaatattggtattttgaatgttaaatgtcaaacaaatgtgacttatgctggtgccctcgccctgctgatcagattctggttcaaattctgccactccagctcctgggttaggggctttgctgtaagtttctttttctggactttagatcctgaacctgtccttgcttctcagtttctctcactgtacccctttccctcagtctcttcctctctctttcccctgtcactatttgtctttctaatctccttctgtttctctgaatatcttcatttctatctctgtgtttctgtctatttctctgtttatctttctgtccttcaatctgtgtttttgtttctggctctccgtcagtgtctttttctctcctctctctcttgctctgccatggctatttccactgctctatttctgactctcatttttggtctctgtgtgtctcctagtcactttctttctcactctgtctctgtctctatttctgtctctcctctgctgtgtcctcaatctctctgtctccctgaggctctatttctgtctctcctctgctgtgtcctcaatctctctgtctccctgaggctctatttctgtctctgatgctcttcttctgtgtctctatttctcttcctgtcacttaatcttttccttctctatctctcttatttagtcttccttccacacccttcactcaccatcttttcccacaatcaaatatcactccctggtacttccagcttccaactctagggattcatgattctggtggagattccttcttccagggcctgggaggatagggctaatcccaagggtgcctgcttaggctatgttagctgtgacaggaacctgccatagatttgcactgttctttcctaaagatcaattattttcagcaataaatacttctcagctttttgtatgtctttgtatgcacagagatggtcgttttagagttttatccagtttcatatttccttgtgggtaagaggcaacctcctcatgctgtcataccaaagtcaatctccactacactttagttctgcctgttcttgatctttatataaatggaaacttgcagtatatatt

SEQ ID NO: 1744 - DNA, 2196 bp, Homo sapiens
attggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggtgagcgccctacccctcactgggcggagccccgggcagctgcccgcatccccgtggaggcctggcggtgcccccggcctaggctgtgccgctccttgcaggtgggaatcctggatgtggacctgtgtggccccagtataccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacggtaacggccgggcggcgcgtccgccgtcctggtgaagggggttagcgtccgtgccggcctctcctgtggaaatgttcctcttcagcagccaggcctgttcctggggacctgcacatgacacccacgaccaggcacagggctcaggctggcggtgtgtctccagttgggtccgtgctgccacacagctgtccccaactcccggtcagagggagtggggtctgctgagaccctggccatggcatgcagggacctgaggccccagtgtggcaggtcataggggcagagctgagggggttctggtgcctctggagcaggtggcattagacgcccccaaaggcagggagaggctggtgggagtgaggcgcaggctgtgggtgcaccagtggggcatccaccacggagaatgtgggtgctcccatgtgtgggtacagacgcctggagggtcctggctccgtgttctgatttggggcctcggggagtcagcgggggctctgtgggcaggggccagacactgcagaaagggacgctgtaatggccccggccccatctttgcactcctgcagcgggccagggcctcccgagagcctgtgatggaggctggtggcaagtgacacctgatggactgcagcccctcggcctgacctggctggttcttagtggcgcagggccacgtgtgcagacctgccctgccctgaccgccccgtctgccccgtctttgcagcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccccgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagcgggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtccacacagttagcggagcgcaggacttctgcagtcctcaggtgaccccgggcctccagcaccctgggtcgctgtcatctgtgtttagctcggggagtgccccctaagggggcgaactgacctcaggcatgtcttgtaactgtagaggcgcctgccattaaacgtgtccgctgctgtggcgac

SEQ ID NO: 1745 - DNA, 1868 bp, Homo sapiens
agctttccccggtgtcggcggcaggtggaatttccacgctttatctgcgcctgcgccgcgcgggattcgcggtccgagctgaagaggttcgcggtccggtttcacttctccgaaccctgaggcagtgtgtgaagctgggacgccagccatgttccagaccgcttggcgccaggggatgaggccagaactgagaaggaaggattaactccaaaggatcatgtgtccaaagaaacagagtccttcagactgatggtggggggcctgccagggaatgtttcccagcaccttgactttgggagcagcctagagcagccacaaggtcattggataattaagacaaagtcaaagaggagacatttcacagatacctcagccaggcaccatgaggcctatgaggtcaagaatggagagaagtttgagaaattaggaaaaaatattagcgtcagcacacaactcactacaaatcagacaaatcctagtggtcagatatcttatgaatgtggacaatgtggcagatatttcattcaaatggcagacttccaccgacatgagaaatgtcacactggtgaaaagtcttttgaatgcaaagaatgtggaaaatacttcagatataactcattacttattcggcatcagataattcacactggaaagaaaccatttaaatgtaaagaatgtggaaaaggtttaagttcagacacagccttgattcagcatcagagaatccacactggagaaaagccctatgaatgtaaggagtgcggcaaggccttcagtagcagctctgtcttcctccagcaccagaggttccacactggggagaagctctatgaatgtaacgaatgttggaaaactttcagttgcagctcaagtttcactgtccatcagcgaatgcacactggggagaaaccttatgaatgtaaagagtgtggaaaacgattaagctccaacacagccttgactcagcatcagcgaattcacactggggagaagccctttgaatgtaaggagtgtgggaaggcattcaatcagaaaataaccctgattcagcaccagcgagttcacactggcgagaaaccttatgagtgtaaagtgtgtggtaaaaccttcagctggtgtggaagattcattctgcatcagaaactacacactcagaagacacctgtccaagcatagggctatccatagttaggcccactgtgcctctccttttttctctttattttcatgctttttatcagtgtcctcgctgtccttcctggttagacacttggctttcatcatgaactcttctttaagttttttgaacctgtttccccaacatgaagtctctttatggttagagaagaccaaaaaacaaacaaacaaacttagaaacataaaaggaaatgtaagtttccagatttaaaggacatgctgggtgcccagcaggatggattcaagggaaacctacattaaggaaaattgctgtgaattatgaaaacaccaagtttgaataagaggatcatggagaaaaaatgagaccctaaaaagtttctagagagagaaaacaaaagatcagaaatgaaagcggggccaggcgcggtggctcgtgcctgtggtcccagcactttgggaggctgaggcgggtggatcatgaggtcgggagttcgaggccagcccgcccaatgtggtgaagccccgtctctcctgaaaaaaaaaacacagaaattagccgggcatggtggcgcatgcctgtagtcccagctgctagagaggctgaggcaggagaatcgcttggatccctgaggcagaggttgcggtgagctgagatcgcaccactgcactccagcctgggcgacagagtgagactttgtctcaaaaacagt

SEQ ID NO: 1746 - DNA, 2325 bp, Homo sapiens
ttttttaaccatgttagaagttgttctcaactattgattataccttcatcactctgtggggtcttaacatttggtgtaatatgttaatgccgcaacctttttttgagacggattctttttctatcacccagctgcagtgcagtggcatgatcttggctcactgcaacctctgcctcctgggttctagcaattctcctgcctcagcctcccaagtagctgggattacaggcgtccaccactatgcccggctaagtagagaagggagtttcaccatgttggccaggctggtctcgaactcctgaacctcaagtgatctgcccacctcggcctcccaaagtggtgggattacaggtgtgagccactgtgcctggccttgatgcctcagtgttaatgaggtagaccttgttcagtgccttgttccaaacctagcagaatgaatcttgataaagcacagatataatagggtctaagggcaagaaggagtttgggtggatgtggcgataacaagccttggaggaagggagaagaaatcacagttctcttgtcatttttccttttagcttgtcatctctagagaatgctatattagggtcggtctgtttggaaaatttctgtttcctagtattattaagtcatttcaggtttcaaagggaaataggttggcatatagtggtattcagtacttgcggctcttcttcccgggcgtctgaagaagaacgatggtggggcgggttcttccttttggcagaagttgtgtggacacagcatactgcttatgagacttgggtaaatgttagtgtgcagaataaatcgctttcatggtttgtctctttattctcagacagaagcattaaaatgcgtggctcaggctagcaagaacagatcactggcagattttgaaaaggctctgacagattaccgggcagagctccgggatgacccaatcatcagcacacacttggccaagttgtatgataacttactagaacagaatctgatccgagtcattgagcctttttccagagtacaggtgagaaccctctggggactccatttctggccaggcattctcactgtagccacctcccttccacacctgtccagaatgggaactcacttctaggggtgtgcctggtgggcaagaggccaccaagagcttgggcctctgttgataaaatgaacaaaaatcgaggagagagatgctgtgggtagaggcatgtgggttgcccctgcatgtgttctgagcagtttcctcctcgcttttagtcactgcatgtgttgtacctgttttctgtattgggtgtgtgggataagagtctgtttattgtgtgtagtagtgaagggcaggcagatgggcagagaacaagagacttaagcacggccaaggagggtcttacattagaattttgagaaatacagcagttctccccctgttccctcccttctcttattggaggcaaaagtaaaactttcagtgttggtgtctctctgcctttccttttagattgaacacatatctagtctcatcaaactctccaaggtaaggagtcttaaggccatctgcagggaggaatgggacggggtggcgaggaggggtggcacatgcacctgattggcctcattggaaagctccccagcttctcagtggggaatgggcagtgtggactagagtaggagttgcattgttgctattttgttttcagtccatttggcctaagacccctccaacaaagctactgtgtcagggtgatctctgactagtggatactggtccctttaatcatgtgctttgattttaggccgacgtggaaaggaaattatcacagatgattcttgacaagaaatttcatgggattttggaccagggggagggtgtcctgattattttcgatgaacccccagtagataaaacttacgaagctgctctggaaacaattcagaacatgagcaaagtagtggattccctctacaacaaagccaagaaactgacataggtgagtgctggcttcaggaccccagggctgggcagctctgtcttctgcgtgtcgagactgaaaacctcctcctggtgtcctcatggcttcctgattgacactgctctgtcttctcttgcagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgctt

SEQ ID NO: 1747 - DNA, 1969 bp, Homo sapiens
ttgaaattctccacaagtgtgcttagagtaggtggaatcctcatttcacagatggagaggttcagaaggtctgagaaatctcacagagggacccaggagaaggcagcctccttgtttccatgaactcaatggattccacaggcaaggactatacgaccttgcctctgacaaatgaggaaactcaggtccgagaggaaagggggttctgtaagctcatatggtgtgtccttggcagagctacgaccagctccttactgataacctatgtaggctggggctcttcccactgcagcacacctggccctactgcctgcctggggaagttgttcttatgcgggccctggtctctattggagccactgagggtggttggacttcttgggcctattgtactgctttgtgccctaattgactgcctcatcttctgcccaaaagagggagtagcgtggtgaatgggaaggaaccctgggtttggggttccagtgctgactctgccacatagagtcatctgcttctctctcttggccatctgtgaagtgagggtttgggtcagtggaaggctgcttcttcaagccaatgtttcttccagaagttgccgtggggattgaggagaaaatgaacagagctctaggatgcttgtctggatttatttattacttttttaataagactcacctaaaaccaccaccacctcctcctccaaatactgggagggtagggttttcatgaatggagattcctgtgttcatgccacaggacatcttagctcctctcacttctttcctgggaatgtagggacctgcctgctccccatctctgtccccttagttaccatttccctctctgtggtcctcacaggtcctggatggaaggaagcccaccggggggaagctggaggtgaaggtgaggctgcgggagcctctgagtggccaggatgtgcagatggtcactgagaactggctggttctggagcccaggggcttgtgaggtgggcagctctctgggccttcagaacctttgccccctccttttactcaactaactactcaactcatatctggagagaaaacctaggagtttctcatctatgagaaagacctaccatgctgggtagggcttatgggctgagtttctgatgttcctcagtagaactgggaagagaaggtaaccttccaaggtttaactatctatctatctatctatcttcaggaaaccctttctaaaatctttgtgttttcactgcagtttagactgacttcttgtgctttgcacccctgtgtagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctatagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaatttt

SEQ ID NO: 1748 - DNA, 2609 bp, Homo sapiens
agatgacactgtggtttgggctgaagaatgtgttgcctgcgcaaattggctctggatgaatactgcagacaatctggagctcagcctcttttcccatcttttggaaatccttcaatcaccaagggaaggacccaggaatgctgaagctgcccaccaggcacagcttatacccaagctcatcttcctattcaatgagccgagcctcatcccctccaagatctccaccaccattggcatcctggcctgtcagctgaggggccacttcagcacccaggacttgctcaggattgggctgtttgttgtgtacaccctcaagccttcgtcggtgaatgagaggcagatctgcatggacggagccctggacccttccctgcctgctggaagccaaacatctggaaagacaatctggctcagaaaccagttgctggagatgctgctcagtgtaatatcttccccccagcttcatctgtcctctgagtcaaaggaagagatgtttctgaaactggggcctgactggttcctgctgctcctgcagggccacctgcatgccagcaccactgtgctggcattgaagctgctgctgtactttctggcaagtccctccctccgcacacggtttagagatggcctgtgtgcaggatcctgggtggaacgcagcactgagggcgtggatattgtaatggacaacctgaagagccagtcaccactgcctgagcaaagcccatgcctgcttcctgggttccgtgtcttgaatgactttctggcccaccacgtccacattccagaggtctacctcatcgtctccaccttcttcctgcagacaccactcacagagctgatggacgggcccaaagacagccttgatgccatgcttcagtggctcctgcagaggcaccaccaggaagaagtcctccaggctgggctgtgcacagaaggtgccttgctcctcctggaaatgctgaaggccaccatgagccagcccctggcaggttctgaggatggtgcctgggcacagaccttcccggccagcgtgctgcagttcctcagcctcgtccaccgcacctacccccaggacccagcgtggcgagccccggagttcctccagaccttggccatagccgccttccccctgggagcccaaaagggggttggggctgagtccacccggaacaccagcagtcctgaggccgcagctgaaggcgacagcacagtggagggtctccaggctcccaccaaggcacatcccgcccggaggaagctgagggagttcacgcagctcctcttgagggagctcctgcttggagcctccagccccaagcagtggctgcccctggaggtgctcctggaggcttctccagaccacgccaccagccaacagaagcgagacttccagtccgaggtcctgctttctgctatggaactattccacatgacaagtggaggtgatgcagcgatgttcagagacggcaaagagcctcagccaagtgcagaagctgctgctgccccttctcttgccaacatctcctgcttcacccagaagctggtggagaagctgtacagtgggatgttctcggcagaccccaggcatatcctcctcttcatcctggagcacatcatggtgatctcagccccattacaagctagagacttttcctgacaagcctccaggaaacctttgctcaaaccctccctgtgatggggaaccccctaaaattcaagttgtcccacccagggggatgtctgtgattcttggaaagaactttctgttatcaagctgggatctacctccagcaactcctgccagcagtcctggttatgccctctgcagcagaattaggaggaccactctccttcctcttcacatctcatagagagtgaaattggctcccagcacccttctgactgcagagtcacccacagacctcaggactgggcctcttcacagtttctagagccatcttcacttgtctgatgagcaggtctaagcaaacctggagagacttgaattcaaaggcttcttcaggaacaactccaagagaggagaaatagcccttgtcagctctgtgagggttaaaatcagattcctggcaagttgtgttgtaaatggaaagaagctgctgagctccctatggctaaagcatggactcccagctaatatcccaaacataggtgccagtgggggccaccgtgctttcagggggaccaggcctgagggctcggctccccacatatccaccagcctcctctcttgcttgctgtctgtgatgcctgcccctcttaacctctgtttgagacccatctgaggagcaggagaggaacatgataaagaaatgaatcccaaaccccaacaggtttaaacagaccttcacttcatgagtagaaacattgcgttacctgtgaaattctaagggagtagcctataacaaattcattttctatcggactgaaaaactttgtgcatactctttgtattatggattcttttcatggaagccaaacagatgtttggagatgtatggaccagtccatgctaaggctacaaatcagggtcttctacttctccctctaagtttcttttgaattaaaatcttctggactccgtctccagt

SEQ ID NO: 1749 - DNA, 1941 bp, Homo sapiens
tttttttaatgaagtgcatcgtgttcccacttgcacttaaagttcacatttggtgccaggctgtattgcttcttctcactggtgagtggcagctgtgtctcctttctgccagtccagcagtcccagctgtcagtggcacctgcataatgacacgtctgcatttcctcccaatcagcgtgcagcggttttgggaggaggaatgcgactgcatggcgcgctcgctgcaacctcagtctgcagcctgctagggacgcacggccacactcctgtccttcagcctcagtctgcagcctgctagggacgcacggccacactcctgtctttcagcctcagtctgcagcctgctagggacgcacggccacactcctgtctttcagcctcagtctgtagcctgctagggatgcacggccacgctcctgtctttgaggtgctgtcagaacagctttctcctcggtatcccgccgggtttgactggctagtgggcttgctttggtttggactcacccagatctagtgcagggacacacacgggggccggcattgctcctttccgccatgtggagttggccggggccagaggcacatgctctggtttggacagcccggccctgggggctggaataggaaatgcctgcgtccctttaccctgcccaggggccaacacccccagcctagctacggcttcccccaggtgaacgaggtggtcttcagccccggggagtcccactgcgccacatgcagtgaggatgggagtgtgcgggtgtgggccttggccagcatggagcttgtgatccagttccaggtgctgaaccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggaggtaaaccatgctcctggcactgtgggtggggccggtacccatccaccccaccgcagcatgctgcgcctttgctgactcagggccacctggcaccctccctcgctgccttctgcccttgggatggggcgctcctgatgtacgtgggccccggtgtttacaaggaggtgatcatctacaacctctgccagaagcaggtggtggagaagataccactgcccttttttgccatgtccctgagcctgtcccccgggacccacctcctggctgttggctttgctgagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgc

SEQ ID NO: 1750 - DNA, 2558 bp, Homo sapiens
tttttcttgttcacaaaaaaattccctgtaaatctgaaatatatatatgtacatacatatatatttttggaaaatggagctatggtgtaaaagcaacaggtggatcaacccagttgttactctcttaacatctgcatttcagagatcagctaatacttctctcaacaaaaatggaagggcagatgctagaatcccccctagacggaggaaaaccattttattcagtgaattacacatcctcttgttcttaaaaaagcaagtgtctttggtgttggaggacaaaatcccctaccattttcacgttgtgctactaagagatctcaaatattagtctttgtccggacccttccatagtacaccttagcgctgagactgagccagcttgggggtcaggtaggtagaccctgttagggacagagcctagtggtaaatccaagagaaatgatcctatccaaagctgattcacaaacccacgctcacctgacagccgagggacacgagcatcactctgctggacggaccattaggggccttgccaaggtctaccttagagcaaacccagtacctcagacaggaaagtcggggctttgaccactaccatatctggtagcccattttctaggcattgtgagtaggtaggtagctagtcacacttttcagaccaattcaaactgtctatgcacaaaattcccgtgggcctagatggagataatttttttttcttctcagctttatgaagagaagggaaactgtctaggattcagctgaaccaccaggaacctggcaacatcacgatttaagctaaggttgggaggctaacgagtctacctccctctttgtaaatcaaagaattgtttaaaatgggattgtcaatcctttaaataaagatgaacttggtttcaagccaaatgtgaatttatttgggttggtagcagagcagcagcaccttcaaattctcagccaaagcagatgtttttgccctttctgcttcactgcatggatacagttggtaaaatgtaataatatggcagaattttataggaaacttcctagggaggtaaattatgggaagattaagaaaggtacaaattgctgaggagaagcaggaaacctgtttccttagtggcttttatcccctcggcatgcgatggggctgatgtttctataattgcctcagactttcacatttactagtagggctgagagaggctttagtgaggaaagaatattcagaataaaacggttgagaaagctgagaagaccattgagttttgatcagttgtgaatagagtgcaaagccatggccaagctgtttttggaaacgctggccggcgtgtcttcagtggaaaaagcaaatcaaaatggagcgagagcaaaggggcgtcctcagtcctcaacctacaatcactgtatggaatcggtcctggcagctgaacataggaggtcactggaacaagtgatagtgcagattggctttcaaacatcctcctggcttgagttttatcagctacaatgtgggtcctcttttgaagccttaattcacaacagcagctttttgggggtggggctgggcgggtgttgtcattgttctttcccttcctgtaagtgtcgctagttgctgcctcgtatctcaggtttttctctgtttttgagaaatggacagttttttgaccaggatgtgacttcatgtttcctatggtgacttctaaaaccagcacagaatgatatgactcaacacagaccgacttggttatggggatgatgagccgcacagacctcactagttgtgcacaaataatgtgctatgatggggtgtaaagtgaaggcagaagagggtcagccgcattgttatgatactgggaaagtgccggtcaacgatttgagttagtttttagatatacattgaaatctttaatcagacattctcaagtttcacacagtagtttttgacgttatgtacacacacaccaaatgtgtaacagttcaccacttccagagtgtggtcatgcccaaaacatgtttaagaaaggaaagcagtagctccttgctaacgatgtttcaggaggtttggggcacttggttttaatgagcttctgtcatttagggcttctcttggccatggtccccttccttctggaactgtgatgtagtcacatcctacagcctttagtgctggttcactagtgtcagataatcagttcttggaatcgagactgccgtggcgaaggggtggcctcggaggcaggctctggagctgcttggatgtctttaggtggggtggtggctggctctcttcagcatgtaattggggaaaccctcgcgtctactaggggtgatacagatggtgattttaaagagcaaaactagacttctatgtgagaagtgctggaaaatgatttaggacgtgtaaagttagatggaaagactgtaaatgtttaatatgaatatagtgttcttttgaagtaaggccagctgttgaacggttaaactgtgcatttctcattttgatgtgtcatgtatgttaatgtatgaaatgattaaataaaatcaaaactggt

SEQ ID NO: 1751 - DNA, 2741 bp, Homo sapiens
atgatctcaggagatgtgtatgggttcagcttgacaaggggtggacttaccatggttaatactgagtgtcaacttgattggattaaagatgcaaagtattgatcctgggtgtgtctgtgagggtgttgccaaagaagattaacatttgggtcagcgggctggagaaggcagacccacccttaatctggtgggcaccatctaatcagctgccagcgaatatacagcaggaagaaaaaggtgaaaaggcaagactggcctagcctcccagcctacatctttctcccatgctggatgcttcctgcccttgaacatcagactccaagttcttcagttttgagacttggactggctctccttgctcctcaagcttgcagacagcctattgtgggaccttgtgatcatgttttagcacctcttacgaatgagtgtctgagcagccaaaaaataaataatgaatcatccaggcaaaggggaagaaaaatggacttggccagagatggggaagaacgtacgcaaaaagatgaggtcgttcagattggaagttggattggagggcagaccaaaggagaagctgctgaagtagatgttaaagatggagagaagtggacggcagagacatagaggaggaaaagtcagcaagacccgagatgtgtatggagagttagagtgtgggaagtgtgacatgtaactgaatcggatgatggcaactttcactgggcagtgaaaggtcaggttggtggtaaaagtcatgagttgactttggggcatcttgatatagtcacttccaatatcatgtgtttcaacaagcccgtgttccttcctggtcagttcccccagctagagtgtgttttacatcccgcagcattgtatgagaactgctagaatatcactcaccacttcccatagagattctgtttgttcatctgcttgtcccactgtgtgccttacacatagtaggtgctcttggaatgtgtgtgagatggattaacatgagaagtgcttctctgcatgatttcaccattaaagtgttgaaagcaactagcgctcctccttcctgacctccaggcttccacccagctgtggggactgctgtggtggaagggcctagtctgaatctggacaggggaggtgcctgcaaatattttcgtgcctgcaaatatttttgtgcctcgggacagatggatgtccagtttactgtctgcttcctcagtggttctagaggtaattgcatcctgctgtgtacagttaggtcgtggaggagacaggcaccttctctagtctttctggaaggtaaccagaggtctttcccctttcctatcatggcagctgctcagtcgcaggctccagatgtctgcttcagaattcaagaacaccttcctgagctgggaaacagatccaaggaaatatcagccagaggcttcattttatcatctgtggaaatgcaagatgttagagcacctaggagggtcttaacgtgcaaaacactgtcttgaggctgcctgcagaacagagggtcatctgctttcattagattctcaagggagcctcaacaggctacacctgaaccccaggtttggggcatctctccagccctcccagctctgacatcatcatcaccattaacagctgaaatgtgtgaggtggttgggatgtaccaacaaccctcccaagagtcccatatctacctgacctcatttgaccttcacagcaacccagtgactcagctgctatttggcccacgttttacaaacctgagtcagtgtgctttacctcagtgacccaagaacccaggtgctagagtcaggcctgcatccaaatcaggggtgggatcagtggtgtgccctgaacaaatcattatcctcttttttgttttattttttggagacagagtctcactctgtcacccaggctggagtgcagtggtacagtctcagctcacagcaaccactctctcctgggttcaagtgattctcctgtctcagcctcccaagtagctggggactacaggtgcgtgccaccacgctcagctaatttttatgttttagtagagacagggtttcaccatgttgcctaggctggtctcgaactcctgagctcaggtgatccgcctgccccggcctcccaaagcactaggattacaggcgtgagcaccccacccagctcattaccctcttttaacttcaattttctcatccacaaaatgagggcaataatctcctttcttcctcactagccatgttcatgaaagtacttatttgcccattttaaaatatgtagcaatgtgccccagaaaggctggggcatgagtcctgcttggggtggagcagggaaggcctgctctgccccactggggtgtcctcagatgaaagtgggtgtgggctgactttctctgagctccctgtggagtcacacggggaactgggttgagtcacagcacaagggcactcacatgccccaccccgaggaggtccctgttctgacagaagccctgagccgtgactgtggactgacacccactgcctctgtgaccttgggtgggttacataacctcccacatgagaaggaggcggaggcacccgggcttgtggcctgagctaacctgggtagtgggagccctatctgtgaattgccaagggactgccatggggactggtgagaacacagctctgcaaggcccttttgatttgttttaacctttaacttttcaaaaatttcaaatttaaaggatgcatgacacagtt

SEQ ID NO: 1752 - DNA, 2304 bp, Homo sapiens
ctgctgaccctgggttcccccaaattctacctcccagggtcagaagaaggtacggccaattctcctcctgccttttctggcccccagggagatgccaggcccctctgctcccagtctcaaggggccatgatggtggctgagcctggggggcctactccttcctctggccaagcaaaacccctgcatggctggagcggggggactctcactcttgccttctgggctgtggacatgtgtgtattttgcctgatgctccctgtcacctccctccctgggtgctgtactcgcctgtcttctgctgggtgtgttgctccagagccctcagacgctctccctcatacaggcaggtctgggcttctcctgccactcagggaaggacactgccacatcctgtgggtttatatcatgttacctcttcatccagcctcaagaccctctgtgtagggggctgggaataacgggaactgtgtttaacatgacccaattttcaggctggtgacgagttcacgggtgtctcagcaaagttggacacaagctagagagagctctctcctcccagccaaaacctgggaattccccactgcagctcctcaggggccctggacagtagctgtgaccaggctggtgaaaggcccgtccctcccatccagggctttcaaagaagtgggtagaatcacggccatcaagtaaacgccactgcggatgacagaggcctagctgaggaggctagggccatgtcctcccagctggcagagtctggacagagcctctggtggcctctgccctgtcatagcctaagctgctgcagccactgtgagaggccacagaggggaaggggaccctgacgccgggcgctgccgcctgggggagcatggcacgattgctcttagtgttgaactttctgttttgtctcttgcccgtccggttttagttcctgaaattaaagaagtggtgagccacaagtacaagacaccaatggtgagtgtgccgctcaaccctgatgggccacggtgcgcagggctccctgggggaccttcggacaggaggaggggagggccctctgagcgcacaggggtgagtggggacctcgttttgttgccaaaggttcaactcaggctgaaacaggtcttgagccctgagagacagacacacacacacggatcccctctcccatggggacagcttccttgcttggagctcacgtttagcccagaggcccatgcccagtgttagggcaggagttgcccattggcagatccttcacatatggagatggaggagtctcagtatcgtgatccgcctggttttctctcctctaggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactcc

SEQ ID NO: 1753 - DNA, 2413 bp, Homo sapiens
acggtcggggcccctcggggaccagcccttcgcggggctgctgccaaaaaacctcagtcgggaggagctggttgatgcgctgcgggcagccgtggtggaccggaaaggtgaggggtgagaggcacggccgcacaaggaccgggaggagactgcctcggcgtgcagttgggctctccattgaagccacgggatcagccctgcttctgcctcccactagcagcatgagctgggacgagccacctaatttgcaccctctccccgcttttaaccctactgccatgatgcagtagggttaagagtggggagaagatgcaaataactaccgagccttgcacatagccggcgctcagttacgggagttgctatactagattattgtttattggccgcggtggctcacgcctgtaatcccggcactttagggtgctgacgcgggcggatcacctgaggtcaggagttcgagactagcctggccaacatggtgaaaccccgtctctactaaaaacacaaaaattagccaggtgtggcggcgtccgcctgtaatcccagctactcgggaggctgaggcaggagagtcacttgaacccggatagcagaggttgcagtgagccgacatcgtgctactgcgctccagcctgggatgacagagcaagactcagtctaaataaataaataaataaataatgattatttatcgacggacaaaacacaggctttggagtcagacatacctaggctctgtgatcagcttgctgtgcggctttaggaaaataactgaatttctctgaaccccactctctattcagtgatttattccttttctcaactatttcttgaacatatgctatgttccaggcactgttctaggcaggctatacagtgctgaaaaagatagatatggtttctgctctcaggggagaaatggatttctctctaacgggagaaatggatgtcagaaaataaatgaacaagttactagtggtaagtgctatgcataaactaaaacagggtgttatgatggtgaggaactgcaggaggaaggcagacattagattggagattcagacctctccgtgatgtgacatttgagccaagatgatagggagtcagacctgggaaatttggggacaggaaacagcaagtgccgaggctctgaggtggcagaggaacagaaagaagttgaatttggtgtggggtagttaactcatgtctgagagtcatgatggggacatgtgctaagatgcgtgagaaagtgctctggaaactctttagtgctgcataaagggttaccgttgcttttgctgatgttcgtgtgatgtatgtttcaggacctctagtgacgttgaacaagccacagggtctaccagtgacaggtatgggccggggatgtgggaagggaatgcagcggaagggggtttcgtgactgagggagggaaaagtgaaggcatgaagctttggcctcttgtaatttttctttcttactttccaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcgtgagtccgggtctgggaagaggaggggtgcttctagatatagtacccctacagagaggagtcaggggtatggatttgggatggctggctctcctgtcccctaaaacaggcaagtgaccactgcctatactgtggccctgcccggagtctattgggagcagggagggtctgggtatagctcccagacctgtgtaaggcttgttcactcttggctggcaccacagacagttccagcgaaggccccatcccgaaaggacatcctggaaggtgtcaagaagactctcagtcactttcgtgtggtagccacaggctctggctgtgccctggtccagccgcagccactgacaggtaggtctggcaccctagccagcctttaaaactgcacttgatttgggaggctgaggcaggtggatcacgaggtcaggagttcaagaccagtctggccaagatggtgaaaccctgtttcaactaaaaactacaaaaattagctgggcacggtggcaggcgcctgtaaaaccagctactcgggaggctgaggcaggagaatcgcttgaacctgggaggcagaagttgcaatgagccaagatcatgccactgcactccagtctaggtgatagaggagacttcatct

SEQ ID NO: 1754 - DNA, 2393 bp, Homo sapiens
attttcatccctgctcagtctcctcaggggcttgggagccaccgggctcagcatattgtgctgtgctgcacagtcctgctgcccgcttgggggtggacccagagccctgcaccccctgagctgccccctctggttgccttgtagagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcaggtacaacccagccctgtgaaggcagcacaggtgggagggtagagaggtaatcatcatttgccaaggccctgccatgtgccaggaacagtgctcggtgctttcagagaccgaaactggctttcttagtcattcttcaggagaggaattacctgtttttacagttaaactgagactaggaagagttatggcccgaggtcaccatgaggtcagtggcatggtcaaggttcccattttgtaaggtctcctgaatgaggtccctgcctctcttgcacctcaccctggatcattgcaagaccttcccagctaacccacgcccctctgcagcccgccttcctcatgacctaatgtcttaaacaccacttgccttcaggggagatgtgagtggttgagtaatatgtattcagcactgctgctgacacctccctcagagctcccagcaaccctgggagggagagccacgttatcctccttctacagatgaggaaatggaggcccaagatgtgcacgcacttgcccaaggcctcgcagggaataatgggcacttgaacctgaccccagagccacacactccgccacagtggacagctgtcactgtgtatttagactgttgatggtgtctgagtacagcacctcaatatagtggactgattctacgctcatctgatttgttaccatggactcagtttatagaacgtcatttcccagcaagaacaacatcagcaccttaggatgattctgttgcgcaggactaccctgtgcactgtggggtattcagcgcctgaggttccagccagtaggctcccttccccatgcaactgtcacgagaagggaaccccaacctccatttgttaggcggcctagttgatagccaccattataaagatgtgttatgactacacagcagggtacgtcctacaggcaggctggggccctttggaactgctcactgttccctagtcacaccaaggacttttcagtcattaggatgagcagatatctgcccctagagctataggaagtcttccctgtaggttctcaaattttggggtgcattagaatgagtctgtagagtcagacatacataagtacgtatgtgacatcttatgaacaatgtgagggatctttgaggaccgatttgaccgtgcaccattttagagccctgtctcaaggtccatgctgaagcatggcgcgctggccctttttgcctgtctgctgtgatctgagccactctagcccctgttccttgtctgcagctttgcctctggctgtgtggcgctgcctgtgttgatgaacatcaaggctgtgattgagcagcggcagtgcgctggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaatccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttg

SEQ ID NO: 1755 - DNA, 2343 bp, Homo sapiens
acctctgcaaccctccctatagcaagatgggtcaaagcctgatccctacccccgaaaatgggtgtcaagtgtctccgtcaaggacagacttaagactcacccgaaagaaaacgagacttctggtaaagccctagagtcctgatctggcatcaccggctttgctctatttgctttgaggaagccatccttccctggtcgtcttcactgcatctgctctgtgtacagaatccttctcattctaatccaccttggtggcagtaagtgcttagataagcaaacttggctcatcaataccatgaggttctttggtgggtgaagagatgtttccttttcccaggtccccttacttcctctccattcccccactaaactcccatcttctctctgtacttctctcaccttgtactcctgcaccacctcctccaatggcaccacgctgtgctgtttgtggctcctggattctcggcacaccacacagatggcctcttcgtctacctcgcagaagagcttcagggcttcttggtgtttgggacagatgccctgatcggtcacgcggctccctcgaccaggggttgggtgcatctgccgaatcacctggaccatattggccagctgcaggttggggcggaagctccgccgaggaaagctctttcggcactgagggcatgtgaagcacctccgaggggctggaggcgggggcagtggggtgacggggtctagatcctcttcctcaacctcctccagcacttcctcctcgtcctcctcatcctcccccctcaggtcctcctcctccatgtcccccaagtagtagtccaggtcttcctcctcgtcctcctcctcccacacatagtccatgttgtcccagctggacctgctcatgccactggtccagaacacaccctcttcttcctcctcgacctcctcctccatgtcaccctcgtagtcttcatcccgcatgggggtgtcccaccccgcgccagcccccacagcctccacttcctcctcctctccgtcctcctcctcctcctcccgatctaactcatctctgtcctcctcatcctccccaccccacaactgggttacacaaactcggcagaagttgtgcccgcagccgatggacacggggtccgtgaagtaatcgaggcagatggcgcacaccgcctcctcctgaagggtctgcacagggttgggtgtcatggcaacggcagccatcttagtgtccagccagccagtgtagaggttcggtgggggggcgaggggcgggggtcttccctaccgacgccctggcgacccggctccacccccagccctgcccctccacacctcgccccaagagcagccagagagatgtcctgccgacaacccaccccaacacagtgttccctactcccaaacgacaaccgtgtctctacgaggggaggggacagtgctgggcgccaccgccaagtccctcaggtggctctgagtacaagtctgccccaatgctcccttggactcctcataaacccccgcccctcctcacttcctggccccgcccctagcttccggcctccttcccaacacttccggcgtctacacaccacctaagctcgcgacttccctccgctgtcctgctactccccctttttccccgcggggccccagggcgacaggaaatggcgaggagacgctctagtccgcactagagaacagggcgggagggctaggacggtggaggcccgcgtctctgtggtaagaggccgcggggaacgcagaaagaacagaggaaccgcctacccccatcccccgccgctggggagaaacttcggggggtagggggagcgcctggcggccgtctgctttcggtgctatcaccgcatcggccagacgccatcctaccctcccggcacagccgactgcagccggtactccccacagccgatgccggaagcgagggggtgggtccgcggcgcgccctgaagtacttccggcccttctaggcagacgacttcgttgtggaggactcagagggtcgtccgggtcggaccgggggcggggcctgagaaagcgcttcgcgggttagggcagcagacgccccacccttccccaactgtagtcggcgtttcgcatccgaggtagaaactgccaaccggacactgtctcatggtttagatgaacttccctaactgcccagcagtgaagaagtggtgacgaatcattccatctacattctcacagcatctctgcaaaaatagatgctttgtgcggtagaaataatacttgatgcttaaatagctctttaaattttatttttatagagatttgatgtcgatacataaataaataaatgttgtttgatgcgag

SEQ ID NO: 1756 - DNA, 2532 bp, Homo sapiens
agttgttacttaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggacgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaatttaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttccttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgctgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctcag

SEQ ID NO: 1757 - DNA, 1935 bp, Homo sapiens
aacccggggctccgagccggagccgagtctgcgcctgggggcccttatctccagaggccagagcttccatccacccaggcagcctggtgatctgtcctcactgccccctccccacgcccaccctactgggccatgaaggggatgggggcaagcccagctgactgctccaccctctgcccaggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacctcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcatatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacgtgaggcctcatgcccctgtcactttccacgctgggtcacaacacacagataccaggccctgatccctcttccacttgcccagcccagcccgttctgcttgttcccaaccccgtgccaccaaccagctcccaaaaacccctgtgtgcacttcccttgggctccctgccaccttccccctgagagaggccaccctcaggtgtgcaacacctggagaaacacccagggaagagagagagcctgcatttagtcctgatctcagagaagtccccttccctcacccctcagtctaactgaaaaaatggaaaggttcaactag

SEQ ID NO: 1758 - DNA, 2348 bp, Homo sapiens
gtgctcctgggcctggcggttgagcccggggagctagtctttgcttgggtaaagaaagaggactttccttttttttttttccttttgagaaaattcagaaatttggaggcacggtagttaggattcaggccaaactggtaaatgacgaaggggctccttccagagccaaggaggaagggttgtccgggtaagtcccgcgggacgtggagagacggcgccgcccgggtcctcccactgattcctttgaccatctggcttacggacgagctctttgttcgctgctcctccgaaaacgccttcaatgactccctttgaataaagtaggaagtccgaaccgagccgccaggccgcgacttggcccctgttttccactcgcgagggccctgcgtcaccccgcctcgggaaagctgcgcgttctccggccgcttgcgcttggccgaagctgctgggtcccgctgtgcttcccccgggcatgcgatggggataattcccacgcctcgctcaaagccatcccgggagagccctccctggtccccataggcacagttgggtgttcccttttccgtgttaaccttgtatttcggatatagttctgttatagtaattactttaaggtattgtagttatttacaatcagtctttcccccacggtaacctagagtgtaaaccccctaaataaacgtcagaagtaatgaagtcttaacttccttggcttaggtttcagcgcccttctcaaccccacactcccgcttcagtctttacacaacccttcccatgaatatgctgacctaacaagtaacctacttttcatactccaaaatcttctcttctgtgtggggaaaataatgcattgactgccacctcactccacctccaaataaattgatgttgaaattctggcctccggtaatggaattctttacatcaaagtcactttttatttctaaaagtaatcacatatatattatattcctactgtggcccttgccatggatcaacgaaaaatatgacatagtcaaaatagaccaaaacatctggccttgttgtaaccaatgggaaacacggttgggaggtccctacttacatgtcacttgcttcaggaaccgttccttgattcctaagtgggggaccttttttcctaaatacaactatagcttgctttcttacctcttaagccctttttatctgcagtctcacttaccctactaaggtctttaaatgcagggcttgatcttccattattgtatctccagcacctataaagctttcctgttaaatagtagacatttaataagtatttattgataaacgtgaagtatgcctcaacgtttaggctaaattcatatgaaaataaaattgaaaaaataattttaaagaacagcattagttactgagattatgtggtaaatcccttaaaatataatcttgcattgaaatagttttcaccatttaccagtctttatatgaatatatactcatctaaatggaaattgggaaatttaagcattttctgcttttccgaagtaaattttctaatgtttttcttaaagctgaactaaattgcaaaacttgctttaataaagtgtgtatttttgcatcagttaagcccctgacctctttatgttctttaaatttgattcattagtgaaattaacaaggttctgtgtttttctcacctcattcagttttataattaaccaataaaagcttattagcttttaaggaagttttaggaacttaaattgatttatgggcaccatatggttacatcaaaggacttgtttttgttttaactggaagtggattcttaagtcctttaagatggaaatttatgttctttctattataccaagcaatgctttctgaaatagagtgatttttttttattccatgctaccagttggtcatgcaattcaaatattaaatactagattacagatattagaatcttgtaatgcatctggtttaatacctgtcattttgtagaacggttaaatgtcttcccaaggtcatacacctaatcagtggtatattcaaaacccaaatcctaggcttcctatctgaagtccattgcttatgaagtggtttgctatgtgttctgactttgttgattcaaataagtaagctaaatcaatttaagccattaataggtttataaagttatttgctatgtgttgttcttacatcattgattcatgtaagtagacttgtgtgacagctaattcttaaaaaattatgaagatgttagacttcttttgatatatatatgttgattgtatgaacagattgacatcaatatacttattcattataaaagatttgagtgggaactcaccaaatcccacacc

SEQ ID NO: 1759 - DNA, 2773 bp, Homo sapiens
acttcaacattaattaacataaaattcttgacaagataatgaagtttctttttcttgtcacaccgagtctttgaaatgagctgcgtgggtcacgtacagtgggtggctcgcacctctaatcccggcactttgggaggccaaggcgggcggatcgcctgaggttagatattcaaaaccggcctgggcaacgtggtgggatcccatctctactaaaaatacaaaaaaaaaaaagttagccaggcatggtggcggtcacctgtggtcccagctactcgggaggctgaggcgggagaaccgcttgatcccatgaggcagaggttgtagtgagccgagattgcgtccttgcattccagcctgggcaacaagagcgaaactccatctcaaaaaaaaaaaagaaatgagtggtgtatttttcaggtgcccaggtctctaatcagagccccatttcaagtactcagtagtcccttggccatgtcaccccccccgacatggacagtgcaggtccagtgggctccccactgactgcaggcagggaacaaggcagaccctagagggccaggccacagtaggggctgaggatgtctggtgaatggatgcctgggagaatggatgctagaattcacacacgaggccatgaacagggctgggaaaacttccaaactcagggaagcacgtgtcttggtgcaccttgtgatgcttcaacagcaggactgagatggggacatttacaatgaacagaaatgtatgggctcgagttctggactctgggaagtcccctgtcaatgcaccagcaactttccagggcctgcgagctgcacagtcacgtgggggtgaaggttgttgccagaagctcaggggatgctccagacagagtggcctgggatgtcgagtcactgctgctccgtgacatgggggcaagaggaagcagtttagtctgacatactgcccccccagctagagggcaagagacagaaaggggggctgaagtcgcccttgaataaccacagcagtggcacccacaaaggtgcagttcccacagcctcatagctgcttgtaggtgccacctcttaaggccattaccatagcaattaatactgaacatgagctttggagcagacaaacactcaaaccgaacagggggatggaggaaaggagcttcaatggcaagatctcctggactcctgtcctggcccctcctccccctgccccacccctgctctcctcctgctccccctctcagagcttgccctgaccctgctcctctcccaggtgtattccgaacttaagtaccacccagagatgagattcttccactggttcagcaagtggaggaagctgcatcgtgaccaggagtatgaggtcacctggtacatatcctggagcccctgcacaaagtgtacaagggatatggccacgttcctggccgaggacccgaaggttaccctgaccatctttgttgcccgcctctactacttctgggacccagattaccaggaggcgcttcgcagcctgtgtcagaaaagagacggtccgcgtgccaccatgaagatcatgaattatgacgaatttcagcactgttggagcaagttcgtgtacagccaaagagagctatttgagccttggaataatctgcctaaatattatatattactgcacatcatgctgggggagattctcaggtgagggtctccctccaggctcatcgcctcgctcctctcacctcctgctcatcctcttgaggcctcccctctgttccagaccaggtcctctcctggccaggccctcctgccttccctcctgccccctgcctgccctcgtggttacactccctcacccacactcctcgtgctccctccacctccctgcctcccacctgctttcctgggcccttcctgtgagtgagaggccccttctgcctccagagcaacctccatccacccccacagcctgggagccccaacctggccccttccatctccctggcataaccgaatttgtcgtaaaactggacgtagtaagtgggcatgaatagtcacaagcccggcagtcagaagctttgagcaacatccttaaaggccaacctgagcccctgagaaggagctgcctccatggaaacagagcttcaggcttcggctgccatagaagatggccgggctgggtgcccacagggcaggcatttattttctcacacatctggaggctgcaagtccaaggtggaggggtgggcggggttgtgtcttctgcagtcgctcctcctggctggcagggggtcccttccggccctgtcctctctggcctttcctctgtgcacctgcactcgtggggtctctctgcctccaaatgtcctcctcgtttatggaccccagtcatgtgaatttgggcccacactgaaggtctcatttaagttaatcatctgatgaaaggacctgtctccaggccaggtgcagaggctcatgcctgtaatcccagcactttgggagtccaaggcgggtggatcacctgaggtcaggagttcgacaccagcctggccaacatgttaaaaccccatctctaccaaaaatacaaaaattagccgggagtggtggtgggcgcctataattctagctactcggaaggctggggcaggagaatcgcttgaacccgggaggcggaggttgcggtgagcccagactgcgccgctgcactccagcctgggcaaaaaagcgaaacttcttctcaaacaaacaaacaagaaagaaaggacctgtttccaaatacagccaccctttgaggg

SEQ ID NO: 1760 - DNA, 1637 bp, Homo sapiens
aaaaaaaaaaaagctctgggagacgagcccagcactggaagtcgccggggtcttccattcggtgatcatcactgaacacagaggactcaccatggagtttgggctgagctgggttttcctcgttgctcttttaagaggtgtccagtgtcaggtgcagctggtgcagtctgggggaggcgtggtccagccggggacgtccctgaaactctcctgttcagcctctggattcaccttcagaggctgtgttgtacactgggtccgccagcctccgggcaaggggctggaatgggtggcagctatgtcatttgacggaggcgaagaacacttcgcagactccgtgaagggccgtttcgccttctccagagacaatcccaggaacaccctgtatctgcaatttaacgacgtgcgacgtgaagacacggctgtatattactgtgcgcgagtctcggaacatacggccccgactctcttcgatctctggggccgtggaaccctggtgactgtctccacagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagtgcgacggccggcaagccccggctccccgggctctcgcggtcgcacgaggatgcttggcacgtaccccgtgtacatacttcccgggcgcccagcatggaaataaagcacccagcgctgccctgggcccctgc

SEQ ID NO: 1761 - DNA, 2047 bp, Homo sapiens
gttcatgtgtcttaattcttgattcagaaaagctatcaactgtattctccatatctcaaagttaacgtgtccaaaataaaatgtctcatcttctcatgccatctagttcttcccgcagtgctcccatcttgtgaatggggatggcctcctaccatgggttggggccccaaaccttgaggccgccctgctcctccttttccctcccctcatcttcagtggcttggtacatcccatcaagagatatcggaatccctgcacgctgccagggtccttctgctggtgccctccgaccatcaactggaagagtgaagtcgcccccagtagtctctcttcttctgcacttgctccttacagtcctctcaacacagggaccagggtaccccctttctaggtgtaaataagtctgctctgcactcaaagctgaagacagcacgtagacccctcgggcggtgtcctacctgaactccaagttctcaccatggcctgtggacagccccatgggcacacccacctcgtctgtcttctctaccccttgctcaactccacgcagcccatcccccttcccagaacgtgcttggcagctccgacctcacacccatgtttcggccgggaacgttcacctgccattgtctgtgtgactcagtcctctcctcgtgcaggtctttactcaacgtcatttcacagagacccttcaggaccagcaaagccctccctgccgccccacccagcactccccacctccctcctctgcttagtttgtttcatgggagtcacctggtgtatttcatattatattcttctgctttcttgtctgtctcgtgcatctggacctctgcacaaaggatgggttttgtctctttggctgactgcagtgtcctaagacacttagtgcctagtagctctagtaactgtttgttgaatgaatgaatgagtgaatggatgcatagtcactaaatcagaaatcgtggatactgtaatcatagaacattaggtcataaataccaaggatcctgaggaagaagaagaaagaatatctatgatttggacagccatttttccaattgtggaacattgtttagcatttcaaataatgaaaataaacacatatagaaggcttactatgttctgggcattgttctgttttatacatattaactcgtttaatctgtgcaatgcacgtaggagtttatggagtttcctcataccttatctcattcagttcccaaaataataccagcagattgtgggtgattacaacattttcaaggattcttccccagggcagctgcttgtgggagagctgaggtctagaaaggaggagttgagagcaggaaaggaaccaagcctgaccccacccccatgccagcattttgatttatggaaccctgggagaagagtttctccaaaatgatacttcatggcctccagcagatccccctcaaagaaaccaacctgggaatgaccctctgtgtggagatcaaggaggaaagaggcaagtgagcctttcttttctcctgctcgtggacttagagtaagagtgtctgggacatccaggtatatactatttccatttttccttttgacatcttcgatgatcaagatacctgctaaggatttgttcagaaatcagaattagttgtaaggcagttgcctgaacaactgaaagcgtaatgaccccacagagagcactaaggcaacagaaagtacggcgaggtgggattattaggttggtgcaaaagtaattgtggtttttgccaatacttttaatggcaaagtttttttaaaaagtatttttagtagaggcagggtttagccatgttgatcaggctggtcttgaactcctgacctcaggtgatccgcctgtcttggcctcccaaaattctgggattacaggcatgagccaccatgcccagcttttttttaaatttccattacttttaatggcaaaaactgcaaattactttcacaccaaattaataggatatttgatgagttttaatataattatcgtttttaccacaattgaccttcccctactcttaccctc

SEQ ID NO: 1762 - DNA, 1968 bp, Homo sapiens
agagacctggctggcctccagaggggccaccagagatgggcctgtctcctttgcactgggggagaacctagagaaacgcctgtgtgcccagggtcctggcctccctcgccgatgcctgctttcacacccctaggcctggctggctcacactgcattcattccctggcagagacgggctggatcagaaggcttcggagatcagcagaggctctggagttggaaatgtgggcagcaacgggcatgctgacgtcagtgacccagtttgtcaaggccctgtcaatggtgtacctaacgtgcaggctaatcctgtgtcaagccaaccccgacacctgcaaccaagcacgcctgcacctgtccccaagactcagcaggcacacacagctctctccacagagcactccttggctttcctgggtttctttttaacagccctaatttcaagcgggggtgtgtgtgtgtgtgtgtgtgtgtgtgtgtttttcccccttttaatatttttgtgctatttatagtcaccagttaatcagggtgggtaaaagtactgaagatgagaagcggcgtgggctggcttaggggcaggcatgctctagaagggaagaaagcctcttttctccaaccatccataagaaagtcaatcaaccaataagccggccatgtgctcagtgcagggcaagaaactaggaagggcaagaaagtttaaggatgacaggcagatctgggtacagagcctgggccagctgtttgacactggccaagtcagtgaacctctctgagcttcgctttgaaagcctccttattgtaaatgggggttctactaaaagccacttcataggattccagggagggttagcagtaatgtatgtcagctcccagcagagcacctgatgtgtgattggagcttaatgaacactggtgattataataactggtcctgcctggctccttcccttaagaggcttgtaattaattgagctagaaagagcagaaggcacgtgagtgccaagggggtggtgaggtcttcagaagagttcagggtgggtgccggctcagccagggatgcaggagaccagtacttctcaatctagaatgtgcacacgaaccaccagggattggttaaaaatgcaggctccaatatgtctccgccagagatcctggctcagtcagaaagggtggtcccacagtgttgcccacgtggttctcacttagccagcagggccccaggctgcacattaatgattgggaaccaatgaattaggtgatgctgacctacagaatgatttaacctaagtaatagcgtgatcgaattaacgttttagaaagtgaaatctgagagtcctatagagctgtgcttctcaaactgcaatgggtctgggaatctcctggggacctggttaaaatgcaggtttggagctagcaggtctggattggggcctgagactctgcatttccgataagctcgcaggcgatgccggtgctgctggtccaagaactacaccagaagaatatctcatgtcctatattccatttgtttgcatttctcttcttttcttggcacagtgtgattctggggctgttcctgctcttttctctgtgggctaactaatggaatgccagcgcttctccttgagaatgcagcgagtggaaagcaatctcaaaacggtcaggttcggtggctcaagcctgtaatcccagcactgtgggaggctgaggtgggcagatcacctgaagtcaggagctcaagaccagcctggccaacatggtgaaaccccgtctctattaaaaatacaaaaattagccaggtgtggtggcaggcacctgtaattccagctacttgggaggctgaggcagaagaatcacttgaacctgggagatggaggttgcagtgagccgagattgtgccaccacactccagcctgggcgacaagagcaaaactccatctcaaataaataaataaaataaaaatctgt

SEQ ID NO: 1763 - DNA, 2408 bp, Homo sapiens
gtctatttttggccactccatgggaggtcatggagctctgatctgtgctttgaaaaatcctggaaaatacaaatctgtgtcagcatttgctccaatttgcaaccctgtactctgtccctggggcaaaaaagcctttagtggatatttgggaacagatcaaagtaaatggaaggcttatgatgctacccaccttgtgaaatcctatccaggatctcagctggacatactaattgatcaagggaaagatgaccagtttcttttagatggacagttactccctgataacttcatagctgcctgtacagaaaagaaaatccccgttgtttttcgattgcaagaggcaagtattaggaaactttagcttgatctagataatgtaactatgaaaaattaggattctgtgatattttcttaactttattttagaatataaaatgctacttctagtaagtttttaattatattcagacacttgaagtgaaaacctgcctataaaattaattatatctaacactaaatttgatagaaataggaaagcttttggcagtgaaaaatattgttttccatcaaaccagtaaataacaagatttttaatgcttgaatgatgattaatcttcagcattagcagatacttctttctttacacatggacctttgctgcagtagaataaaaaggacaaacttctacctaaattactccttattttatgtatatattttagcctcagaagttaagtattatttatcacacatgtgctttatattatttgactttcatattaatctattcattgtgctacttgatatttctagttgtttaagaataattactgaatcccaatgggcttgcaagttttttttaactaaaatatttttgaccgtccactactcacctaactctatatatgctaccatagtcctaattaaggaagttctgcttttatttttaagaaaaattcataagcttcagaatataatttaaaatattttagagtgaaaaatgagcactgaaaattatacatggtcatgatttttaaataaatttttatccatgtttaaggataatgtgtcaggcacattgatctaaaatgtaattacaatggtaaatgttcaaatctagatcagtgtgtaatgtggtacattagtttgtaaaatgctttcacagcattaactcattgttaattcttataccgccaaatgagatatcatttctttcctatccatctgttttacaaatgaggagacaggctcagagaagtaacctacttatctaaggccacatagctagtaagtggtggaaccagaactggaactaaggccatttaactgcaaatactgacctcctgtcatttatcaagccattttcagacggcatgatgttctcctgaggagcaaaggaatggaattagagctagcacaaggagaaattgtgcatagcttgctgcctacgtaacttatgcagaagatctgagcagtcttcctgtttttagggatattttgcacatgtgaactatatagtgagaaaatgtcaaaaactaatacatgatatactgtttgtctcttagtgtccatccttgagtaatagaattttgttttagatttatttgaacatttaccatcacaattaaattttaggtcaacaaccagccttgagaaatccaaataccaatttgactataaatatagtaatacgtttaactgcaataactatagctataagtgcgtaccaaaccatgttttttccaaatgaccttaatttcttggcactacccatgttggatacctcatttgcttccccaaagactgtgcccaaaatttctgttgttcctacaatgattctgcctgccaacaaagtctgaaaatctctcaagtttgttataaaaacagcacagttagaacatgatgacattcctggagggaaaaataagtccacttatttgtttctaaaatgcctgtatcccaagcaactagaacacatagttggctatacttaatgaggagtcaagacaaaccattcaattcttctaaaaaagtaagaaagtattcaaagcaccagagtcacaatgttgagctcaggtgcaattttctattcactttacttccagcatggtcgggttaagagtggactacatagcttgaagcggatttcgttgagattcgttgtaattgaatcaacaactgaatgagcatgcctaagtagtggctccagagagtctgctttcagattttcttgccagctttgacccaagattaccctgggtctgcgagttttatcacctgctttatcatttgattacaagtatagtataactgtatttccttgtgggatagaagctgtaaaataagctgaaaataataggggatatatataaataaacgatctgagaaagaataaagaaaataattac

SEQ ID NO: 1764 - DNA, 2517 bp, Homo sapiens
agtaatatggtatcaactattcttcattgctactcattagattctaggcactattctaatatttcacatcaggacttttcaacagcagcactatgacattttttctagataattctttgcggttggagggggctacaggatataggatgtttaggagcatccctcacttcaacccactggaggccagtagggtcccttcctgccccaatcgcttgtaccaaccaggatgtcaaccagatattgccaaagctcccctgtgggtggggttggggacagaattgcccctgatgagaggcgctgcctcacgtgagctctgtcatttaatcttcacaattctccgaggtgggtcctattactagtcctggtttacagatgaggaaactgaggcacagggaggtaaatatttgccccgataatgctgcactaaaaatgcttctgaaaaagggaagctcgtaaacaattgtcatcgagggtctggaagagagcgctgatgtaattaaggagggtgtctcaggctgagtatgaggaaaccctattgctaaccctctgttgttacctcccatccctcggtcctctcgtctgtgctgtgggagtggggagcggcaggtctttcatgctccttctgctagtggaattcctgctttctagcatcccttcatttcatcactgggtgcttgtttgctcaggattatgcctcatcttcgtaagtcggacatgatcctggcgcttcagacactcagctttgcaactccctcaaaatgggagccacaggcatgtcgggggttgagctttatcctgcccagcccctcgctcagtgggggtgaacagagtgagaggcaggacttgaaagtatttgcccagaatcatacagcaagatagcatcatgtgcaagaggcagccatgtgtactccgagtccacactgccattcttgttggcctttgcaggccggcctcctgaaaaacttgtctctgctcacttcttcagtctcttctccttctgtcttcccttcaacctactctaatcagaagatagagacagaagtaagcagtgaactaggcaggaccaaaccaaaccaagagttgtgtgttgaccagccaatgaggaagttatgtgtgggagagaacatggtaaactatgtcttcttctcccccatgtctatgtctgtgtgtgtgcgtgcatgcgtgtgtgtgtgtgtgtgtgtggtggggggaggctggtattttatttattggacaaatatttattgtctagcactatgtgccaaataccaacttaagacatctataagaatttcaatttctctgagacccaggctaagattttccattaaattcacatgagtctattacatctctttctttcatttccacctgggtagtcaggaaaacacattagacatatttttaaaaattaaagttaacacagagtgttacaaactttgagagaagcaataattttgagttgcactagtaatcacagcaacaaccccaaataccacatttattgtctcttacaaagcatcataagttacattaatcactggttttaactacattctgttacagtttggactctagtaactaggcaaatacaaaccaacaaaacagcatataaaaccacatggaacaaaaagcacactactctccaatatgcattttctggagccaatctgatatttaactgggataagacattctaaatagcaactgaaatattgatataccagaacatcatgaaataaatatttttcccaactctgaagacattcctttcctcatgcaaaatttaccaaaaagaaaaaaaaaaaaggaaaaaacaaaaaataaacaaaaaaccaggctgggcatggtggctcacacctgtaatcccagcttgggaggccgaggtgggtggatcacccgaggtcaggagtttgagaccagcctggccaacatggtgaaaccttatttctactaaaaatacaaaaatttgctggatgtggtggtgcatgcctgtaatcccagctacttgggtggctgaggcaggagaatcgcttgaacccaggaggcggaggttgcactgagccgagattgcaccattgcactccagcctgggtgacaagaccaaaactacgtctcaaaaaaaaaaaaaaaaaaaaaaaagaaaaccctacaaaaccaacccaagttcatagtaaccagaattttcaaatatttctctgtgatcagcacctaaaaatgtattttaaaatgcttattttaatggccaggcacagtggctcaggcctgtaattctagctgggaggcagaggcgggtggatcacctgaggtcaagagttcaagaccagcctggccaacatagtgaaatcccatttctagtaaaaatacaaaaattaggcatcgtagtgtggacctgtagtttcagctacttgggaggctgaggcaggagaatcgcttgaatctgggaggcagaggttggagttagccaagatggcaccattgcactccagcctgggtgacagagcgagactccgtctc

SEQ ID NO: 1765 - DNA, 2716 bp, Homo sapiens
agtgtgcgaggcagcgtgaagctggggcctgctccccgcagcctctggagcgcatcacagaccttctgagacctatgttgctggccccccagaacccgcaacatggcagatggggcaaaggccaaccccaaagggttcaaaaagtaggtgctggatagatgcttctctgggtggaggggcccacgcttcggggcctcctgtccttcaagaacctccaggtctagcctgggtatgaagaagttcttcaccgtggccatccttgctggcagcgttctgtccacagctcacggcagcctgctcaacctgaaggccatggtggaggccgtcacagggaggagcgccatcctgtccttcgtgggctacggttgctactgtgggctggggggccgtggccagcccaaggatgaggtggactggtgctgccacgcccacgactgctgctaccaggaactctttgaccaaggctgtcacccctatgtggaccactatgatcacaccatcgagaacaacactgagatagtctgcagtgacctcaacaagacagagtgtgacaagcagacatgcatgtgtgacaagaacatggttctgtgcctcatgaaccagacgtaccgagaggagtaccgtggcttcctcaatgtctactgccagggccccacgcccaactgcagcatctatggaccgccccctgaggaggtcacctgcagtcaccaatccccagcgccccccgcccctccctagagcctctgaggtttgagagagagagcgggaggagggtctggcttggggaccagacgaggtgcagggagggtaggagccaggccaggagcctgagggttgctggttgcctcctccctggagctctccagtgagggctcagctctcagaggactcaggaaggcctgggtcctgactcccccagcccagccccaggcatgggtgcctcctgctgctggttctggactgggtgggaggcacggagcttataggggtctctcctgagggtggccggggagacctgagagagaggaggaggggcctctgagtggggcctctgttgctggcgccagtttaactccccggagccttagaaagtctgagccttagaaagtctgggcctgagcatccaggcccagagctggatgcatcctcggcccaagatcacaggaaggcagattgctggtcacaaagcatgggttccgggagcccctcagctgatcccacaggatggcctggggtggtggctactttgggcttgaagctctctagagccccattcacagagcaggtgccccaccccagccctcactgaggtggccatgagtccaggttcagaccctaggggatgtgcagtgctgagtgtcccagccctgaagtctagcctcagagcaggctcctgggcactgacagagccacacacccaggtacaccccccaggctaatatggggacacacaaaaatatggccttcaacacctacaagtcttctctgtgtcccccatcgacccatgcacatcaccccaaccctgctctgccacaccacgtgggtctgaggagcactcctaccccccggctccgggtccctgacagacactgccctcctggcctgcacctggaatggcagccagaacactggagggggacccacaccctctctccctgggctgtggatgggtgttgcaagtcccatccctcctggcctgcacctggaacagcagccagaacaccggagggggacccacaccctctctccctgggctgtgggcaggcgtcacaagtcccattggtggggaagaggctgagggctgagacccacctcagtgaagagggaaacgtaagcagggagagcatcaaggcgggaggcagcctggaaacttctagaagagggtcaaggtaggaggctacatggaagcttctagaaggcagtaaggaacagggtggtgaaggagaggggagaagatgggagcatggagagacgaggtgagtgacagccaccagcagggacgggcctccaggcaacacagaggagctgggggccagggccttacggggctgggttcctgtgtggggcgtggagctggggctgaagtggaggggacggccctgcggcccccagcactgttgtttctccaggtgcaccttaccttcctccttacctgcccgagcctcaactcagggtcagcagcctccacggagccagccccacctgcccgaaaaccactgaagccaccctccgcctggactcaacagccgccagcaagctcgcctggcagtgcccctggagcaccattgtcgctggggagggagagccgggaagggtggagaaggaggcagaagggacatgtatgaaaaaaggacaggaaacctgaccagaggcggtttccagagccccagccttggagacaaggacactgccacccagcgccacagtcagtctgggaggggcccacgccccccaccccccatgccacactgccgcctcttgctggccatggttctccggcttgggggaacgcaggttcccagctgcgcccctcccccgcgcacacacaccctcccctgtccctcggaaagactaggccagggtctggggatgggattctgctgccaggggtcctgcctgcccccactcaccccagacgcttcggatgctgcagctcctggataatctccacaggactcggcttcctctcctcaaatgaataaaggcctcctacctc

SEQ ID NO: 1766 - DNA, 2014 bp, Homo sapiens
ataaccaacaaggaactccggtgcaaagcgtgatggtttcctacccaacaatgtcttctcatcaggtgctcataagcagcttggaaaattgtgggttttaaagtagaatttgccaaagtggaagctgtgggtctgtccctggtttgggtggctggctgggtaatgcgtgcttggtccataactgttgataatttactttgaatcaagattataatagaaaagtagaaaatgcaaaatacatgcttctgtcactactgtggcttttgaatgctctcctaagtttatttccatataacttcatattcatggaagaaaatacattagtctacagttttattcataaagacctttggaaattttattgcattttgcttattggtagaaagtcctcatgacaaattcccattcatttttgtacacacccaaataaacttcatttttccataactttaagttataagagattttaatatggcatctcagattcatttaaagggcatttctggagcctagcaactacattctctggactaaacccaagttaagtattttaaaagtgttatgtatccttttgtgatgtatattctaaaataccccagaagtagaaataaagagttagtgaaatggtataataattaaatttaactgtaccaggtgcttctgaccctaaaggacctattctagggcccctaccctactattctgattcacattgcatcaacttctacctccacctccacaataagtgttctctaaagttgcaggttgagaatatagtaggtgcccaggacaaaagcccttttcactgtggaggactccaggccactttgcataaaatcagaaagggaacatggcttttcaaactgagagaaacccagagtggaagatctagactatagtttctagaggtcattgagagagaagggaaggaaactcagaactaacaccttctcagcatctactgcattccaggcagtgtgccaggcattgtacaccatcccttcaatcctttcaatggtactttgaagcatgtatgtcattatcgcaatggactagggaattagagaggttaagtgactttcctaatgtgaaacagccgataaatggcagagctggaattgatgacctgttaggtctaactcaaaagtttgaatatttttcatgacaccatgttgtttattgtacagaccaaaatagtctcttcatacagggttcttgcttgtgtctttttacaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgaccttatggaggaaggtcatgttttt

SEQ ID NO: 1767 - DNA, 2453 bp, Homo sapiens
tttgggacacttaagtgactttgaaatccatccaaaggttactctgttccttcactccacacagctcaggcatttccatgttggtctcagctgccatctcaatggtttattctttttacatgttggagcagatctggacctcccaaaatgttttgaggagaagtgggcttagaggggttttccctgctctgtgagagaaggaatttagcaaggattaatttttctaagaaggtggcacaagttttgatgtgatttgctggaaaatagtaatagtcacaatttatcttattcccccaagagaatgggatgatgttcccatggaaccttgctcatcctgctagcaataacttgtattctctttctgattcacacaaacaaggatcagagggtgatggtgggggaaatgataccaggaaatacagttcgttttttgcagggattcagaatgtgttgctggacttcaagataggaagaatctttgccttgatggctgatgacagtaaccaccccatctaccatcatctattaaggatttactgtgtggtcactttacagtcatccaagtaaattttcataatcacctgattacatgggtaccgcttttcagaaaaagaaacagatttctggagggtaagtaacccaaatcgtacagctgagccatctgtctgcatctcaagcattgaggcagcattcggcctccgagggtgttgtcaaatgtgctggtctctgttaactcagggttttggattaatgggtggagctgctcattttcacaaacacccaggatgcagtctgcaccctctatttaaagtgaggtccctggacgagcaacacggcagcacctggctgcttgtcagcaatgcagaacatcaggcactccctggagctacagcacaagatccccaggcaggcgcatgtgcatccaagtttgagccgcactgctttctgccactacggaggaatgtatcctttactctcttcctccccttcgtctcatcttgtttggtaattttaaattatttaaaagttatagaaaatcatagtgcctcaaaatggcttaccaagaaatactcaaagctgtaggatcagaagcttgacatgaagatttctgtgcatctttgaattgctttacagaaattaaagaaaaatccagacatctaaaagattataatttcagaattcatagtaacatggggatcttcttggtgtcagaactgagttcttgctgaggtttgcattgggccctgtctccgggcagctgcagcataacacggagtcacccttgctgtctaagccttgtggctggaggggaagagtgaggaccaagctgtcaacaatcccagacctgccaagccccatttgtctgtgtgcctgccaggattctaagactgcatttgggaattttgacttttactgaatgtgaaattctgtgtatatatagccttggtgagctgacccagtcagggatgactctgatgtacttttgtcttacaggattcagaatccatggctggaagaggtagtaaggccattgggagggcatgcctctcctcagcccacccccaccctgtgtgggtctccattctgaaatttccattcagatgacccggtcctaggcagggaccaaaattccttgtcagctgaggaagtcctgaagaaacatcctgaagatgatgactgcactgccatcgtgggcagatgcagcttccatctacctgagggctgaaggggaaaacctttcacacacgtgaggaaggcgcagctctgtggaaaggtcactagaatggcagcggcagcaaatagggctccaatgcacgtttgcagttaactgggtccaaggagagcatggccctccacagcaagtttgctctatagaataaagtcctgagcttgtttttatcacagttagacagagaatggtctcttgtttctcagttatccagggaagaacagtgtatattctctgtagatgagtgttgtctaatgtagtgattaatctctgctagtgttaggaaagctccactactgtgtgtgtgtgtgcgtgcatgcgcgtgcgcatgtgcacatactgcagtcttgactttccaattacaaaatgcctaagtcaggtcacattgtcttcttccagccagtttctaaggcaggcaatggaaacaggagccgatgccaaatggtctagaggcagaagggctgcatgctttgcagggccagccccaaggctgccttccagagctgcactttctctggggacagtaaactctcaccgcagctgccagccccctgtgcttggccatgcccctcacatggacttggaatcagtgtctctcttgctgatgagcacctccaggagcctcagtttcgcctttatgtgcttatattcactgtattcttcagccataggagtgcggtcttccttctggacatttctaatgcaaataaaggaaaaaggggtc

SEQ ID NO: 1768 - DNA, 2307 bp, Homo sapiens
acaggcatgtgccactacgcctggctaattttttcatttttattttttgtagagatggggtcttgctgtgttgcccaggttggtcttgaactcttggcctcaagcaatcctcctccagagcctcccaaagtgttgggattacaggcatgagccactgtgcctggccagaaattgttttgaaaggctaaccagtaaaacattaaccaatttacaagagaaaaacagccccatcaaaaagtgggcaaaagatacgaacagacacttctcaaaagaagacatttatgcggccaaaaaacatatgaaaaaaatctcatcatcactggtcattagagaaatgcaaatcaaaaccacaatgagataccatctcatgccagttagaatggcaatcattaaaaagtcaggaaacaacacatgctggcgaggctgtggagaaataggaacgcttttacactgttggtgggagtgtaaattagtgcagccattgtggaagacagtgtggcgattcctcaaggatctagaatcagaaataccatttgacctagcaatcccattactgtgtatatacccaaaggattatacatcattctgctataaagacacatgcacatgtatgtttattgcagcactattcacaatagcaaagacttggaactgacccaaatgctcatcagtgatagactggataaagaaaatgtggcacatatacaccatggaatactataaatatataaaaaaagatgagttcatgtcctttgcagggacatggatgaagctggaaaccattgttatcagcaaactaacacaggaacagaaaaccaaacaccacatattctcacttataagtgggaattgaacaatgagaacacatggacacagggaggggaacatcacacaacggggcctgttgaggggtagggggctagaggagggatagcattagcagaaatacctaatgtagatgacaggtcgatggatgcagcaaaccaccatggcacgtgtatacctatgtaacctgcacgttctgcacatgtatcccagaacttaaagtataattttaaaaaaagggaaaaaaagtaaaaaaaaaaaaaataaacaaatcagcaaactacacagaagaatattagaacaatttctctcaaatttctcttccattgagcttcctgcctgaccctagagctccctcacctctttggcttaccagctcccatccttcaaagtttctgagttattctgtggggaatttgagctactctcttcctttaggtccaggccatctcagctaggtccagagagcctcactcacctccccaactaagcaagcatccctggaggtatgttcttcatgcaagggcagttcctgagagaatttatttggttagctcataaagggattatattgttttcccctgcacatgagagagagtagctgaagtctactgactttaatgaaattctctgtgaagagtctgggagggacggtttaggtaatccatctacaagggtgctcagagagtttggagcgaagcgattggtgtcgttatgatggcattctatggcacagtagttacagtgcaccaggcactcttttaaagacttctcaagtgttcattcatttaattcttaccacaaccctgtgagggacttcctgttattgtctccgttttactggtgaggaagctgaagcagagaagttaactactttgcccaagttcctttcctcctttgaggataaggagccaaaggttcaggaatgcccaaatcacatccctcttcttgtctaaccacccaacctctccacaggcaacctgatcagccacctttatacaaagtacagtattcagattggaataaaaatatatctccttgactccctgctctgagaggtatttcttctcagactcccaaaagctggattgaggaacatggcttagttggtacagtatagcaaaatgtcctgcttgttgaaactgaatttgtgattatcttctttttcctcaagaagtcattgagggctgttgtatccctataaaaggagaatttagagtagccaaataaaagggggctgaagtagtctcattacggaaaaagagagtgtgagcagccttttagtaattgattgcctcaagatgtggtattcagccagggtgaagggaaagtagttggggctgtggatctggaggtttacagaagcctttacccatcctgagactcagttctgctgttggtcttcagagaagtgtctgcacctgctgagaagaaatcacaccactgcactctagcctgggcaacagagcgagactctgtctc

SEQ ID NO: 1769 - DNA, 2362 bp, Homo sapiens
tccttgggccgaccccttctcattgaggacattcatgaagagctggatccagccttggataatgtattagaaaagaattttattaaatctggcaccactttcaaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggagttagaggctgagagggttaaacttttggaggatgttacttttaataagcggaagatgaaagaacttgaagataacctcctctataaattaagtgctacaaaaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaagggggagcagctctggacctgaaagcctgtcctcccaaaccctatcgctggatccttgacatgacttggctgaatcttgtggagctgagtaaacttccacaatttgcagaaattatgaaccagatatctcgtaatgagaaggggtggaaaagctggtttgataaagatgctccagaggaggaaattatccctgatggatataatgattcactagatacctgccataaacttttacttatcaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgacgcattggccaagaaactgaaactggaatgtagaactatctcaatggggcaaggacaagaagtacatgctcgaaagctgattcagatgtcaatgcagcagggtggttgggtattactacaaaattgccaccttggcctggaattcatggaagaattactagagacgctaattaccactgaagccagtgatgattctttccgagtatggataactacggagccccatgatcgatttccaattacattgcttcagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggagcgacgaaaatttggccccttaggatggaatattccctacgaattcaattctgctgacttttcagccagtgttcagtttattcagaatcaccttgatgaatgcgatattaagaaaggtgtatcatggaatacggttcggtacatgatcggagaagtacaatatggaggcagagtgacagatgactttgacaaacgtctacttaattgctttgccagagtaagtcaatttagaaaaataaagtttggagacacatttcactgtattttccaatttttttgtttgtaataggtctgccaaactcaagcatacagcagagctgctgcaaagaattagccaagaaacaaatgcatgtgtgcgcttacacacacgcacacacatgcacacacacacacacacacacaacaaccagcaattgtgccaggcatggtggctcacgcctgtaatcccagcactttgggagactgaggcgggcggatcacgaggtcaggagttctagaccagcctggccaatatggtgaaaccccgtatctactaaaaatacaaaaagtagccgggcgtggtggtgagttcctgtagtcccagctacttaggaggctgaggcagaagaatcacttgaacctgggaggcggaggttgcagtgaaccgggatcgcaccactgcactccagcctggtgacagagtgagactctgtctc

SEQ ID NO: 1770 - DNA, 2120 bp, Homo sapiens
ctttcacttgtagctgcgagggaggagcccccgacttccctgtggaatattctgagagaccctgtgaaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtggggggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacagctgccccgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcaattgcaataactttcggttgctgcaaaatagtgaaacctctgccacacaccagatgtcctggggacccctcatccggtctgaaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcctagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatccgaccacagtgggaggtgtgatttacccattacacaatgagaaaccagaggagccgatgagttacttaattgaggtcacagaatgaattagcaagaaaatggttctaaaatctaagtattttagtctagaattttctccattacatcatcctaagagataatgctctgtacttcatttgaaataaactggaattgtattagatagctc

SEQ ID NO: 1771 - DNA, 1825 bp, Homo sapiens
gggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggtaccctgctcttcagggaggtcagttttttgcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcttgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattagaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccattt

SEQ ID NO: 1772 - DNA, 2235 bp, Homo sapiens
acgccttggggactgcgtttggcttcatcaggtgcacctggccaggaagggagcacaggcaggggcatgaggccagtggcctcctctgaggacccacctagccccgccccagctccacctgctccctgccctggccatctccaagccacatgggagcagcacaataataagaattattaacaggaataagagcagccctgagagctctgggagcgggagctgtggtggcccacagtgcccagggagggatacatggcagccccagggtgtggggcaggtgggcagggcactaatgaggggcctcgagtcccaggccaagggctcagacttcctcctggggataatgggaaggagaacctcatggccaggtttgtgcccttagtgaggtccccaagggggaacctggaaggaccactgtcttcttatagcccttcagacccccccagaggctctgcctccccacaccctggcctccctccccaggctctgggaggccaggcctcgccccctctcctgtgctgctccttctcccagaggactgcatccgccctcagcacttcaaggccctgcatgtgcccgcacctctccactcccctggctcagcttggacctctcttctgaactccagacttgcggatcctgctccccttcccacttctgcacttgggggtctaatgaggcctcagtggaacatagaattcctcccgccctgacatcatagctcccgcctgggaggcctcctggatgactcctttcgcctcctcccttccctgagagcagcccctggctcaacctccacctccgtgctgcctcggaccacctgcccagtcgagctgccatcacctgccaggtgaccacagcagccctcactcatcccctgctcctctgccttccactcccgcgaccatcagcctccccaagccagaaaggtccttctggagggtgacgcagaccaggacactgctttgctgaagacctctgacagcctctggggttgcttggaataaaatccaccctccttcccagggaaccccaggccctacgggagctggcctggctcaccccggcatcacctccctccactctcctccccttcactgcacccagcccctctcctccctgctggccctgaacttagggccagcctgctcctgtcttagggccttgcacttgctccttctggaacattcctcctccagctgctgacgtgcccctccttgtgtggagaggctgggcccagtctcactccactgacggcacggctgctctgctcttcctcacaggaggtgtcaactccacggttggtttgcttctgtgcccaccgacagcctcccctagagcacagtgcctgtttgctgccctgtaggctgtgagcactcactctagttgagcccctgaggggcaggggcaagggcagaggagatggagtccgggagctgcaggtgcagtcaccttcccatgtacctcccacacatgcagctgtgagaaccacacggcataaagggtggctgggccaggccaccccacgcgtcctcatcacccctgggcctttccaaggagatggctccaggtgtccagcaaacaccatttgactgcccagaaaggaagtattatcataggctcagagcagcttttggtaatttctttcctctcacaccaaggcattgtgtgcgcacgtgtgtgtgtgtgtgtgtgtgtgtgtgtgttttaatttttattttagagacagggttttgctgtgttgctcaggcttgtcttgaacttctgggctcgtgtgctgcgattacagggtgagccactgcgcctgatcaaggcatcaccgttgaacctcctaagaggaaaacataaggctgtgcaataccaggaactgggattctaggttgccccagacaccaaggcatcaaaagccaggggatccagaaaaaacacagacagccaagagagaaactgcgggaaaaagccaaaaggttgagagccacaccatctagaagcttcctgcctgtggtgcggcacagaaacaaggagagtcagcaattaccagccagccaaggtcctggaagctgacgtagagctcgtgccgacggcagacctgccggccgtgggagccgtggacgtcatctgcagggacagaaggggcaaggtcttttctggggttcctactgtgtgcagctactatggggtaccagggtgggggatgccctgatgagcacatttgtcaaataaatgaatgacagg

SEQ ID NO: 1773 - DNA, 2028 bp, Homo sapiens
agaactgtggcgctttctgggtaaagatggacgtccacgatctctttcgccggctcggcgcgggggccaaattcgacacgagtcgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcaggtgaatgatgaactgtacatccattacaatggaatactacctagtaataaaacgaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcagaatacacatgatccacaaagcagcagtggcagccaagaaatttggacctaaatcatctaaaaagtttgatattcttgtgactactccaaatcgactaatctattcattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccgtgagagaacttgttaaaaagggtttcaatccacctgttcttgtttttgttcagtccattgaaagggctaaagaactttttcatgagctcatatatgaaggtattaatgtggatgttattcatgcagagagaacacaacaacaggtaaagtcaaatatatactttgaaactcagaagaactacttgattttaaactattgacattaaatttatgaagtacctgttttcattctaaaacaatttaatatatattctgttaaccagagagataacacagtccacagtttcagagcaggaaaaatctgggttctgatttgtacagccttgctagcaagagggattgattttaaaggtgtgaacttggtgatcaactatgactttccaactagctcagtggaatatatccacaggataggtgagttgtcttttttttccttcccctctgtcacccactgatctgtcttaggacccctgctattccctgcacatatgctcacttcttagtgctgtgaaaatccagtgacttttataaatgaattttgagagcctccttccccccaaaatgtgttttttaatggtctaatttttcttaggtcgaactggaagagcagggaataagggaaaagcaattacatttttcactgaggatgataagccattattaagaagcgttgctaatgttatacagcaggctgggtgtcctgtaccagaatacataaaaggttttcagaaactactaagc

SEQ ID NO: 1774 - DNA, 1882 bp, Homo sapiens
aatagccatattgcccaaagtaatttatagattcaatgctattcccatcaaaccaccattgacattattcacaaaattagaaaaaaagctaatttaaaattaatatggaaccaaaaaagagtccatacagccaagacaatcctcagcagaaagaacaaaggtggaggcatcacgctacctgacttcaaattatattacaaggctacagtaaccaacacagcatggtactggtaccaacacagatatagagacctcagaaataagaccacacatctacaaccatctgatcttcaataaacctgacaaaaacaagcaacggggaaagaattccctatttaatatgtggtgctgggaaaactggctagccatatgcagaaaactgaaactgcaccccttccttaaaccacatagaaaaattaactcaagatggattaaagacttaaatgtaaaacccaaaaccataaaaaccccagaagagaatctaggcaataccactcaggacataggcatgggcaaagattttatgatgaaatcgtcaaaaataattgcaacaaaaaccaaaattgacaaatgggatctaattaaactaaagagcttctgcacagcaaaagaaactatcatcagagtgaacaggcaacctatagaatggaggaaaatttttgcaatctacccacctgacaaaggtctaatttccagaatttataaggaacttaaacaaatttacaagaaaaagaccaaacaactccatcaaaaagtgggtaaaggacatgaacagacacttctcaaaagaggagatttatgtgaccaacaaacatataaaaaaagctcatcactgatcattagacaaatgcaaatcaaaaccacaatgagattccacagcataccagtcagaatggtgattattaaaaagtcaagaaacagtagatgctggcaaggctgtggagaaataggaacactttaacactggtggtgggaatgtaaattagttccaccattgtggaagacagtgtggcaattcctcaaggatctagaaccagaaataccattcaacccagcaatctcattattgggtatatacccaaaggaatataaataattctattataaagatacatgcacatgtatatttattgcggcactattcacaatagcaaagacgtggaatcaacccaaatgtccatcagtgacagactggataaagcaaatgtggcacatatacaccacagaatactatacagccataaaaaagaagcatgatcatgtcttctgtagggacatggataatgctggaaaccatcatcctcagcaaactaacacaggagcagaaaaccaaacaccacatgttctcactcataagtgggagttgaacaatgagaacacatgaacacagggaggggaacaacacacaccggggctgtagggagggcagggggaggagagtatcaggataaatagctaatgcatgcagggcttaatatctaggtgatgggttgacaggtgcagcaaaccaccatggcacatgtttacctatgtaacaaacctgcacgttctgcacatgtatcctggaacttaaaataaaataaaattaaaaaaaaaaaccaagctaaaaaaaaaaaaaagaaagaaagctcttccaccctccttcacctatcttaatacaagtcatttctccaagctccctttagtgcagggctctgcatttactgtggttatgcaatcatctgggagatcctgttaaaatgcaggttctgattcagtagactggaggtgaagtcaggactctgcatttccaacaagctcccagatggttatgatgctgctggtccatggacctcacttcgaggaccaaagcttactggcttattggaaaaaaaaaaaaaag

SEQ ID NO: 1775 - DNA, 2605 bp, Homo sapiens
atttttattcattcttttttattctgtccttcagacagaataatctcagttggcctgtctttaagttcactgattctttcttctgcctactcaaatctggtgttgaccccttccggtagatttttcatttcaattattatacttttcaattccagagtatctattcagttcatttaaaaaataatatctatctattggttttctctatttgtaaaaaagaagtagacattatgaatacatctataacaagtaaagagattgaatcggtaattaaaaacctcccacaaaaacacctaggaccagattactttgctgatgaaatctaccaaaccattaaaaaacaccaatcctttgcaaattctttcaaaaaatgtaaaagaacgaatgcaaccaaactcattgtaggagatcagttttgccctgataccaaaaccaggcaaggacaacacacacaaaaaaacaactacaaactaatattcttcacaaatatttaccaaaaaaaaatcctcaacaaaatactatcaaaccaaattcagcaacatagaaaaagtattttacactatagcaatgtgtaatttgtcccagaatgtaaggtcaatttagcacctgaaaatcaatcagtataatatactgtattaatagaataaaaggcaaaacctcatgattacctcaataaacacagaaaaagcattttgacaaaatccaacattcttttctgataaaacactgaaccaactaaaaagtaaaggagaacttcctcaatctgatgaagtatatctatttatttaaaaacccacacctaacatcatacttaataataaaagacagaaaggtttcctcctaaaatcagaaacaagataagaatatctgttcttaccacttctattcaatattgtactgggacgttatagccagggcaattaggtaagaataagaaataaaaagcatccatattggaaaggaagcaaaaccctcttatttgcagatgacatgatcttgtgcatataaaaccaaaattcatccactgaaaaaaccattaaagataataaacaagttggcaagatgacaaaatacgagattaatatacaataaccagttatatatctatacactagcaataaacaatatgaaaatgaaactcaaaaaccaattccgtttacaatagcgtcaaaaaaataaaatatttaatactttaaaaacaaggcttacacactgaaaactataaaacatcactgagtgaaattttaaaagacttaaataaaatagatttttcatatttatggattggaagacctaatattgttaagatggcactactcttcaaagtgatctacagattcaatataacccgtcaaaatccctgctgccttttttccagaacttgacaggctgacgctaaaattccaatgaaaatataaaggaagcagaatagctaaaacaattttgaaaaaagaactaagctagaggtcacacatgtcccagttgcaaagtttatcctaaaactacattaatcaagattatatgggactggtatgaagatatacatacatacatcagtagaatcaaaataaaagccagatatgtatagtcagttgattttttacatggatgccatgacaacttaatgcagaaaggatagtctttcaagaaatttggctgcgacaactgaatatccagttgcaaatgatagaaattggaccctttcttcatttcctagtaaaaaaaaaattaactcaaaatgaatcatattaatggctaactataagagctaaaactatgactcttggaattaaacataggtgtatatcttcatgaccttgaattaggcaatgttttcttatgaatgacaagtaaagcacaagcaactttataaagaataaatagataaattggacttcatcaacaatgaaaatgttcgtgttttacctacactgtcaaaaaaatgaaaaggcaattcacagaatgggagaaatatttgcaaatcatctaccagatatattctagcatccagtatataaaactattacatgcaactatttaaataaaagaaacaaaaccacactaataaaaaaagggaaaagatttgaatagacatttctccaaagaagatctgcaaatggctaagaagcacagtaaaagaagttcaacatcattagctttcagggaaaaacaaatcaaaactatgagataacatttcacatccactggcagggtggtcatcaggaagtagggcaataacaagtaatgtcaaagacgtggataaactagaaccctcatactttagctggtgggaatgtaaaattattcagccactttggaaaacagttagattgttaagttaaacatgaaattatcaattgacccaggaattccattctaagaaaattgaaaacatatatccttataaaaacatgtacacaaatgtttatagcaactctgtttataatagtcaaatgatggaagcaacctaaatgttcataacctaatgaattcttatgcaaaatgtgacatattcacacaatgaaatattattcacccataagaatgaagaaagtactgacttatgttatagtgtaggtgaaccttcaaaacattatgctaagtg

SEQ ID NO: 1776 - DNA, 1961 bp, Homo sapiens
tgtaactaagtgccacagagtggatagcttaaacaatagaaatttatttctcatagttctggaggctagaattccaagatcaaggtgccagcatggtttctggtgagggcccacttcctggctcatagatggcctcctgtctgcatcctcacatgtcaggtagagagagagagacagcaagctctctcgcgtctcttcttataagggcacgaacttcatcacaaggaccttatctaaaccaaaggaacttccaaaggccctgtctccaaataccatcccattgggggttggggcttcaacatatgaattttgggggaacataattcagtgcacagcagatgtggaagctgagatctacggagatcctgtggctcatctaagcagagggggacttgttcctaggtctgatagcacctaatccagggctccttgccttctaatgcacagctttgacctccagaaccaccctgggtcctgcctccttagtctcttttgtccttgtgagagctgggtgggtttaagaaagtattggaaaaggaggctgcctttcccaaacattatcaggagcaatattaataattatattagacacagccctcatttatagacccctgactcaagtcagtgccgttctaagttcacatataatatttcatttgcccctcacaatgattctagggaaacgtattctctcttttctactttacagagcgagtacagaggcatcatgcaaggtcacacagctataattggcacagctggggactcacccgggctgtctggctcccgagtttatgctcttaatcagtaccaccttagggatgggatggtcaacaacacaatcaggaggtgggtgagggtcagccctcccctgagctgggtgcactggaatacacctaccatcccctggtcagggctcaggccagcacatggggctgattttgtgaaaagttgtaagcataagcaaataatgggtgtttgccaagttgaagacaggcatagaattgaatcttctgtctctcctaatgtcaaataatgaagtagacagtcgtattcttggcatattatgaatttcttgttttctagttggacagagatcaagggtctcttggtttagaatcacaggaccaagggataatgcaaggcctgttaagaccttttggtgccattggccaggaccacatggagcagggggtcattttggtattaaacagtgactgctggtctatcctctagggggtgataatctccccttcctcttcttgatggacatttattcaatagtcaccaaggagattcagcaatctgggtgtcctacagcctagatatgctgtcctgtgttgttgaggtttatgcctggactttgattgatgccagcccctccaaaggctctttccacagctgttgcttctggttggatggtgcactcactgtgctcagcacctcaggaagggattgagggttgtgaatagtggagatgtgtagggagagtagggaatatgtttcactgccaatatacaagcagtatgtcagatttgggaattctactggcaagggttgagtctttgcttgtcaccgggctaaaagttgcttcacctttccaaacatcagcttcctcacttacaaagtataaccactgcattgcaagttgttgtctcgattaattgaagatgcttgccatacagtagggactcaaccatgtcagcttctccccccagatgctaggggctgtgtgctttcatggaaagaaatgcttctgctagacttaattgacatcatctttggtgggtcttttctttgcttctgaccacacgtcttttaaacttgagatgcttttatgcttccgggtaacaagcaaaagtcaggccaaggaggaagcaaaactaggatttattggtggggggtcatggaatagggatgttagagattagcagaaaagaactgcaatgatttaaaaaggc

SEQ ID NO: 1777 - DNA, 1823 bp, Homo sapiens
ctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaaaaaaaaaaaaag

SEQ ID NO: 1778 - DNA, 2110 bp, Homo sapiens
gcttccgggatttggcggcgcctttgtctctcgctgcagccggagctccaggtctcgctttcactgctctgtgtcctctgctcctagaggtccagcctctgtgggcctgtgacctgcagaaattgagagatccacagctaagactccaggaccccctggaagcctagaaatgggactgttgacatttagggatgtggccatagaattctctctggaagaatggcaatgcctggacactgcacagcggaatttatataaaaatgtgattttagagaactacagaaacctggtcttcctgggtattgctgtctctaagcaagacctgatcacctgtctggagcaagaaaaagagcctttgactgtgaagagacatgagatggtgaatgaacccccagtaatgtgttctcattttgcccaagagttttggccagagcagaacataaaagattcttttgaaaaagtgacactgagaagatatgaaaaatgtggaaatgataattttcagttaaaaggctgtaaaagtgtggatgaatgtaaggtgcacaagggaggttataatggacttaaccaatgtttaccaactatgcagagcaaaatgtttcaatgtgataaatatgtgaaagtctttaataaattttcacattcagatagacataagataaaacatatggaaaataaacctttcaaatgtaaagaatgtggcagatcattttgcatgctttcacacctaactcgacataaaagaatttatacttgtgagaaactctacaaatgtcaagaatgtgacagaacttttaaccaattctcaaaccttactgaatataaaaaagattatgctcgagagaaaccatacaaatgtgaagaatgtggcaaagcctttaaccagtcctcacaccttactacacataagataattcatacaggagagaaaccctacaaatgtgaagaatgtggcaaagcctttaaccagttctcaaatcttactacacataaaaaaattcatactggagagcaaccctacatatgtgaagaatgtggcaaggcttttacccaatcctcaacccttactacacataagagaattcatactggagaaaaaccctacaaatgtgaagaatgtggaaaagcttttaaccgatcctcaaaacttactgaacataaaaacattcatactggagagcaaccctacaaatgtgaggaatgcggcaaagcttttaaccgatcctcaaatcttacggaacataggaaaattcataccgaagagaaaccctacaaatgtaaagaatgtggcaaagcttttaaacactcctcagcccttactacacataagagaattcacactggagagaaaccctacaaatgtgaagaatgtggcaaagcttttaaccgatcctcaaaacttactgaacataagaaacttcatactggaaagaaaccctacaaatgtgaagaatgtggcaaagcttttatccaatcctcaaaacttactgaacataaaaaaattcattctggagagataccctacaagtgtgaagaatgtggcaaagcttttaaacactcctcatcccttactacacataaaagaattcatactggggagaaaccctacaaatgtgaagaatgtggcaaagcttttagccgatcctcaaaacttactgaacataagataattcatactggagagaaaccctataaatgtgagagatgtgacaaagcttttaaccaatctgcaaaccttactaaacataaaaaaatacatactggagagaaactacagaactggaatgtgtgataatgattttgacaacacctcaaatttttctaaatataaaggaaatcatactggtgaaaaattctagaaatgtaaagaatgtgtcaaagactttaaatggttttcacacttcattgtatgtaagataattcatactggagaaaactacaagtgtgaagaatttggcaatactgttaattaaggctcaaaccttattgcacaggaaagcgtttatacttaagaaaaattgtacaaatataaagagtgtaaaatagccattaatatctgttgacatcttaatatcagaatgttggtacttaataaaagcattataaatgc

SEQ ID NO: 1779 - DNA, 2152 bp, Homo sapiens
gaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccaggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttgaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccaggggctctgccagcctcgacctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtttggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcggggcctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgttc

SEQ ID NO: 1780 - DNA, 2357 bp, Homo sapiens
attaaatgtttctgctgggttggcaggtgtgatcatggtgatgagtccagtttagagtcagctccccgagggcagtatgcaggctgctttcttgtgctagtgactttttgattacagagagcaaagaggcatgagaagcactatgcagaatacatttttttttaaagtagcaacttcaacaaaggcaggtaacttcttgagggcatactgtgtgctgggagctttaggacaaaatctcattccatcgcatcccaatcctaagcattaggctgttagcaccaagtctgcagagttcactgaccctttgtttagggcttgtatccccagtgtctagaacagtgtctggcacatggtaggtgctcagttaatacatattgaaagaatgaatgaattatgcttacaataaatgagaaaactgaaaatttagagaatttaaaccatttacacaaggccatgttgacactaagcgacaaaactaggatctgtgtgattctaaagctaaagagctgtcttctaaccacatgttcccctgtaatgttctggttttgtttatcaagacttctttgcctctctagaagactgtattatcatactttgttcccttaagcttctatttgctatgtatgttatttattcctctcctttttatgcctttatattcttgcatatctgaaacttcttacctgcagtaacttgggaagatgtgtgtcttatgtggaatacaagatgagatcaaatgataactgaaaatatccttttttgtgttattaatatttgcattccgtgaatattaataactgagtagttttccttgtttgtacctcttggctcttaaactctgtaagtgtggtatttttcccgcttggtggtgtcttctcatggggttctagaaagcaaatactgctctcctttttcatgttttctatagctgattgaagtgtttttaccatggtcagtgcatttttccgcctgcctgtttcatgatcactattgagggatttgactgaatttggttaaatcttacatatagctaacagctttcaagacacataaaaaatttgctgacttctgaaacaaaatgtcagccaagcattgttcaaatgagtacactgtcagtggggtttaagatcatttggtgtgttggtagagttatgtggctgcaattagttgtaagtgtaatcatgatttgcatgcagtatcaaaagtacctttcatgtgtggtggtataaggactggcaaacagcaagttccagatagcagatctctccaccgccccccacccccacccagctttccagtctcagatggacgacattgacaccacagctcttccaggcacacgccctgtgggctagaggtttatgaacgttgatttggagaccaacagacctgagttccacttcccactcacccacttagtggctgtaatacctggagcaaggtccttaacctctctgagtttcttattcctcatcttttaaacggcggtcacaccacacacttcacacactcacatggtgagtgctcctgggcaaggggctgttgtgagcccattggtatagcaactagtggtgctgtctactgcaaagcaaatgatgaagctcagtgaacaacgctgagtgatgagacagggcagaaaagggtaaggcgaggggccacgacatcacacccacccagtgtttttccccagagccctgaggatgatgacaggaaggtccgaaggagagaaaaaaaccgagttgctgctcagagaagtcggaagaagcagacccagaaggctgacaagctccatgaggaatatgagagcctggagcaagaaaacaccatgctgcggagagagatcgggaagctgacagaggagctgaagcacctgacagaggcactgaaggagcacgagaagatgtgcccgctgctgctctgccctatgaactttgtgccagtgcctccccggccggaccctgtggccggctgcttgccccgatgaagccggggacactcctctgcccagcaaggagccttggtcattttcatacctgggaggaaggcttttccttcacaattgcatacagggggcacctgtggccaggcctcctcctgggagctccaggaccagccagctgtgttccctgcagactgggctcagcccgacatccaacaggcgccaaactcacagagcccttgtgcagatccagcatggaggccaccctcaggagtgacttctcatccaccctggcagctagtaggttctgctgttatgcagagccatttcctctagaatttggataataaagatgcttattgtctctcccttctccagttctgggaatttacaggcacaatacacttccttttcctgg

SEQ ID NO: 1781 - DNA, 2076 bp, Homo sapiens
agaaacccgacggcgcggacccaacctggctgctgcagtacttgctctaactttgccgcagctgcctcccttctctcggaacccactctcctaacccacccccgagaggcggagagaatgtgggagcacttcagagaggcctaggctccggagatcgggccatctgggctctgaaagcaaattagttttccaactcatgtctggctccggcgttacccagacgcctggaaggtccttcctgcagtctgatcaccatttttcctgctgcactgaccaatcagctccccttggccttcaacctcgggaatgatggattaggggagtctagaaatggacgaagccctagaagcgcagctgaagacgagcagaggacgcttctcggctacagaatccctccccaccttggagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacaggctggagtgcagtggcgcgatctcagctcgatgcaacctccgcctccggggttcaagtgattctcctgccgcaacctcccgaatagctgggatttcaggcgcatgccaccatgcccagctaatttttgtatttttagtagagtcagcgtttcaccatgttggccaggctggtttcgaactcctgacctcaggtgatccgcccacctcggcctcccaaagtgttgggattacaggtgtgagccaccgcccccggcccccaccaagttctttcttaccgtgtctagaccccagagaccggattggtactccccaggtccctgctcccacccttccctagcccaacctcctactgggttgtgccctttgaccccaaaagctctcgaagtccagatttgcccttcccaagaaaccattcctgctctgggtccatccacattttaccctggaggacccagaagcccagtcactctctacaaaaccccagccttgatacagacctctctgcgcgccccccaactgccccaaccctgattcatcccgctagggcccagtaagaacattcaccctccccaaggacctgcccccactcacgttccgcacatagactcccaggccgcacgctccggctctgaccccaatccctaaggaatttacacatttttcccttcccgaggccacgccccccacgtctctggactccgcccactagggccttaactccactttttcctagaccttcgcagacgggacggacctttgtcgctcggctctgggccacgccctaccggtggctgctcctggagcccgtcactgcttcaacatctccatctccgcggtacctcgtcccagaccagggcgacgggcccgggaagctccctcccggcgttcccgcagccctcgcacctccatcctggacgctgcgggcagcgggagtggcagtggaagcggcagcggcccctagcggacgcgtggccccgagttgggggagctacccttcccccagccccgcccctcaggacacccagaaccccacccctcgtcctctcggccttctgtaatagttttgagatgtctgtccctcctccctggagctccagagacccacccctctccaggttatcccagaaatgacccaactctctcacttttccctctcccctttgaataaagtcgccagctagagcacgt

SEQ ID NO: 1782 - DNA, 2610 bp, Homo sapiens
tctcactaaaggcttggtgctagaatatggcatttgtgtctgtgtgcatgcttttgatagtcttttctgtaattatgtgcatgcttttgatagtcttttctgtaattgtgtgcatgcttttgatagtcctttctgtaattgtgtgcatgcttttgatagtcttttctgtaattgtcctgatacgcgcagtcaaaagcaagcatgctatctagattccgtgattggtttgggtcctcattgtcaataccactacctcctcatttcatgtgaggaaaaaaaaagaagaaagatcttgagagttgcattcagctcatctaggtttttttcttttcttttcttttcttttctccttttttaaggcagggtctcactctgtcacccaggctgtacagtgatgctgtactccatagctcactgcagcctcaaacccctgggcttaagggatccttctacctcagcttcccaagtagctgggtctacagatgtgtgccaccacatgcggctaacttttaaaatttttgtagagatggagatctgtctcactgtgttgcccaggctggtctcaaactcctggcctcaagtgatcctcctgcctcagcctcccaaagcactgggattacaggcgtgagccaccacacccagccagctcatctaagttcaatatagaacagctgtgtcttgtaagaaaaaacattttgaacatatttggctcaacttaactgaaaatgtaaatataaggttgctgtttatttctatggtttatcattaccgtcagcttaagtgtgagttaaacagtgctgtccataacccatggtgcctgctctggcacacagcgggacctggaggctgggcgggcagggcagtgtgccgttccttctcttgctgcataaccagccatgggtcatgctctatcctcaccctggccctgcagcaaggctgtgcagcacctgctcatgctcttatctcacagagagatgccatcaaactgtccccatcatcaccaggatgtgtcactacctcacaccatcctggagccaggagccaccgccagctcagtggcttccgtcagcatggtccatcactcctcacgatgctgtcgtctgcgctaggctcatccagacggttctgctccgtggcgtgtgctggggctggagtgttcacaggggctgctgagcaggtccccacgctgcctctgtgatgccttgagctcctccaggttgtctgagtttctacagccacggccacgtccaagaggggagaggcaggacccccagtcctcctaagagtttggcttggaactggtgcagagtgacttctgccctttgtgttggtcagagcagggcacaaggacagcccagcttcagaggaaggagaaatagagtccacctcttcccatgaggccagaatacatcatacaggcaggaaaggcatttagaatcctttctggagacttctatagccagcaggttcccagcttagtgtctggggggtctgattccctttctgctgaaagagtgagaaacactctctccggctcccagggatctctgtttccctcccagggtgtccctgtttgtctcccgctggaaaaggaagaaggaaaagaactgtccttatttcttctttcttctgcctacatcaaagcaggtttaaaaaattagaaattaagaatttatcagtaagaatgtagtaatgttgatttaggaaaacaaaatggcttataactgcaagccatccttatgtaaatgttaaagctgatggatctagaccagaaggggtccaggggtctttgtctcggagaggcccagatcacagctctccaaggtccatgcgagaggaatagtaaactgaagccacacggctgccgtgtatgcaaagggagcctgcagggtgagtttcgtaaattaaagcacctctcggtgtagacacacacagactgacttctgcttggtcacagcttccaagcctcagggtaggtgcaggctgagggacaccaggtgcgagcattttctgtttcttgtcatggcaccagtgtcgttcctgtcacccacggcactgagctctgccctggtaacgtccctccctccctcttaggctttggccacctgcattgttgtgctactgggtctccctgctaaaggttctgcttcctggttcctgcaagagcagatctcagtttttctgttgtgttgttttgttttgttttttgttttgaaacagggtctctgttgcccaggctggaatgcagtggcgccatctcagctcactgcaacctccatcttccaggttcaagtgatcctcccacctcagcctcccacatatgtgggattacaggcatgtgccaccatgcccggctaatttttatatatttagtagaggtggagttttgccatgttggccaggcccgtcttgaactcctgacctcaggtgatccacctgcttcagcctcccaaagtgctgggattacaggcatgagccactgtgcccggccagatttcggcttttctaagctggccttccagcctctccatgcatcttgcccaccccactccacggcacagacctttgttccagccaaacgagttcttctccctctccacactgccatat

SEQ ID NO: 1783 - DNA, 1965 bp, Homo sapiens
acagcccagtatagcaagtgtagacatggcaccggcagcttaatgggccagctgagtgatggggaagccccaaggagacctcaccaggcctgatgggtcagggagagcttcgcggaaagagtaatagatcttttgcgagaagaaaacaagggaacagccataactggggctgccggggaacggagagggacaggaagcagaggggaagagaaggggctagcaacagcagcaggatgctcatgcagggctgtgcaggcccttgggagcagcctgggttctattctttggacgctgggggagtttcagccgaagcaggccaggaacattcaggtgtctctaatggttactctggctattgtgtggagagaggcctggaagggtcaagcaggagagggatgaggcctcacagggcagccacaggctcctgaggctgggttggtaggggaaggacgtgagaaggggacagattcaaaagctacttgggacctatgtagtaaccatctgaatggcaatctatgtagatttttgcagtgtgtctgtgtagtgtgctgggagcaggtatttgtatttatctctgtgtactcatgtctaggccagtaggatagagtatctatctgttcacctgtgtcctcaagttatgtattatgcaggggcctctgtgtgtgtccaaaggtctggcccataattcttggctcagtgttaactttcttcctgcctccaggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttat

SEQ ID NO: 1784 - DNA, 2075 bp, Homo sapiens
atctgtggctgggttatgaccctgaatgtcataagaattttcttgagtagaaattcgaagtagtcttgctccatctctagattttcaattagcactctttgattatgcaggccatataaaatatgcccttcctgctggcagactatttcagttcttatctcatactcctctagttttgccaacaaaagtagttcactccctcatacctaaagctttaacgctttttactgatggctctggtaaaaatggaaaagcggctatttggtggaaaccacataattccctcactcaatctggatttactaccgctcagggagctgaggttggagccctagtactggccctagaaaccgaatccgttcagcccattaacattgttagtgactctgtttgtttgttgcaaaaccttgagaccgccctcattaagtccactctcgagcctaccctgtgtacaccttttcttggacttcagcaattgctgggtcaacatacacagttttatcacacatattcgagcacacagctcactgccttgcccactggcttatggcagtgatcaagcagacctgcagcttatgacgtcactgcttgaccaagccacccagtcgcttcagtttttccaccaaaattagagaaacttaacaatagcagcttacccaaagactgggtaaacaaattatcctgcagtgcccagattgccagctcacaggcacatctcttccttgaacaggtgttaaccttagaggactagaaccttatccattatagcaacagatgttacacacgtccctaaatttggaatactaagatatgtacatgtatccattgataccagttcctacctaattagcgcacatgctcttcctggagagtccacacgatacatcattaaacatcttttaacttctgcgtttatggggtggcccacaaaaattaaaactgataataatctggcctgtgccagctcacatattcaacaattttgtcacacatggagcatccaacattccacaggcatcccgtataactgacaggccatagtagaacgtgcccactccacccttaaaaatatgctcagaaaacaaaaaggggaaaatgagtgaggaccctgcaacactactagcacaagtgttatttacccttaatttctaaaatttaaatgataaatttcaatcaactatagaaaagcaccttgctaaaacctctcaagacataaaacccgcagttttatggaaagatgtaaatagtaacgtatggtgtagtccaaatgaattgctaacgtggggaagatgatatgcttgtgttcacacccccctcaggccctctttggattccagtacgatgcatcagaccataccatggcgtggctaggacccaacacagtaccagaagtgaaggaaatgatcctgcaggacccgcagctccagacaacacagcttcctcagacgacacaagccccggacattacctgggggatgctgaagaagacaacttacaaggctgagcaaatcctgctccagacacagaaaccattcactccagataatttgttccttgctctgctctctggtgatgcaaagccggaatacgagcagtaatcgctacgcctgacaaacctgctgctgtgcacatctgtactcttcaatcaacaaaacctgatgcaaaaaacaaaagggggagatgtaggagatcagtcagggtggtgggaaaagttataaggagagacgcaaaccttcttggaagtccaggaggttttgcaaagcttcgggagagaataaaggctgaaggcagctaaattctcttaccctgacgctaagggcaagaagtaggtaacaaaggagtgtaaaggaatttatctagacgagttttatttacttttgcagacctttgatcatcctattgcgcgcaggactgctcccaaggcggtgggggtgacaattacctacagattgtgttggctccaggccttcgtcattaaatctgtactgaataaatacaagcggctccagcttatcagggctgcattctctctttggtgtctctaaggccgaacagtcccctagccgcactcatgc

SEQ ID NO: 1785 - DNA, 3101 bp, Homo sapiens
tttattcaccgttgatgcgccccgagttgtcacaaagccaggcagtggccccggcctctgtgcttaggggaatgctgctccatctttgcggtgacccccgggtctgtgctgagcagagcgcagctccgccctcgcggtatcctcagcccgcccgcccgcccgggtctggcctggggagaactctgctccgccttcgcggtaccaccgaagtctgtgcagaggacagcgcaggtccgccctcgcggtgctctccgggtctgtgctgaggagagcgcaactccgccgtcgcaaaggcgcgccgcgccgcgccgcgccggcgcaggcgcagagaggcgcagggctctcttgcttacagtggtcgccggcgccccctgctggcgccggggcactgcagggccctcttgcttactgtatagtggtggcacgccgcctgctggcagctagggacattgcagggtcctcttgctcaaggtgtagtggcagcacgcccgcctgctggcagctggggacactgccgggccctcttgctccaacagtagtggcggattatagggaaacacccggagcatatgctgtttggtctcagtagactcctaaatatgggattcctgggtttaaaagtataaaataaatatgtttaatttgttaactgattaccatcagaattgtactgttctgtatcccaccagcaatgtctaggaatacctgtttctccacaaagtgtttacttttggatttttgccagtctaacaggtgaagccctggagattcttattagtgatttgggctggggcctggccatgtgtatttttttaaatttccactgatgattttgctgcatggccggtgttgagaatgactgcgcaaatttgccggatttcctttgctgttcctgcatgtagtttaaacgagattgccagcaccgggtatcattcaccatttttctttttgttaacttgccgtcagccttttctttgacctcttctttctgttcatgtgtatttgctgtctcttagcccagacttcctgtgtcctttccaccggtcctttgagaggtcacagggtcttgatgctgtggtcttgatctgcaggtgtctgacttccagcaactgctggcctgtgccagggtgcaagctgagcactggagtggagttttcctgtggagaggagccatgcctagagtgggatgggccattgttcatcttctggcccctgttgtctgcatgtaacttaataccacaaccaggcataggggaaagattggaggaaagatgagtgagagcatcaacttctctgacaacctaggccagtgtgtggtgatgccaggcatgcccttccctagcatcaggtctccagagctgcagaagacgacggccgacttggatcacactcttgtgagtgtccccagtgttgcagaggtgagaggagagtagacagtgagtgggagtggcgtcgcccctagggctctactggaccagcgtctcctgtctcctggagaggcttcgatgcccctccacaccctcttgatcttccctgtgatgtcatctggagccctgctgcttgcggtggcctataaagcctcctggtctggctccaaggcctggcagagtctttcccagggaaagctacaagcagcaaacagtccgcatgggtcatccccttcactcccagctcagagcccaggccaggggcccccaagaaaggctctggtggagaacctctgcatgaaggctgtcaaccagtccataggcaagcctggctgcctccagctgggtggacagacgggctggagaaggggagaagaggaaagggggttgcctgccctgtctcctacctgaggctgaggaaggagaaggggatgcactgttggggaggcagctgtaactcaaagccttagcctctgttcccacgaaggcagggccatcaggcaccaaagggattctgccagcatagtgctcctggaccagtgatacacccggcaccctgtcctggacaagctgttggcctggatctgagccctcgtggaggtcaaagccacctttggttctgccattgctgctgtgtggaagttcactcctgccttttcctttccctagagcctccaccaccccgagatcacatttctcactgccttttgtctgcccagtttcactagaagtaggcctcatcctgacaggcagctgcaccactgcctggcgctgtgcccttcctttgctctgcccgctggagacggtgtttgtcatgggcctggtctgcagggatcctgctacaaaggcgaaacccaggagagtgtggagtccagagtgttgccaggacccaggcacaggcattagtgcccgttggagaaaacgggaatcccgaagaaatggtgggtcctggccatccgtgagatcttcccagggcagctcccctctgtggaacccaatctgtcttccatcctgtgtggccgagggccaggcttctcactaggcctctgcaggaggctgccatttgtcctgcccaccttcttagaagcgagacggagcagacccatctgctactgccctttctataataactaaagttagctgccctggactattcaccccctagtctcaatttaaaaagatccccatggccacagggcccctgcctgggggcttgtcacctcccccaccttcttcctgagtcactcctgcagccttgctccctaacctgccccacagccttgcctggatgtctatctccctggcttggtgccagttcctccaagtcgatggcacctccctccctctcaaccacttgagcaaactccaagacatcttctaccccaacaccagcaattgtgccaagggccattaggctctcagcatgactatttttagagaccccgtgtctgtcactgaaaccttttttgtgggagactattcctcccatctgcaacagctgcccctgctaactgcccttctctcctccctctcatcccagagaaacaggtcagctgggagcttctgcccccactgcctagggaccaacaggggcaggaggcagtcactgaccccgagacgtttgcatcctgcacagctagaggtcctttattaaaagcacactgttggtttctg

SEQ ID NO: 1786 - DNA, 2150 bp, Homo sapiens
ggaattaccaaaaattagctgggcctactggtgggtacctgtgatcccagctactcgggaggctgagacgggagaatcgcttggacccaggaggcggaggttgcactgggccgagattgtgccattgccctccagactgggcaacagagcgagactctgtcttaaaaaaaaaaaaaatcaaggtgattcctggaagtgctcacagcaaggagctgtttctgtcgtgagctggcaggtgaatccgctgcacacacgctgtgctctagatgccgccagtggagctttgcccgcagtctctgtccatgcaccctgggccaccggggagtagaattgtccatttcattgtctctctcaggggatgctggcgcgggggtgggtggcgcctgtccgtggggcccttgcctgcctccccgtggtgctggcgtgttctgtcactgagccactctggggcttcagtgtccctggcatgggtgacactgctgggagtgcctctgggctccttgcctgtggcctttttttttctcaggatggatttctggaagcgaggctacttctcagtactatttccgaatcgcttcctcagtgagtcctccccaggctgcaggtgccgagcgggagcaccactcctgcacgcccgtgcctgtggcatgcccagatgatcagggtggagcggcccagctcaatgtcttcatttagggccattgagagtttcttgtgtcactgaattcctcttctgggaatttttagtttgtgtcattttgttgagttttctgttgggttccaagcctctcgtggcactgtgaatttgctgtggggtgcagctgatggcccatggcggctgtatctggaagtcctttcccgccccagctgtggtcctggtggttttttaggtggaggtggtttcgtcctctttccgtggctcccacagctcagtgctgggctgctgttctcgctctcagccaggaaggcggcccctcccacacaggttgcagggatgggctgctgtgttcttctggtttttctctccttcgagttggtattttaaaccatgcatctcatcacctcttctggcacttgctggcgtgtggtgaaagctgaggatggggagaggccgtggggccctctccgtcctcatctgcctgcaagagctctgactggcctgggctcaaagggaccctgtgcctcccacgctgcctgccccggtgtaatttatgatgaattttcctttgttgttcctctgcgctgttgcctggtcacaggcctgtctgtcagagtggcttcctgccggctctgtggtccctccaggcatttctgtgctctatgctttctgtgctgtggtgggtcttcctcatcacatgtccttttcaggaacctccttgatctgtttctctttgttttaatacccacattgtgtgtgtttgcaggcgaagtccctggtgcgagaggagggctgcacttgcccgcatgccacacactcctcttgcttcagacccacgggatgggatgtgtgtgtgaggccaggccctgggtcctccctcttggggcaggcctgggcactgatctgcccaggtctgggtgggtcagatggtggggctgggtaagccctgggggaagatgctgtgcccccaactcggccagtccggtcttctcacaagtgctgttggccctgtgtgcagccaggcaggcgtgtggatgtgctcagatattgatttgatcatcttatgccttcttcaaatataaaacatattattggccgggggtggtggctcatgcctgtaatcccagcactttgggaggcctaggtgggtggatcacaaggtcaggagattgagaccatcctggctaacatagtgaaaccccatctctgctaaaaatacaaaaaattagctgggcgtggtggtgcgcacctgtggtcccggctacttgggaggctgaggcaggagcatcaatcacttgaatccgggaggcagaggttgcagtgagccaggatggcacaccactgcactccagcctgggcgacagagcgagactctgtcttaaaaaaaaaaaaaatcaaggtgattcctggaagtgctcacagcaaggagctgagttcttaaagactgaagacaggctattctctggagaaaaataaaatggaaattgtactt

SEQ ID NO: 1787 - DNA, 2590 bp, Homo sapiens
gttaaatggtgtacatatattttttaaaaagtgtttctctttgggtttgaaaaaagatggaactggccatttggtatgttcaacagccatccctgcgcatcgcaaaatgtattgggaacattttccaggcagttaccccagtcacttcaaagcagaggtcctgtctttgtcttctggctttggcttatgcaaaaggagttttcaacaactttggctttcagctgttcactctctggtttcagctaaggctgggcaggaactggccccaggacaaagtgacaccagagtttggaacaaagcctggcgctaaggactcagatcagacctcctgggcctcaggctcagctcccaggggcttaaagccaacaagggtgcggtttggaatttgtcgtgtttagagttcagcaggccgcctgcctctcggagtgagagcacagctacacttgccagccatctggttgcatggcatggcatttgctccccacctcaggcatgcagaggacaaagtatattgcatttgtttcttcctgaaaataatgggcgaaattagaacatcattggctgagaactgggatacccccaccaagtcagtatggagaaaattatgagtgaaacaaaagacaaatgttttgcccttttcagggtatctgaaaattatccatggcatggtagtgctgctaagattggtggtgttaattatgcctcagactctgtgtccctctctctctctttctggaagaaaagaaggaatactgttttcatcatatacttcaaagtgttgtcctgcacctcctctcctcagagcctcagaaggacctgtgaggagagtgggccaggtgtgatcatctttggagaaagaggaaacaggttcatgaggcaaaatcacttgctctaagccacagaggtgggagaaggaacgtgcattcctgccattctggggcatctgcccctttaaaagcaaagaaatgagacccaaaacagtccttccaagagtttggctcttgcttaataaaagaaggtgaactttgcacaagtttttcctttgcttttctgttaatattttatgtggatatcttgcagggcaaaaagagtggcttattttcttttcctttcctgcctacaaatacgacattcatatttagcatgttaaaaagagctcagaaaatgaacattgcagcattttcatgctgtgtaagtcagagcgcagctatgactgaactgggtcgtggcaccgctttgctgggtgttgcccagataaaaatattccttgaagctgggagagcaccacgctgtagcttgagaaattgttccagctcttgaaaggggaaaaaatcaaatgaaaccatttgcattctaacagtctttggcaccagggaaaactgtcaactgtgtcacgtgtaaatagaaatctgctccccgcttttggtgcgttttttcataatttcccttgccactctaattatcaaagatatttttatttttaaacaaaaattgtctcccacgcaggcctcatctttctgcggtgaagtggaaacgatgaattagaatattctaatcacttctccaacaaccactatggaggttataaacacaagattatcctagcaaagaaaagtaaattgtttgggcacagaacaggccaggaaaaaattcagtaggccgggcccggtgctcacacatgtaatcctacactttgggaggctgaggagggttgatcacctgaggtcaggagttcaagaccagcctggccaacatggtgaaaccccgtctctactaaaaatacaaaaattagccgggcatggtgatggatgcctgtaatcccagctactcaggaggctgaggcaggaggatcgcttgaacccagaaggtgaaggttgcagtgagctgagatcgcgccattgcactccagcctgggcaacagagtgagactctgtctcaaaaaaaaaaaaaaaaattcagtgcccttgtccaccctccccactcccccactgcctccctgacctccttagtgtatgtccactacacctaaggatgatatcaagactggcttcacggtaagacccaaatcccctgagggtgcaggtctttcatattagtgaaattaaaatccagaatttactccgacttagcaggcgttgaagttcctatttaatgcccagcagtatgcaagaggctccttagaataattgccaataataaaatgtgatttatcaaatagatactatgtactgttaattggtaaatagggatcacgtgctagactgtgtagggcttgatctgtgctttaaacctcagcaaaaccctgagtgaagtacatcccccatttttggaatggggaaactgaaacagggcaagctgaataatttcccaaagccacatagctagtgatgcctctgataatttgaatcctgttaataatcttccttgttccttccttggtggtgagagtttaacccctccttcagatcctttcgtagaacttaaatattctagagagggttgtcgtctaaagtcattcatgtgcaatgtagtaactcaccacgtcctcattaaaatgagaactcattgttacatggacacattgcagggg

SEQ ID NO: 1788 - DNA, 2103 bp, Homo sapiens
caaagtgcccagagatcagaaggcgctgccgcctcggctctgcagggacagaatgggcccctcggggagccgtgccctggggtggaggcgctgctggcatgaccctgcagaagggcaggggtggcacctgggggctgcacgctgtcttccaggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccaggtgagcccggtgcagaaccttcagggatgcgggtctggaggggtggccaggagagctgccgtgagcaagggaggctgtgggcaccccctcaggagctctgccaggtgctgagcccaggcctgcaccctcagccctggctcctggcctggggtctcgagacctgggcagctctcttcagtctcagtgtcttcctttgaagaatgttctggggctggtgtgaggtcccgggcacatggggctgacagtgccagcaaccccctccctcccttgctctggtacagaaggcagggggcgctggtgggatgcagtcaccacctgggcccacctccttgcaggacagcagtggccagagcagaggggccttctggggagcaacgccccagcctgttgtccttcccggaagggtggttctcatgggttgccgtgccctcaacccagccttgcagctgggccctgggaggcagggcctgggagatgcctgagaggggccgtgttggagggccaggctggctgcatgatggccctgggctggggtgtgactgcctgcagctactctgacagcctgctcggcccacagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcccgctgtccatgcttggccccctcgtccccatccacctgtgccctccgcatcttaccctccctttctctttcctcattgccttctcccttcctgttccctcatctctgccctccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaacctgtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgtttgttgggctcacgcttgcacaatgaaggcttgttcacac

SEQ ID NO: 1789 - DNA, 2059 bp, Homo sapiens
tctgagccctgggtagcagcacgtcgatgggttggttttgtttcctcttcattgaaggtggtgagtttcaaagatatcagctttatgtaaagctctccgttccaaccctaccccaaacttcctctcctgtcttcatgtggatgctaacttaaaactcttatttctgggtcagataactccctgctctcagccctgatgactacacctttgacacacactatattggtatggcttttaattttctctttgtttctagcatttgagaatctctgtctttgttaattcaactatgtatttttaaataaacttcatattttagctaacacttgtagatatttgtagctggggaaaactaactttagttgattctactgagtagacaggactggaaatccattctctggggtttgttaaaaccaaagtaactggctctcctggatgctagctcactgtccaagttgaatttagtgtcaatcatccagaaaatgtcccgtttttcatgtgcgaagtctgcttatagttaatagaccagcttaggttcttcatttagttcagtgaactcttcaaaatgtggtttcaatattgaaataaatgcatatcattctaattttactcttttctctctctgctaggaaactggagggagtaaatcctacagacaatagacagatgtttgaaatacttagaacatggtttgtttttctttttgtttttgttctgaaatggagtgttgctctgttgcccaggctggagtgcagtggtacgatcttgggtcgccgcaacctccgcctcccaggtttcagcaattctcctgcctcagcctcccgagtggctgggactgcagacgcgtgccaccatgcctggctaattttttgtatttttagtggagacagagtttcactgtgttggccaagacagtcttgatcttttgacctcatgatcttcccatcttggcctcccaaagtgctgggattgcaggcatgagccactgtgcccggccagttgttttaattctaggttctggatacatgggaagtggaggaaatgctggacaagaaggcacagttagatggtagacccacctctgtcaataaccaggcccagttttaactcattgtttttcaattgtaaaataagagtgttggacaaaataccttataggctccttctagctcttaggtgatttataaaggtttggggtgagggtaaactgggcggttaaagtctgtgtaatctgaaagccatgcaggggctctgacgggcttacccctgtccctgcagccaagtcctgacgtgctactttcccagggcttggttcttgcctgtttctcttgaggctgccttggcattcacccacgctcttggttgttattttttactctctgcccctgtgaaaatgcacctgctctcgtggcttcactggccactttctcaatcctggctgtcttctttatgttcttgttccctgtatcctatgggtctgtttctttctgactactcaccatgagggcaagagattccaaatatctacaaaattcctcacattcctgaagaaaccctcccagtctttccctagtgtcctgtctctgaggataccaccttgcttggtgagaactttcatagatctagcctcttcatttaccaactcctaccaggccacttttcttgtgaaatgtcccatatgcacattttgtgcattcaataaatagcttttgagttaggccaggcactgtattggacatggattaaacataaaataaagaaagcagatctcggccggacacagtggcgtatgcctgtagtcctagcactttgggaggccgaggcaggtgtatcacctaaggtcgggagttccagaccggcctggtcaacatggtgaaacccagcctctactggaaatgcaaaaaaattagccaggcatggtggtgggtgactgtagtctcggctgctcgggaggatgaggcaggggaattgcttgaaacccagaaggcgggggttgcggtgagccaagatcgtgccactgcactccagcctgggcgacagagcaagactccgtctc

SEQ ID NO: 1790 - DNA, 2439 bp, Homo sapiens
tttatggcaaggttcttttaaagccgtggatttccatgctgttcgtgcggcatggagatcacttcctaccgagagttaaggaggaaaaaaagatctctgagttttgaaagaagatttaaccaaaatgcatttgactcttctgtggatttttattggctgatttggaaggcaggtgccctgggcatccccagtgggttccaattctgcagctgcccagactcctgcaggcagaggtggaagtgtccccgctagaaaggcatccaggaaactcgcttttgaccaactcagatacagtctggtctttcttgttaactgggactttaccctctccactaatgaatagtgtttgtagtttccaggcaggtttttttcttcttttgaagttctttgaaacccttaggacgccaagggaaggaagttttcattttcagccctttacattcttcaaaatgtgatccaggcttttccctgtggcgagggtgtcccctagtgttgacttacattatttccacttgttttaaatgaactttgattaccttgacctgtgcacagaaatcaagagaggcagcccctttttagagctgttagaaaagaactgaaacatccacctctgggaaaaatagagtttagtttgtgcatgtgtctcagaagtcaggtgcacacattgagactggtgcagccacatgcctgccttttagggactccttgactgacctgatgccttcacccaaaggcatagtgaaatgggaagtatgatttctgactggtatgaagtggctgctttagagaaaagatcacattctttagtcctagaaaccaaaggtggcttcctgatgctcttattcagcacgtgcctgtctttgaggcaggactggcactggggtgggggcatggtttggggttaccttaaggaccctggatatttctcagataggactttttcttttctttttttgagacggagtcttactctgttgcctaggctggagtgcagtggcatgatctcagctcactgcaacctccgcctccccaaattggcgattctccttcctcagcctcacgagtagctgggattacaggcacccgccaccacacccagctaatttttgtatttttagtagagatggggtttcgctgtgttggcctggctggtctcaaactcctgacctcaagtgatctgcctacctcagcctcccagagtgctgggattataggcatgagccaccacacccggccctggactttttcttaattgaataaatatttatcaagttcttcacttctatttgacggttcctgggctcaacactggattagaaaatgaatgggacagagttcttcatctgagacatagggtggtccaggtagtaggaggaagaaggattgcagcgcagcagtcctcgggacaccaccagggggtgaacgaaggagggacgggggagctgtgcaggtgccccagctccttgggttgcacagggttgaagaccagacccaagaaatggggccttgaccagctcagcaaactgagaatggcctagatttcagcacactttcaccaggatttgtcaaatgaaggaagattccaagcgcaaaataccctagatttcaaccaataaaagcttgtctgaaaacttccaagatcgggttgtacaacttgacatttgaggaaacgctacttcagtagatggtgctgtggcattgttttctgaacaactgaaggaggagactccagagaagggtacctgctggagacctgtgtggtttgtggggtgggtttcttatatcactgaatctaaagtgggtgcctttcagaatgtgctttactaataatgtgttactctgcttttaattatacttctaataatttttcccaagagcctaattagcttacgatctcacagttggtaaagaattacaggatgtcattgcgtggatttctgtgggcagtcacccggagtggtatctaattagggaaaaggcagtatgtccctttctggaagtgtgttaactgaaaatacggtactaagcaactgctaaataaattagccctccttcctcctggccgtgcgcagaaacatccctgcagtatgttgcctatttgtcaaataagattagtgtaaatatggggcatttacctttgctatagaagctgaaattgccaggcacggtggcttacgcctgtaatcccagcactttggaaggccaaggctggtggattgcttgagcccaggagttaaagaccagcctgggcaacatggcaaaactctgcctctacaaaaataccaaaaatcagccaggcgtggtggtgcgtgtgtattcctagctacttgggaggctgacatgggaggattacctgagcccgggaggttgaggctgcagtgagccgtaatcgtgccactgcactcctacctggggagcagagtgagaccctgtctccat

SEQ ID NO: 1791 - DNA, 2133 bp, Homo sapiens
cgcgcgagaagctctaggacccagcagcggttgtcgggtttgggactggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaagggtccccttctgcttgttatagccccagtagtcctgtccaggttctagaagactccacctacttttccccagactttcagctctattctgggaggcatgaaacatctgctttgacggtggaggcaaccagtagcatcagggaaaaagttgttgaagatcctctttgtaacttccactccccaaacttcctgaggatctcagaggtggaaatgagaggttccgaggatgcggcagctggaacagtattgcagcggctgatccaggaacaactgcggtatggcaccccaaccgagaacatgaacttgctggccattcagcaccaggccacagggagtgcaggaccagcccatcctacaaacaacttttcttccacggaaaacctcactcaagaagacccacaaatggtctaccagtcagcacgccaagaaccgcagggtcaagaacaccaggtggacaatacggtgatggagaaacaggtccggtccacgcagcctcagcagaacagcgaggaactgcccacttacgaggaggccaaagcacagtcgcagttcttcagggggcagcagcagcagcaacagcagcagggggcggtgggccatggttactacatggcagggggcaccagtcagaagtcccgaactgaggggaggcccactgtgaaccgtgccaacagtggacaggcgcataaggacgaggcgctgaaggaactgaagcagggccacgtccgctcgctcagcgagagaatcatgcagctgtccctggagaggaatggggccaagcaacaccttcccggctcggggaatggaaagggcttcaaagtaggaggggggccctcccctgcccagcctgcaggtaaagtgctggaccctcggggtcctccacctgagtaccccttcaagaccaagcaaatgatgtccccagtcagcaagacccaggagcacggacttttttatggtgaccagcaccccgggatgctccacgagatggtcaagccctaccctgctcctcagcctgtgagaacagatgtggccgtcctgcggtaccagccaccccctgagtatggggtaacgagccgcccatgccaacttccgttcccatcaaccatgcagcagcacagcctcatgtccttccagacctctcttaccagcagccagctggctgaggaaaagaaggaagagaagacctggaaggggagcataggattgctgctggggaaggagcaccatgagcatgcctctgccccactgctgccacccccacccacctcagcactgtcctccatagcctccactacggcagccagcagtgcccacgccaagacaggcagcaaggacagcagcacacagactgacaagagtgccgagctcttctggcccagcatggcctcccttcccagccgcggccggctgagcacgacccctgctcacagccccgtcctgaaacacccagcggccaaagggaccgcagagaaactggagaactctcctggccatgggaagtcgcctgaccacagaggccgggtcagcagcttgctgcacaagcccgagttccctgatggagagatgatggaagtcctcatctaactgccatccctgtggaatttcagtacagaacactgacaaacaaggaaagcggcagagaaagaagaaagacctagaaggttgtagatgggaaatcaggaatgatttgaactgataaagatttcagactcataagaacacattttataaatgttaaacacaaaaactacatgactgaagatagaagagaatgcgatggattttattacacatggtggaagagagaagaggcgtgtaggtttgcaaacaaagttaagaaataggaaactgaatttttcattgtacagaaaatgtatctcttggggagggcctgtgtaccccccattctctgattataaacagataaaccc

SEQ ID NO: 1792 - DNA, 2429 bp, Homo sapiens
catctttaagaactgcagttactgaatacagcccctcatcagcgctgaggttggtccacttaacctttggtccacttaaccttgctatcaatgtgggctcagggaatgtgcctgccaggacaggaagacagccttgggctaccggctccacctggccagcgccctgttcccacagcaggaccagctccttcctaactgcttttgttttgtcctgggacagagcctggattttgggttaagtttgtgccttccaggctggggaagaagccaaaacttctgtttcccatgcaaaacgccaccacacacctagggaggatgtttgtgttccacggaggtcgccacccatctgttttcagagtaaacgtttgtgtgagcgcactctggcggggagtcccgagagcggaccctcttgccactgcacccataggtgcggaacgaacctgctgccccgaccctgcggctccgaccggggccgagcagcgaaggaccaccctggtctggtcacctacgattctgggtccagctcagctggtgaccttgcttaggccacacccctctctgagcctccatcttcccttcagcagctgtgtagggtgaacttaatgttgtgcaagatcatgtccagctctggaattttaggattatgagcttatttacgatcagcctgttgattctacctctaaaatataatctgaacccgtatactcccctccatgtctcctggtactccatgatcttgtcgcttcctgcccgagttctgcagtttagaataaacccaggcccctctccgcggaccctctgatggcagacctccatccctctgcacagggcctcacccacccagccacgtgctctgctgccagccccccggagcccctgggatctctgcacctgctgttttctccgtagagagctgccctccctccactcctggacgggctggctccttccttccttcccatctttcagagctcagcttcaagtgttggctccactgagaggccttacccccaagaccctttctaaaagaactgttcctccatcattccacctctcaccccatttttttcctatattttgtagctctttccttgggtggatctggttttgtgttagtctcttgtcacctccactaggcagggacctcccagggcagggacggacgcacctgtcccagtcatggctgatcagcgagagccaaacatatcatagcacatggggtactgtaggtgttcaaaggatgctggctgaatggatggagacttccttcatagagccccattttccttcctgatttcttagtctcagttcccattttctctcaaagatccaggggtcacaatgagagtgattataaaacaaactacacatgcaacacgaactcctcagtcaatcccaagagggctctcactccacacttcatcatctgccctgtgacctcagattaaaactcaggcttaacatttcctgaggccctgctcggtgccaggttctgggtctgtgctttccagttgttttatgtatccttgataacctctgtatggttggtggtaaaatggagagatgtattttcctgcggggaaactgagtcctgagaaacgagctagcccacagagagctggtggctggtagagcccggatccaaaattgggagcgtcttgccccaagtccagtgctgtttcctttatacccaatgccacagagccaaagtggtacctggccgagatctggccctgaatgtagaagaggccagggaaaggtggagggaagagggcataggtcccagtgtgggattccagatgacccctgttgtccagctggctaggagatatgtggaccccagggctgacagatgttcctgagggccacagggaacctgacggaaggttggtggcatttctagaggcaagtggtcagagagagcatgggggttttgtggggactgggaataaccgagggcctcgtggcaggctgggtggcactgccctctcaacgctgacctgtcagctggttcaggaaggcctttctgaggccagcacagactctatcacaccatggaccttcaagggatagctctcttggcaaaacacccttttgccagacctaattgccagaagctgcagtggaaatgagaacccaggatatgggacgagacagacctatgtgtggatctcagctctgccatttgctagctgtgtggccctgacagtcacctgccttgtgagctctgagttccttaagtgtaaaaatgccatggtatggtagagaggaaagagactcatatttgaatatgacacagaataggcccttagtgccagcctcgggggctcacacctgtaatcccagcactttgggaggccaaggcaggcaggttgctgaagcccaggagttcgagaccaccctggtcagtgtgatgaaactccgtctct

SEQ ID NO: 1793 - DNA, 1951 bp, Homo sapiens
gtttgattaatttgctggggggtgctcacagaactcagggaaacacatgtttacatttaccagtttgctccaaggatattgcaaaggacacagatgaagggctgcgtggggcagggcatggggaagatgtggagtcctgtgccctccctgggcacccccctccaagagcctctgcatgttccgccatccagaagctccctgaaccctgtcctcttggatttttatgggcgcttcttgatgtcagctttcttccccgctggtggggatggggccttctctgaggaggatcgtatgagcaacaggaaaggctggaggagagagatgttttgcctggcagctgaaaggcggacagaaaggacaggggaaggttggggaagttctgtttcctgaggcctgacgcacccgaccttctaacagaagactgtaacagggctgtggggtacacaagccaggtgccgtggaggaaagcctgtagatagatccacatcacggcaccaccacttctccccgtggttcacaggccctccccaagcatcccagggccctctgctgtgaaggcggctccccctgcctcgctacctgggcccccgctcccctgtgcagtgtgcttatttcagtgctggtctgacttgctcttcgtggtggtaagctccatgaaggcaggaccatgctcagggagtttcctgtccttcactgccccagggatgtggcaaatacttaatcagtgtttgcctatggagtgaacaggtccatgaatggtcttggaaaatgatgtatcccagcaccatggtggtggtcattcatacgtgttctcatgacttctttgcttttcctaatggtgagttcggtaggccaattcatttcttgctgaaaagtgtggtaaaggcaagtctcctaactggaccaagactacagcctgcagaacgcgcagggcctgggcatggggaagcacggatgaggagcctgctgctgatgctgagcaggagccgtggaggggtctacaccactctgctgactctgcgtgatgaggattcaaaatgccattcacgcaaaacaaatttagcaactaagaagtagagcggcgcgctgctttagaagcactatgtgttagcaggtgtggtacacacctgactttgcttctgtggctgaggaaggggaatgagtcttctgtgcgtaaatctttccacaagcaccatcctgggtgtcctgcctgaccagacttgtgagccagggccaggttgaagcatgtgcccaggtgaaaattatgcattatttattcatgtgagcaactctgcgcctattttgaaacattcactgctttgttttgtttgttttgtctaattgcatgaaagatgtggtaggcagaataatgccccccaacaaaaagtgtccacttcttaatccctggaacctgtgaatatgttaccttactagcaaaagggactttacagatatgactaaggctaaggaccttgagttgcagaaattatcctggaccatccaggcaggcctggagacatgagtcctctaaaaacagagactctttcccagctgtgctcagaaccagaggtgaccaccaaagagagatcagagccatgccatgtgaaaaggacttgacttgccattgctggctttccagatgatgaaggggcctcaagccaaggaatgtgggcagcttctagaagatggaaaaggcaaacaaatattctcccctagagctctgggaaggaacacagctctgccacctccttgattttcacccagtgaaattagttttggattcccaacctatagaactgtaaagtaacaaatttgtgttttaaggccaggtgtggtggctcacgcctgtaatctcagcactttggttttggaaggccgaggtgggagaatcatttgaggccaggagttcgaaaccagcttgggcaacatagtgagactccatctctacacc

SEQ ID NO: 1794 - DNA, 2265 bp, Homo sapiens
ggaacatggcggaccagatcccgctttacccggtgcgtagcgcagcggcggccgcagccaaccgcaaacgcgcggcctactacagcgccgcggggcccaggccgggagccgaccggcacagcagttgctgtggttggctgataaatatttgtcgaagaaagaaagagctgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtgatatcctgctcacagtttgtaccagcattgaaaataggctatctctacacctactgggctcctctgggatttgtcttggctgttactatgacacgggaagcaattgatgaatttcggcgttttcagcgtgacaaggaagtgaattcacaactatatagcaagcttacagtaagaggtaaagtgcaagttaagagttcagacatacaagttggagacctcatcatagtggaaaagaatcaaagaattccatcggacatggtgtttcttaggacttcagaaaaagcaggaccttttttctatcagtgcttatgtttatgctcagaaaccacaaatggacattcacagtttcgaaggcacatttaccagggaagacagtgacccgcccattcatgaaagtctcagcatagaaaatacattgtgggcaagcaccattgttgcatcaggttggtttgttggaccttgaactcaatcggctgacgaaagcgctatttttggctttagttgctctttccattgttatggtaaccttacaaggatttgtgggtccatggtaccgcaatctttttcggttccttctcctcttttcttacatcattcccataagtttgcgtgtgaacttggacatgggcaaagcggtgtatggatggatgatgatgaaagatgagaacatccctggcacggtcgttcggaccagcactatcccagaggaacttgggcgcctggtgtatttattgacagacaaaacaggaaccctcacccagaatgaaatgatatttaagcggctgcacctgggcaccgtgtcctatggcgccgacacgatggatgagatccagagccatgtcagggactcctactcacagatgcagtctcaagctggtggaaacaatactggttcaactccactaagaaaagcccaatcttcagctcccaaagttaggaaaagtgtcagtagtcgaatccatgaagccgtgaaagccatcgtgctgtgtcacaacgtgacccccgtgtatgagtctcgggccggcgttactgaggagactgagttcgcagaggctgaccaagacttcagtgatgagaatcgcacctaccaggcttccagcccggatgaggtcgctctggtgcagtggacagagagtgtgggcctcacgctggtcagcagggacctcacctccatgcagctgaagacccccagtggccaggtcctcagcttctgcattctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggtatgccaccatatacaccatgttcccagtgttctccttagtgctggaccaggacgtgaagccagagatggcgatgctctacccggagctgtacaaggacctcaccaagggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttggtaagttgccttggaattgttttttgaatcgttctctattcatgattttgaagtattttcttattgttgcttctgaatacattgtgttaagttgtg

SEQ ID NO: 1795 - DNA, 1882 bp, Homo sapiens
cttgtgatagtgagttctcatgagatttggttatttaaaagcgtacagcacctccccgctcactctctcttgctcctgcttccgccgtctaagatgccttactccctctttgctttctgccatgattggcagtttcttgaggcctctccagaagcagaagctgctgtgcttcctgtacagcctacaaaactgtaagccaattaaaactcttttctttataaattacccagtctcaggtatttctttatagcagcgtgagaatggattaatacaagtctcaggtatttcttttcttttttttgagatggagtctcactgtgtcgcccaggctggagtgcagtggtgtgatcttggctcactacaacctctgcctcccaggttcaagcaattctcatgcctcagcctcccaggtagctgggactacaggtgcccagcaccacgcctgactaactttttttgtatttctagtggagacagggtttcaccatgttggccaggctggtttggaactcctgacctcaggcgatctgcccgctttggcctcccacagtgctggggttacaggcatgagccaccgtgccatcaggtatttctttatagcagtgtgagaacggattaatactagcaccttttcatatacctgtttgccatttgtatgtcttcttttgagaaatgtctattcaaatcttttattaattttaaattggattattagatttttttcctattgagttgtttgagctccttatattttttttgtgaattattctttgtcagatggaaaacttgcagatatttattttcttccactctgtaggttgtctcttcactttgttgattgtttcctttgctgtgtagaagcgttttaacttgatgtgatcccatttgtccatttttgctttggttccctgtgcttgttgggtattactcgagaaatctttacccagtgcaatgtcctggagagctttctcagtgttttctttagtagtttcatgtttgaggtcatagatttaagtctatgatccattttgatttgatttttgcatatgtcaaaaaataggggtctagtttcattcttctgcatatagatgtccagttttcttggcattgtttattgaagtgactgttatttccccagtgtatgaatgttcttggcacctttgttgaaattgaattcactgtagatgtatgaagttgtttttgggctctttattatgttccatcggtctacgtaacttgttatgctagtaccttgttgttttggttactatagctctataatacgatttgaagtcagataatgggattcctccaattttgttctttttgcttaggatagctttggctactctagatcttttgtggttctgtttaaattttagaattgttttttctgtttctgtgaagaatgtcattggtattttgataggaattgcattgaatctgtagattgctttgagtagtatgaacattttaacaatattgcttcttctaatctcactgtgtcgcccaggctggagtgcagtggctccatctcagctcgctgcaacctctgccttatgggttcaggcgattctcccacctcagcctcccgagtggctgcaactgcaggcgcatgccaccgtgcccggctaatttttgtatttttagtagagatggggtttcaccatgttggccaggctggtctcgaattcctgacctcaggtgatctgcccacctcggcctcccatagtgctataattaacagtatgagccatcaagccctgccgtatttcattgtatgaacatattacagttcatttatccattcacttgttgaagaacatcttggttgcttacaagatttggcaattatgaataaagctgctataaacatctgtgc

SEQ ID NO: 1796 - DNA, 2454 bp, Homo sapiens
aaagtggtgagtattggcctctttttcttccctctgagtgttctgccttttactgagcaggagggagcaggcttcctgggtatgtggcgagcatactgccaggtggccatgggccgtgtgcgcggcctggcgagcacatgcctgtctgagggggcggcacagctatgcccagcagaatggcaccacaggagaacacaggtcctttctcaagaggagctgggattccagcttctcctgtgaaatctctttatttttaaagctgacaacgcattgtttttttattgggtcaacaaatcccacccacgcattagtgatccctagaaagggagctcccaccggtggccaccggagggtcatgccgtttcaggtgcttctcaccttctgacccagagctgcctgccctaggtctaggagtttcagagtgagccactcgggtagcagagctgtcagggtgcccactcccttcctttccaggccctgagcaagtatgttgacgtggacaagactgcctgcctgtggccctctcaccagaggtggaacaggcctggcagggccctgactgtgtcatccttgttctctggcaggtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcttgctgaaatattactgcttgaatctggagcagattgcgggtttataaaactgctttttatctgagaacaaacgggtttggaaattagtcgtcttttttccccactcccagagctgctcaagtcattccaccggccccctcggcttgggacagggtagtgtaactcccgatcccagggcctagccctgacacaggtggcttcccgtatcccggtgggaaaacgccctgccaccagcgggcttgagctggcctgtgtccctccaccgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggccaacctccccagcactggtatctgagtaacggctaagaacctccttcctctggctttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgtaggtgcttctgggcacccatcctctgcgtttcatttgcagtcgactgtacagaaggcactcaccacaataaacctttcctgaaagcaaaaaaaag

SEQ ID NO: 1797 - DNA, 1733 bp, Homo sapiens
atggccaaggccgggcggccgccttgcccccgcttcctttcacgctgtcgctgcccgtaggtggttgtggccactgtgcccggagggaggcggcggtggccagtaatgcctgggaaactcctctggggggacattatggagctggaagcacccttggaggagtccgagagccagaagaaggagaggcaaaagttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataat

SEQ ID NO: 1798 - DNA, 1998 bp, Homo sapiens
ttttgtgctaaaaatataccatataaaaaagtgaaaagacaagcaacataatgggagaaaatatttgcatatcagatacttcaaaatatgaaaaggactcttacaactcaatgataaaaataaccaattaaaaatgggttaacagattgtaatagacatttcttcaaagaaaatatgtgttttagtatgcttgggttgctataacatactaccatagactgattgtcttaaataacatttatttctcacagtcctggagactgggaaatctgagagcaagacgccagcagattcaatgccttgtgagggcccactttatggtttgcagatggctaccttgtggctgtgtcctcagcaaagacagaaagggatctggtctcggccaggcgcggtggctcacgcctgtaatcccagcactttgggaggccgtggcgggcggatcaggaggtcaggagatcgcaaccatcctggctaacacggtgaaaccccatctctactaaaaaaaatacaaaaaaattagcagggcatggtggcaggtgcctgtagtcccagctagtcgggaggctgaggcaggagaatggcgtgaacccaggaggcggagcttgcagtgagcagagattgagccactgcactccagcctgggtgactgagcgagattctgtctcaaaaaaaagaaagggatccggtctcttccccttcttataagggcattataatttcattatgaatgcctactcttgtgacttcatctaaaccaatttacctctcaaaggccccacctccatatgccatcacattggggattagggcttcagcatatgagtttggagaggacacaaacattcagcttatagcaatatgcaactggctagcaagcacagggaaagatgctcaagcactactattcattagggaaatgcaaatcaagaccacaatgagataccacttcatacccactagaatagctatatcaaaaagccaaacaataacaagtgttggtgaggaaatgaagaaattggaacactcatacattgctgatggggatgtaaattgatgcaacctcattgaaaaacagcttggcagtttctccaaatgttaaacatagaatttccacatgacttagcaattccatccctaggtatatacccaagagaattggaaacaggtgttcaaacaaaagcgtgaacatgaatgtttaaagtggcattactcataatagccaaaaagtggaaatgacccaaatgtccatccactgaggaatggataaacaaactttgatatatgcatacagtagggtattatttagccataaaaatggataaaatactgatacatgtaacattgatgaaccttgaaaatatgctaagtgaaaggagccaatcacaaaagaccacatattgtatgatttaatttatatgaaatgtcccaaacaggcaaatctataaaggtagaaagcagattagtggttgtcaaggctgggggctcaggggcaataggcatggggtttcttttggggatgatgaaaatattataaaattagattgtcatcctggttgtccaactctgaatgtactggaaaccattgaagtatacattttaaatgggtgtgctaaatggtatatgaattatttctcaataagtgtgtttttttaaaaaagctattgattatttccatcagtctcattcctcttgacaaaaatctgagttgatggtgagcatgtacttcattcctgactccaaagggtacaatatttacaatatttgaatttgggagtgactttactattacaaccttccccttggagacctggaagacccagcaacataaggacaaacagtagtctcagccttgtactaagacttcagcaaaaataagagagatgggagggactactattgggaaggaggggcaatatttctaggcaaatattgtggtagaatggataagagcttcggctcattgggcaaataaaccaagttttaaatcctgattctacc

SEQ ID NO: 1799 - DNA, 2483 bp, Homo sapiens
ctttgcagatgtttgggaggaccacacccagtcctgagggaggcagcagacagacatggatggagtgctggtgctcggtagagttgaagaggggatgggagccagatgtggctacagcactttcatctgtggggcccggcctcagacccacaacagtcccagccccaagaaagtgctgcatgcagccaggctcgatggctcacgcctgtaattctagtactttggaggccgaggcgggcagattgcctgagctcaggagtttgagaccagcctgggcaacacggtgaaaccccatctctactaaagtacaaaaaattagccaggcgtggcggcatgcgcctgtagtcccagctactcgggaggctgaggcaggagaatcgcttgaacccgggaggcagagtttgcagtgagctgagatcacgccactgcactccaacctggtgacagagcaagactccatttcaaaaaaaaaaaaaaaaaaaagtgcagcatgcagtgtctggagggcagcagcagggggcattcggtctcccatccctcttgttctgggcaccaagcgtaagctgccgtcacctcttcaccagccctaaatatgggtgcccctctcccacagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtaagtggcttctctggggagagtcctctggggggcaggacctctcgtcagccctgccagccacctgccaggcccagggctgccctgctttatgacgaggccatgtgaagcactgcgatgcagtcccccaggcccctgccacaaccctcagccaccctatagctgttgaatgggataccattcaccagggctgccagggagttgaaggtttggcgggcttccatggtgtgattgccaccctaaacccttgaggaaggacaaaatgcacaaacagctttgtcctcgctggcgcagggctgttcatgtgtgcaccagcccccttcttcctgagtgccgtctgtgcctcacattccgtgtggtctatggggcagtggggcagctccctcaggcccctttgcaccaagagtggcagtctgggttctgctgggggcggtgacctcgatacccagcaaggcccagggctcctgctgcaccccaggcactgggcagagagcaccacaaaggcagcagcgtgtgtcctcgccaacagtccgcatcccaggtgctgcattcgtgcccttttgggggaaggtaagatagaagtttacagaatttaagcatctgtggggccaggcgtggtggctcacacctataatcacagtactttgggaggctgaggtaggaggatcacttgagtccaggaggctggggctgtagtgagctatgattgtgccactgcactccagcctgagagacagaacaagaccctgtctccaaaagaaaaagaccataagcatctggagcacctgcaagagcctgtgcatgggctcggcgtgactgagagtcctccgccttgcccgagcatcaggcaggccctcccaagacccctcaagatgctagaatgggactttctgcaaagtttaaacatctgtacaggatttagcttctttggtggcgaacttggattgtgatgccctcaggaagtctggtttcactctttctgtcactgtacgtcagcattcatgaaggacttgtattttctctgccttgtgaggtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaccg

SEQ ID NO: 1800 - DNA, 2267 bp, Homo sapiens
tttcctctcattgcttacctctgtgtttctggggaagtgcatggtggagtggcgtggattatggaccctgaaaccaggctgtggctttaccactcaccagctgtgtaacattgggcataatgcataagcccccagtgctccatttctgcctttgtatgaggaggataacagtaacagtgcctgcctcaccaggcctattgtggcctattgtgaggattatcccagtcactatatgtaaagcactcagaacaggggctggcatgcatacgggaagctcgcaccataagcatttgctcttgtggtccagtcccagttgctgggggcccagacttgcctgcctcccagtggtgtggaaacaggtcttcatggcaaggatgtctcccacttcagtcctttattcaccctataccgctgtcaccgtctccttgggtccctctctgcagattgaacagtttgtgtactcatcaccccatgacaacaagtcatgggagatgtttgaagagatgattaccaccgcagaggagttctaccagtccctggggattccttaccacattgtgaatattgtctcaggtatgggacccagcctcttctcagcctccctttcctgtaatcccagacgccacccttaccagctgagctgccacacagagaaacagctcacaattcaactcattgcccacattaattaaaatattacactcttctcacttgggagtatttggtgttaagaatatctgggtgtgatttcacctctggagacaggacatgaattaaagaattcttcaggcttgctaaaggttagccttctgaaataccatccctccttcatgaattctaggggtttttccttacaggttctttgaatcatgctgccagtaagaagcttgacctggaggcctggtttccgggctcaggagccttccgtgagttggtctcctgttctaatttcacggattaccaggctcgccggcttcgaatccgatatgggcaaaccaagaagatgatggacaaggtagatggcccccagggaggtgggaagcagagtcttcagtacacggcccgtccgaattatttctcagcctttggggtgcactggtccccagcatcatgggaaaatctgagcttctcaatctagactaaaaagggaatctgaaaatgccttctactgagtcaggactgagttcttttagctagaaacctgaatctagctctcttctataaggtaattctagcttttctctttctggctttgtttttcttaactccagagaaagaataatctccatttatctacacagaacaagttggaggcttccctcttctcacccaagaaggtctgggttgtaagctgctctcttcaaacccaattttcaggccctactcttttccaagtcaggagcttgaaaggggtgaaaaggaaaggccacaatagtagtttcttccttccctcaaagggcccaactcctcagaataccagaagctaccacttgtcactcatcgaaacatgagggatctttctgcagttatctaataggcaataaataccaaataattcaaatttagaaaaaagttgctaaggggtagaacccatcattttgatttggacagttgtggttggggaagtctggttgaatggatggttcctggccgtcagtaagacccgatgagagttgagcccgacttcccctctgggaccctgtcttcccaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttg

SEQ ID NO: 1801 - DNA, 2424 bp, Homo sapiens
agaaaggagggcaggaagcccacggcccacaggggtgtagcccgagacccacctgcagcccccagcccttgccaggaaagcagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcaatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggatggctggctgccgcctggcctccaaaggccgcaccatggccgacagcagctacaccagcgaggtgcagcccatcctggccttcctcagcctgcggcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagt

SEQ ID NO: 1802 - DNA, 2167 bp, Homo sapiens
aacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctgggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatat

SEQ ID NO: 1803 - DNA, 1621 bp, Homo sapiens
aactctgggagacgagcccagcacaggaagtcgccggcgtttccattcggtgatcaccactgaacacagaggactcaccatggagtttgggctgaactgggttgtcctcgctgctcttttaagaggtgtccagtgtcaggtgcaattggtggaatctgggggaggcgtggtccagcctgggacgtccttgagactctcctgtgtagtctctggattcaccttcactaattttcctatgcactggctccgccaggctccaggcaagggactggagtgggtggcagttttctcatctgatgcgaacgatgaattctatgtagactccgtgaagggccgattcaccatctccagagacattttcagcaataccctatatttacacatgaccaacctgcgacctgaggacacggctatctatttctgtgcgagggaggcatactttgatactagtggtgactactccagagcttttgacttctggggccagggaaccctcgtcaccgtgtcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtctctgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgtggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaagc

SEQ ID NO: 1804 - DNA, 2290 bp, Homo sapiens
taatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactaattaaagaacatgatctcttctttaaagcagtcagtctctgtcacactgtacagattagcaatgttcaaactgactgcactggtgatggtccctggcaatccaacctggcaccatcgcagttggagtactatgcatcttcaccagatgaaaaggctctagtagaagctgctgcaaggattggtattgtgtttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggccttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgtgctgtttcccggaaggagaagcagcgtgtgcatctgttggaagaatgctggaacgagttataggaagatgtagtccaacccacatcagcaggtgtgaaatctctctaagtagcctttgctgcagatgagtatcctatctggaacaggatgaacctgccgctctagatacctaataaatcagcagctggttttaccaactg

SEQ ID NO: 1805 - DNA, 2294 bp, Homo sapiens
cccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaagctgctcaagaagccagaaaaaggagatgaaaaagaattggacaaaggagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatggtaagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagc

SEQ ID NO: 1806 - DNA, 2488 bp, Homo sapiens
aaaaaaaagctaaagcagaaaacaaaagtggcccatggtcttagcttccagataataactattgatttcaaaaaataaaatggcctgggattacaggcatgagctgctgcgcccggccaatttttgtatttttagtagagatgaggtttcaccatgttggccaggctggtctcgaattcctgacctcaggtgatccaccctcctcggcctgagccaccgtgcccagccgtgactgtttcttctaatttatcacttttaaagtctcatttaactttttttccatacagaagatttaaatttttatggagttgactttatgaacctttttcttgatgacttttgtttttttgccctgacctggccactccacgtcactcactgctgacaccagtgcggcacccctgcctgggccatgtggaccccactgggaacgccaaatgtaggcacctcagggctccagcaagccacgagaatcccccatgtccttgacagagctaaatcctgtgtccctggggctgctttatgtttgttgagtggtgttagactcggtcaggtgggctgggtggtgaggctgaaggcgagtgtgggaggaagggagggggtacagagtgcggggcacatgaaccccaatgaggaggtgtttgttaaatgccaggggggcactgagctaaaatggccttgggcccttcctcagctgatgctgaaggggataaggatagagactcgggccggacaggctattctctttctgggtatgattttgaacctgcctgtttttgttctgtaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggtttcctcacctccaccatacacggcctatgctgcaccggcccctgagcaggcttatggctatgggccatacggtggtgcgtacccgccaggaactcaagttgtctacgctgcgaatgggcaggcgtatgccgtgccctaccagtacccatatgcaggactttatggacagcagcctgctaaccaagtcatcattcgagagcgctatcgagacaacgacagcgacctggcactgggcatgctggcaggagcagccacgggcatggccttagggtctctattttgggtcttctaggggcctcaaggtcttgatgtgcatagcttctgataaccctgtgtgcaataatatgatttgcagggcatttctgtttgtgacaaaagtttttaataatagttttaatcattcctttgaaagtagtgatgtcataattgtactaatccacataagtaccacagagaagggtttgaactgtgctattttgttcaaatgttgactctccgggggcactggctcattccaagactgttcttgtgcaactctcagaataccttatttgagcatacctgttttgaaaggcattttctttttagagttaggtgtagtgcttaagggttaatttattttcatgttatgccagtaatatagtgttgtatgcctattgagtgattgtggcaagaaaagctacagcttctttgcgtttaactttttcaaaccacagaccagaactggttgcatgttactttaggagttgtgggttggtaagctcccaggtacttcccgaggctatggtgtgagagcccccgtcctgccctctggggctccacaggcccctggcaaggccgatggctcaggatgatggggcacagcccgcctttgaacaatcatgcttcagaaatctgcctgaccctagctgctgctgctgctcactttattcttgtatggctttggtaggcatacttggagaacatatcccacattaggaattgatttaagcctgagagtttgagggctttaatcctttaaaacttggagaagctggctgggcgcggtggctcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccgggaggcggagcttgcagtgagccaagatagtgccactgcacttcagcctgggtgacagagtgagactctgtctc

SEQ ID NO: 1807 - DNA, 2251 bp, Homo sapiens
tcattataaaccagaaggaggaaatcccaccccatttcacagcagagaaaacaaccgagagagattaaatgatgagctgctgtcacatagccagtcagcagtcttgcaagaattgttgctgactccaaagcttgtgctctttcccagcccaagaacttgggggctctgtcaggaaagttggcctcccttgtgtgtcttcaggggtggggagacgatggtcagactgggccagggagtaggtgctgcccggacccgagcctaccctcccttctcctccccagtgcgtatcacggccacctgagctccctgattgacatcagtccctacaagttccgcaacctggatggccagaaggagtgggtccacgtggtatgcactgcccaactcaacaacaggtcggtgcctgtccccaagcccggataacatggcgctgtcactccccacaggcacctctcccagacacctaccggggcccctaccgggaggaccaccccaacccagctatggcctatgccaacgaggtgaaacgtgtggtcagcagtgcacaggagaagggcaggaagattgcagccttcttcgctgagtctctgcccagtgtgggagggcagatcattccccctgctggctacttctcccaagtggcagagcacatccgcaaggccggaggggtctttgttgcagatgagatccaggttggctttggccgggtaggcaagcacttctgggccttccagctccagggaaaagacttcgtccctgacatcgtcaccatgggcaagtccattggcaacggccaccctgttgcctgcgtggccgcaacccagcctgtggcgagggcatttgaagccaccggcgttgagtacttcaacacgtttgggggcagcccagtgtcctgcgctgtggggctggccgtcctgaatgtcttggagaaggagcagctccaggatcatgccaccagtgtaggcagcttcctgatgcagctcctcgggcagcaaaaaaatcaaacatcccatcgtcggggatgtcaggggtgttgggctcttcattggtgtggatctgatcaaagatgaggccacaaggacaccagcaactgaagaggctgcctacttggtatcaaggctgaaggagaactacgttttgctgagcactgatggccctgggaggaacatcctgaagtttaagcccccaatgtgcttcagcctggacaatgcacggcaggtggtggcaaagctggatgccattctgactgacatggaagagaaggtgagaagttgtgaaacgctgaggctccagccctaagccagccctgctctgcctaagtgtactccaggtgagtgggccttgcttcttactcttgaagatgcacagcgggttccttaccatcagcagcaagcagcctcggcaagctgagcctttttttaagacttttttttgttctgactgatgctccttcccaaaggttagtttcttcaacactggaaattctccaatgcttagcttgcacttgatggcaggaacagctatatcctcccttgaaacctatggggctgtatccacgtggaaccccaacccacccttgcctcttgtaaccacctagtcttatgccctaaataccagacctggagttgggctccaatccagccaataaacatcccctgccagagcaggcttttcttcaccagccaggaggagcactattgtgccccaattcagacggccctggcactgccctagtgtgtaaagaatcccattttttcattcatcagccaagaaggttggtgttccaaggtgtcccaggaggggacatgcctgctggggatgtaagccctcatcactgccccatcctcactccccataggcctctcattcctttctttgaaggggggctcagccctaggcagggcagtccttaaaggatacccccacaactgggcctgcagctggaagagcctgctgcaggagaaagccccaagtccagggcacctggcacccccccccgcctccctcgaccctgagcaagaggtctcacacagcatatcccacactcacccaggcttgggggtttttaaattttatttcaaaagcttggatagcttcaatatccaggttgtggcaaaatcaggacacgtgtaaaataccttacaatacattagattcccaaaaggtaccaaaaagtacagtaaaattaacactttcgttacaggaaatgtatgacgcaaataatataaaattaaaaggtgaaaaaaaggtg

SEQ ID NO: 1808 - DNA, 2093 bp, Homo sapiens
acagatgggagcagagaagccggtctttctagcatttctctccctcttttccactagtcctcagtaaaacagccttgccagaaccagatgtcttttttctgcagatatttactgttatgacttgggaggcagcaggttctggactgttgccctcacctagaccgccccccccccttgtcagatgccacccgttttctcagacccgtcggtctcccagaccacattgctttgtgagcagatgcctgtcagggacagctctatcagaacagaccgagtccagcccagtgagccgtgatgttctctcactgctcggtcccccctctgccatctacagcgacataggttgggtctgttcccctggcagacagcaggccttcagagccctgccagaatctcttgtgtctcccctagcacacacacatccctccccacccaccaccgccaggcctggatagccctagttctctcccatttcttggtgtcagggtgttcagaccttttaagcagatgaatgctaactcattcaaggcttttaaaacccagtgccttagcagggtacagtggcacacacctgtagttacagctgtgtgggaggattgcaggagttcctgtctagcctgggcaacatagcaagacctccttgtcttttaaaagaaaattaaaaaaaaaaaagtgccctaaactgaatccagccctgcagatgtagctgggccaggacagaacagagggtaaccactgccttcccaagcaagcaatggaaactggcagctgcagtgtcttcatcacgcgatggggtgggaatgctgccccttatctgggcacaaggaatagtgtcatctgtgcaccttaaagttgcacaaaagctttcctagtagcgacatctcatccttgtcaaacttgaaattatctaaaaaccacaagtctcttcataggaactgtttgcaagtcagcagttccccattttgtactgcatgaaatgcacccttgagcctaaatatctggcttgcatttgccctggtacatttaactggcgtggtgaagtaggaggagcaaaggcgtcggaatctaacagtgctgtatgattcttgcttctttaagcttcggtttccttgggtttaaaacagggttcctaggaagctgagatggaaaaaggtggctgccgcctggctccattccaagttgctgctctcgttctgtagctagcccaggtttccgggttccgtattaaccctgtgaccatctcaacccttgacactgtcgataggaagctggtcgttctctcagctgggcctttacttaagtcctggacaaacaagttgaccaagggcaggcagagactgctacagggtgccacatagtgtatgcagtgcacaaatggttctatttttggtgggtcggtgttgccagcgagctgaccctgaccaggtgtggaggggagtgggtggggggctgtggaaatgtggccaggtccctacccctatcggcagaggctccatcctgcccttcctctcagccacaggtgcaggatggtagatgggaacttgccagaaggatgcgaccctatttaagtagttgtgttttcttccagcccagcatccccaccaaaacaggaaaagaagtgctctcgtgcagggcttgttcacagtgagcctggctggctcctcatgatctctgagtttaaaatgtgccagcagatgattttaacgatcccatcaaaaattgttgtctggatcagtttcgagctagcgtttccttgcagaggccattcttccttttttgacaaaagttgggtcggccaggtgcagtggctcatacttgtaatcccagcacttcgggaggctgaggcaggtggatcacctgaggtcagaagttcaagaccagcctggccaacatggcaaaaccctgtctctactaaaaataaaaaataaaaataaaaataaaaaaaagccggacgtggtggtgggcacctgtaatcccagctactggggaggctgaggcaggagaatcacttgaacccaggaggcagaggttgcagtgagccaagattgcaccattgcactccagcctgggcgacaagagcgaaactccgtctc

SEQ ID NO: 1809 - DNA, 1828 bp, Homo sapiens
ttgtattttcactgactcatatttcctttactcaggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattagaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtctccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgagcgatgagaatgtgcagcaggtgctagaggagcttcgagggtactgcacggatgtgtctgcggactttgcacaggctgccatctttgccataggtggcattgccaggacttacacagatcaatgtgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgcttcgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataac

SEQ ID NO: 1810 - DNA, 2025 bp, Homo sapiens
tatttttaattaatttattttttgagatggagttttgctgtgtcaccaggctggagtgcagtggtaggatctcggctcactgcaacttccgcatccctggttcaaaggattctcctgcttcggcctcccgagtagctgggagtacaggcacatgccaccacgcccagctaagttttgtatttttagtagacgtggggtttcaccatgttggtcaagctggtcttgaactcctgacttcaggtgatccagccgcctcggcctcccaaaatgttgggattataggtgtgagccaccgtgcccggcctggagatgttttgatctcttaagttgacctaactaaagggagtggtggggctggtgggagttgaatcagtacaactctacaaggagatggtcttgaccctgaatcacactctgcctctttcctcttgggtcctctgagcacaatgcccaacagcagactccccgctctggcccccaggagaggaaaatgggtgagggtcccagttccactgtgtctgcgcctctcagaggcagaggtgacactggtggcagaggttgttgtcccctttgttcttctctctttagatttcagcttaaattttatgacagttaaatgtgcacgtgatggaaggagccagtgcctttgacactggatgaagggtagccgtggctggcatccccgtttctgctcccctcgtggccactgtggattgggtcaggtgcccatggattctgctgctgcgcctttaaatcatggctcacgtgctgccccggccttcctgctccagccggcctgttgaccgtccactatggaaggtgaccgggggtgattgagctctctcgagggcctcgttatacaggcgtggttttcatcctaaccccaacatgattctgtgccgattttgtaagatcaggggtcagttttcacactattttgagtgggtgagcagtgctgcgaagcaactgcctccacagctcccgtcaccatgtgcctgcctgccctacccctccttctgtggtgtggtgccttccacccacacctcacagtggcccagcttcgtttgtgattagctgagggttgggatagacataataaagtgaaaattgatgattgatcttaccaaaatttctcatcgaaattggaagcattaatactatttgttagtgggtctagtgatcgtttggttttagctccattgagtgcttaagtttattgcttataagtgtacacggtttccaccagtttttcccacagttatctgtattttaatattaataatgaggctatcttctagcatttttcatttagttccttagaaaaatataattctaatggtatagctaccaacattttgttaaggagataacctattcagatttggtcaaatttcctatatgttctacgttagggacatgcattttcttcacaaggggtggaaataagggttggtgtccccagagtgacaggagtcagctctttgctctgctgactggtgctgactgatggtagctcaccccatcccaattcctgtcgtttgctttgggaacatcccaggtgggcagtgtgggctccagactaggtcaggcctgtggagccgggctctgtgttcaatgctggcatttatgtgcgtgcttgtggtcttgctgaccacatgtcaagctattctgtctacattcaagacaggagcaagggggaaggtgaagtgccagggtctcctgctcctttttcaagaaaatgataggccgggcgcggtggctcacgcctgtaatcctagcactttgggaggccgaggcgggcggatcgcgaggtcaggagatcgagaccatcttggctaacacggtgaagccccgtttctactaaaaatagaaaaaattggccgggcgtgttggcgggcgcctgtggtcccagctacttgggaggctgaggcaggagaatggcatgggcctgggaggcggagcttgcagtgagctgagatcgcgccactgcactccaacctgggagacacagcgagactccgtctc

SEQ ID NO: 1811 - DNA, 1901 bp, Homo sapiens
gttctgtttagcatgtatgagggtgaacttagcttgctactcacacactactcaccctgtggaggaagttcgcctcgcttttgtggtgagtcttgctgtaatgatagcttatatttacaaataccgtcggcagtgcagggtcttcaggcttgcagaaaacggtcaagtcattactttgagaaatgtacaaacatctatgcttaatgaggtgctaaaagacaaaactcatctacaacctccttccccccaaactgccaacactctggattaacttaaaagctgctctctgggcaggttgcatcccagggctcctccttcacacgtggtggggccccaccttcgctttacctctagcgtcccagccctcgtggtcatctggaaccagggttggtacacagggcctgctggcattcctgtgatactccgtgatattctggaggaatccatcccttccctggggctccatcccactgccccagcaccgccagccaccctgattcagggacatcgcagagattggtgtttgacgctacggcagcagaggcgcagactcttgagtgttggagggtgtctggagggcctggggacaagcaccgcctgcactcccgggagctcggccccgccccaccatggctcttggtgcaggtgcactggaaggaactgggtggggcccttgtgccgaagggcggagatggcgccggcctgcctcacgggcaggggtccgtgtggcacctgtggccggcagcgggtgggtccaggagccgccatcatttggagcgggtatcgtcctcactgactctctgtgggtgcgggtggggtgtgtgacgggagctccgggcctggctgacagtgtctctcctctgcagcgggctgacgcacgaggcacacaggaaggaggtggagcaggtgtatctgcgctgtgcggcgggtgccgtggagtggatgtacccaacaggtgctctcatcgttaacctgcggcccaacaccttctcgcctgcccggcacctgaccgtgtgcatcaggtccttcacggactcctcgggggccaatatttatttggaaaaaactggagaactgagactgctggtaccggacggggacggcaggcccggccgggtgcagtgttttggcctggagcagggcggcctgttcgtggaggccacgccgcagcaggatatcggccggaggaccacaggcttccagtacgagctggttaggaggcacagggcgtcggacctgcacgagctgtctgcgccgtgccgtccctgcagtgacaccgaggtgctcctagccgtctgcaccagcgacttcgccgttcgaggctccatccagcaagttacccacgagcctgagcggcaggactcagccatccacctgcgcgtgagcagactctatcggcagaaaagcagggtcttcgagccggtgcccgagggtgacggccactggcaggggcgcgtcaggacgctgctggagtgtggcgtgcggccggggcatggcgacttcctcttcactggccacatgcacttcggggaggcgcggctcggctgtgccccacgcttcaaggacttccagaggatgtacagggatgcccaggagagggggctgaacccttgtgaggttggcacggactgactccgtgggccgctgcccttcctctcctgatgagtcacaggctgcggtgggcgctgcggtcctggtggggccgtgcggtgagggccgcgcgctgggagccgcatgccctgggcccaggcctgaccctggtaccgaagctgtggacgttctcgccacactcaaccccatgagcttccagccaaggatgccctggccgattggaaatgctgtaaaatgcaaactaagttattatatttttttttggtaaaaaagaaatgtccataggaaac

SEQ ID NO: 1812 - DNA, 2247 bp, Homo sapiens
cttatttataagggatgatgttttaattatatccatgtactaatgtgcaccagtaggtacacacttacttactaatgtttcctaagattcagccattgaaaattaactttccatttgattgatttacttaattcagaatgtggtaatatcctgaccaagattttcaatgttttatgaccatgagccatagtaagaaatacatctttcatcatcaccaggatgaaaatattttgtgcatgtagatgtgtatgagtacctttagtaggcatttcatataatggcacctttcctgtttgtcacgatgctatgataatttctattctggttctttttcctaaatgctttttagaaggtttcagatttattttacagctcactaagagtctgtagtgtttattttgaaaatgggtataaaggtctgtttctttacatcatattttttctgctatctgttttcaatgagacagtccaataacttcacatggaaccaatcagggcatgaccccttaggcgttcttttcatcccaggtgatcttaccaactttcattgtctcatcaggatcatccccctttgtgtatttctgtcaggtccagcctttcagattcccatcaaaactgaaggtttctgatccttttctatttcaggtaaccaagttattgttcatatcagtacagacaaatgagattatacatgttctgcaaaaattcttgtacaggaatactctgaaaatgtagacataaatactcctaggtatttgatatttagtattgtgaagagcttaaccaattgcaaagtttaaagtgacagctcacagaagactgctgtcactgcataccaatgacaaattcagtggtttccccaaattattttcatgttccatattcttaaaattatgggtttttataggggaaagatgcatattacaattaggagaaaaatcaagtaagacagagtccagggaagtatcaaatgagaactttttattgtactctccccatgaaatcaggatgcattacatccccaagattaaggtgtgacattagacgggaggagagcctatcagggaagctttcctgagccctggtattcagagtaatcgttgtctgttaattacatagccattattggttgatttctttcccgtatgagtagtctcagtctcctggttgactgattccacatgacctaaagcctcaccataaatcacattgttggtctttctcacatagtgagcaccacattctcctcataggtgtggccacccataatcctaaatcgtagaattacaccgtccagagtgacttactagacctactacctccaggcaaacaaagacactctcctagggcatgacattttaaggactgagagattgcctctcagatgctgaggacatcacccaggcctctttgtgacttaggataatttctttacttcataaggatatacaatacaaactaaaatatacaaagttttgacgatgttatggcttctccttaaagttcacatttgattcatatttcactgtttacataatttattagttacataatttaccatgcaaggttttatttctaccaagtatttcacatatgacacgtggtgtggttctgaattggtctcatgcaaaccagagtccatagtgtacctggaaaacacattggctgggcacagtggctcaggcctgtaatcccagcactttgggaggccgaaatgggagtatcacttgtggccaggagttcaagaccagccttggcaacatggcgagaccttgtctctacaaaaagtgtaaagattggctggttatggtggtatgtgcctgtagtcctagctgctcgggaggcgggggtgggaggatcacttgagcccgggaggtcaaggctgcagcgagccatgattgtgtccctgcactccagcctgggtgacggagggagacactctctttaaaaaaggaaaatacagggctgggcgcggtggcttacgcctgtggtcccagcactttgggaggctgaggagggcggatcgcgaggtcgggagatcgagaccgtcctggctggcacggtgaagacccgtctgtactaggaatgcaaagggttggctgggcgtggtggcgggcgcctgtggtcccggctgctgaggaggctgaggcgggagaatggtgtgaacagcccgggaggtggagcttgcagtgagcggagatcgcgccactgcactccggcctgggggacagagcgagactccatctc

SEQ ID NO: 1813 - DNA, 3381 bp, Homo sapiens
aagaccttcgtgttgggcctccttcatcagggctaccactctctggacaggaaggatgtagccatcctggactacattcacaacggcctgaagctgattatgagctgtccgtcggtgctggatctctttagcctcctgcaggtagaggtgttacggatggtgtgtgagaggccggagccgcagctctgtgcccgactgagcgaccttctgaccgactttgtgcaatgcatccccaaggggaaattgtccatcacgttctgtcaacagctggttcgaacgataggccatttccagtgcgtgtccacccaggaaagagagctgcgggaatatgtctcccaggtgacaaaagtgagtaacttgctgcagaacatctggaaggccgagcctgccacactactgccttccctgcaagaagtttttgcaagcatctcttccacagatgcatcatttgaaccttctgtagcattggcaagccttgtgcagcatattcctcttcagatgattacagttctcatcaggagccttactacggatccaaatgtaaaagatgcaagtatgacccaagccctttgcagaatgattgactggctatcctggccattggctcagcatgtggatacatgggtaattgcactcctgaaaggactggcagctgtccagaagtttactattttgatagatgttactttgctgaaaatagaactggtttttaatcgactttggtttcctcttgtgagacctggtgctcttgcagttctttctcacatgctgcttagctttcagcattctccagaggcgttccatttgattgttcctcatgtggttaatttggttcattctttcaaaaatgatggtctgccttcaagtacagccttcttagtacaattaacagaattgatacactgtatgatgtatcattattctggatttccagatctctatgaacctattctggaggcaataaagtcttgctctgttgcccaggctgaagtgcaatggcatgatcacggctcactgcagcctctacatcttgagctcaagtgaccctcctgcctcagcctcccaagtagctgggactccaggattttcctaagcccagtgaagagaagattaagttaattctcaatcaaagtgcctggacttctcaatccaattctttggcgtcttgcttgtctagactttctggaaaatctgaaactgggaaaactggtcttattaacctaggaaatacatgttatatgaacagtgttatacaagccttgtttatggccacagatttcaggagacaagtattatctttaaatctaaatgggtgcaattcattaatgaaaaaattacagcatctttttgcctttctggcccatacacagagggaagcatacgcacctcggatattctttgaggcttccagacctccatggtttactcccagatcacagcaagactgttctgaatacctcagatttctccttgacaggctccatgaagaagaaaagatcttgaaagttcaggcctcacacaagccttctgaaattctggaatgcagtgaaacttctttacaggaagtagctagtaaagcagcagtactaacagagacccctcgtacaagtgacggtgagaagactttaatagaaaaaatgtttggaggaaaactacgaactcacatacgttgtttgaactgcaggagtacctcacaaaaagtggaagcctttacagatctttcgcttgccttttgtccttcctcttctttggaaaacatgtctgtccaagatccagcatcatcacccagtatacaagatggtggtctaatgcaagcctctgtacccggtccttcagaagaaccagtagtttataatccaacaacagctgccttcatctgtgactcacttgtgaatgaaaaaaccataggcagtcctcctaatgagttttactgttctgaaaacacttctgtccctaacgaatctaacaagattcttgttaataaagatgtacctcagaaaccaggaggtgaaaccacaccttcagtaactgacttactaaattattttttggctccagagattcttactggtgataaccaatattattgtgaaaactgtgcctctctgcaaaatgctgagaaaactatgcaaatcacggaggaacctgaataccttattcttactctcctgagattttcatatgatcagaagtatcatgtgagaaggaaaattttagacaatgtatcactgccactggttttggagttgccagttaaaagaattacttctttctcttcattgtcagaaagttggtctgtagatgttgacttcactgatcttagtgagaaccttgctaaaaaattaaagccttcagggactgatgaagcttcctgcacaaaattggtgccctatctattaagttccgttgtggttcactctggtatatcctctgaaagtgggcattactattcttatgccagaaatatcacaagtacagactcttcatatcagatgtaccaccagtctgaggctctggcattagcatcctcccagagtcatttactagggagagatagtcccagtgcagtttttgaacaggatttggaaaataaggaaatgtcaaaagaatggtttttatttaatgacagtagagtgacatttacttcatttcagtcagtccagaaaattacgagcaggtttccaaaggacacagcttatgtgcttttgtataaaaaacagcatagtactaatggtttaagtggtaataacccaaccagtggactctggataaatggagacccacctctacagaaagaacttatggatgctataacaaaagacaataaactatatttacaggaacaagagttgaatgctcgagcccgggccctccaagctgcatctgcttcatgttcatttcggcccaatggatttgatgacaacgacccaccaggaagctgtggaccaactggtggagggggtggaggaggatttaatacagttggcagactcgtattttgatcctgagagagtccaaaatgcactggtcacgaaacgtctaatactatgactgttaaaatgtcagactataacaaatatctatcttttatttttcattagacccttatacttcaagagaacacactcagtgcttgtttttattttcttgacacatttattaacaaaatgcatcatggaaaaaaaatctacctcttaaaattccatttgcttttatggttagacatgcttgaccaaaaatgttcagaagaaaatatgtacctggtccctaattaagctgcgttaaatttggtagaagcatttaaatggtctatcttcagttttactgaacaaaaaatgtaatatatttagcattctttataaaagaattgatgctagaggt

SEQ ID NO: 1814 - DNA, 2565 bp, Homo sapiens
cttttcctcctggcccggcctccgcgtcccgcccgcagcgtcccccatttcaacttcctgctgccccgacaccctgaacttctggtcctccccattcctcagccccacgcaggaccacttggttctccacaccaggaaccagagcagcttggcaccccggagggcatggggggctctcccctccctcccagttctcacaggggctgttccgtccctcaccctgagcaagaccagacacctctgcattcgcagccccctgctgtccccacatgctgcctggggtccagcgctccggagcccatcctcccaccgactaccctctttgctcctgcacttttatttttattttattttatttatttatttgagacagagtctcgctctgtcgcccaggctggagtgtaatggcgcgatctcggctcactgcaacctccgcctcccgggttcaggcaattctcctgcctcagcctccccagtagctgggacaacaggcgtgtaccaccatgcccggctaattttgtatttttagtagagacagggtttcgccatgttggacaggctggtcttgaactcctgccctcaggagttcctcaggaggagttctcggcctctcagagtgctgggattacaggcatgagccacagcgccgggcctgctactgcacttttcaagaaatggctcaggacttctcatcttaaaccagaaacaacaaggaaacccattctgttgactttacagcttctgtgttgctcttcacagcccaagtttataaaagagacgcgttttccgccgtctgcatctcctcttctcacccctgctccccacaggaggccctgagcgcccagcagcccttggtcctgcatccccctccagacaactaaagggcctggctccctccaccctgcccggatccagctcccagtgcccgaatctatcccccctccccggatccatccccccctccccggatccattcccactgcctgaatctactctcccctgcccggctctattccccctacctggatccattccgttgcccatgcctggtcccttcaccggctctctcccctggggccgcaaacctacctgggcccccctctggcagaaaggggtcctctcagacccacaggtccaacggctaatcctggctccgcttcccctgggagccttctgcggctgcccccaccctgggctggaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggcccctgactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccgcggtgatgcaagaggagatcttcgggcctgtgctgcccatcgtgtgcgtgcgcagccgggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcgctggctctcctggccctgggagaatcgctcctgcagccccagcccagccccactcctctgctgacctgctgacctgtgcacaccccactcccacatgggcccaggcctcaccattccaagtctccacccctttctagaccaataaagagacgaatacaattttctaactc

SEQ ID NO: 1815 - DNA, 2387 bp, Homo sapiens
taaagcttatttcagataaatgacgaaaaatttttagtgtaagtatgtctcagatacttcatgggccatacattcactaacaaaattatgtattgttcatgtattgggaggcacttggcctcccagagtactgagattacaggcatgagccactgcgcccggcctgttttctcttcacaacaaaacgtccccacatgggcttgacttcgaagtcctcgaatgtcatctcatggaagccccactggggagcatcctcagcccctgcccagggagggcagccacggggagggcgggcacggggagggtgggcacggggctgcggccacccgctgtgttgcaactctgccctctgcttgctttttatcgctgtgtccggaagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 1816 - DNA, 2239 bp, Homo sapiens
ccgaacactgtggcacaagctcaggccgcagacggtgccggccccgaggacgacactgaggcctcccgtgccgccgccccagccgaaggccctcctggcggcatccagccggaagccgcagaaccaaaacccacggccgaagccccgaaggccccccgagtggaggagatccctcagcgcatgaccaggaaccgggcgcagatgctcgcgaaccagagcaagcagggcccgcccccctccgagaaggagtgcgcccccacccctgccccggtcaccagggccaaggcccgcggctccgaggaggacgacgcccaggcccagcatccgcgcaaacgccgctttcagcgcttcacccagcagctgcagcagcagctgaacacgtccacgcagcagactcgggaggtgatccagcagacgctggccgccatcgtggacgccatcaagctggatgccatcgagccctaccacagcgacagggccaacccctacttcgaatacctgcagatcaggaagaagatcgaggagaagcgcaagatcctgtgctgtatcacgccgcaggcgccccagtgctacgccgagtacgtcacctacacgggctcctacctcctggacggcaagccgctcagcaagctccacatccccgtggtgagtgcggggcccgggagagccactgccttctctctctgggatgcgtctggggcccctagtcacggcttcctccagcccgtcttgtcccactcatggcccttgacctctctcgaccttctgccacctgaggagacacagccccacttctgctgtggaggcaaaagccggaagctgcccagctgttctgcagacccgaggtccttcctccagctggtccgtgccaggcctcggtctcctgacctccccctcaccctgggtgcaccccggtcccactcgtgtggggctcccccttcacgccgctcactctcccctctccactccccgtccaccaggacggcctcacgagagccaccccctgtgtctcctgcccctgccccgcccccttctcccttggacccgcgtgggttccctgagcctccatacctgcacgatgagtcccttcccccacctcctcccttgggcttctgggacagcagagctgcagctcccttggggcagcttggtcctcggcccccagcctcaccttgttccacctgaccctgtcagcccagttccccaggcatcatccctacctctgcaggctcaggtgaaacatctcggaatcacccccactcccccagctccttgcgctacgtctgggcccaaaatagatccctccaaatggggccctgctctgagcacattcccatgagggctgcctgccctgtgcactctctgccctgggccgcggggcccgactgggttcccacctcctcctacccactggggtctttcccagcaggcacagggattcctcatgggggaggcagagcccatccgtctgtcctcggtgacggcctgagctgtgcacggcctcccctgccctcctgttctcaggccccccagggtccatccagccccagcgtgtggcgttctggctcttccctggagtctcctcccagaccacgcgactccactcacactgtgcctagcggactgtgtggttgatgcagccgtctcgcttgagtgtgttgtgttatgcccagaacaggcttgccgtcaccaacggccatttccttctggggattcctgggcactgaaactcgcaggtggcgtgaggtacagccaggggccctccacacgcgttggctctgtgggcccaggccgcctgaggcccctcgccgtgctggccctgacctggctcagctacccagcacccccctggtgaggatgacggggtctgctgagcttgccctgagggtgaggctgggtctgtgctgctggccgacatgtcagcgacgttgtgcaggatccaggagcgggcgccctcgggccccaccctgccaagctctgagctctgctcccagggagcacgaggggcactgcacccacggtgacctctgcggtctttcccttccccgcgagcctgaccccagccgtccccggggaggctcatccacagaagacagagacggcagttgggtcatgacattcagaaaaacctgccccaggatctctcctcagtaagaccttctgatcttctgaccttctgtgctttttgttgttttgttttctcgtttaatggatcataacactagtctgactgctgtag

SEQ ID NO: 1817 - DNA, 2019 bp, Homo sapiens
aagtggggattgggtaggtaacttaagaaaattggggaagctctgagaactgtattgtttctacttatacataaggagtcataaggatggcaatacattgaaagcattttttgaatagttgtgcaaatatgttaaatgttgaatggacattcagccacatcactcatctcaacactataaaccacaggtctaattcaagaatgaaactcttattagaactgattattattgccctctgctatagtttaaatgtgtccctccaaaattcatgtgttggaaacttaattgctgttggaacaatgttaagagatggggcctttaagaggtgattaggccatgagggctctgctctcatgaagggattaatgctattattgtgagagtaggttagttatctcaggagtgggctcctgataataagataagtcctgcttccattttctctttgtctcacatacatactcgcttgcacttcatgtgatgtcttccatcatgggatgacccttcccagatgcaggcatcatgctcttggactttacagcccccaaaactgaaagccaaataaacttttgttctttataaattacccagtattttgtattagcagcagaaaatgggccaaggcagaatactggtaccaaaaagtggggccattgttaaaacaaatatctgaaaatatggaagtggctttggaactggttaatgggtagaggttggaagaattttaagtaggagtctggaagaagcctagattgccgtgaatagaatgttaagggtgattctggtgagggctcagaagaagaggccatagggaaattctggaactttttagagataacttaagtgggcatgatcagaatgttgatagaaatgtgcacagtaaagctattctgatgaggtctcaagcagaaactgagagtaaaggccatccttgctatatattagcaaagacccttgctgaattgcatcagtttcctaggactttatggaatgcagaacttcagagcgatgaacattcaggctgctttgtggctgcttttaactgcatatagtaaggtgcgagagggaagaaatgatttaaaaatggaatttataattaaatggtaagcggaacagaaagacttggaaaattagcagcttgaccatgtaaaaagtgaaaaggtatcttttaggaaagtaaaccaaggatgtgtgctaaagagatgagtgtggttacaggggagccaagtgctagtcaagacaatgggagaaaggccctgaaggcattttaagatctttgaggctgtacctcccgttgtagtctcagaacactaggagggcagaatggtttgggggaatcagcctgggacaccctccacatgctcactgcccatggccaccttgggagtctgctctccacattctagtgtagcttccccagctgtggctcaaataggcccagatgtggctcaggctgctactctagaaggcacaagtagtaagctttggtgttggccatgtgatgttaactctacaggcttgcagactacaagagttatgggggcatggctaccttctcctactgtaagagtgttgcagatagcacagggggcaagcagaaacctgtcttgaggcagaagcactacagagcaccctcactagggcaatggctaggggagtcatgggaatggggccacccccaaaaaacacagaactgtagtgcaagtagtgtgcaacgtcagcctgtcagaactgtaggcacaagattccaaccagtgagagctgtatgggctaagcccagcaaagttatggggacagggctgccagaggtcttgggggcccaactcctgccccagtgtatccaggaagtaggacatggagtcgaaggagattattcaccagctttaagacttaatgttttcggccgggcgcggtggctcacgcttgtaatctcagcactttgggaggccaaggcgggcagatcgcgaggtcaggagattgagaccatcctggctaacacagtgaaaccccatctctact

SEQ ID NO: 1818 - DNA, 2315 bp, Homo sapiens
agcggaggagctctgggacacccttgtctagggaagaggtcttactggctgccctcacctgactttgtgtccccaggcccccagccatggccctgtccctgcctctgggccctagacttggctcagagcccctcaaccacccaccgggagcacctagagaggcggacattgttggatgcaccgtctgccccgcgtccggagaggagagcacgagcccagagcaggcccagaccctgggacaggactccttgggccctcctgagcacttccagggtgggccaaggggcaatgagcctgccgctcaccccccgagatggtcaacaccctcttcctacgaggacccagctgggggcaaacactgtgagcaccccatttctggcctggaggtactagaggctgagcagaacagcctgcacctgtgcctgctggggctgggccgccggctgcaggacctggagcaaggcctggggcactgggcattggcccagagtgggatggtgcagctgcaggccctccaggtggacctacgaggggcagctgagcgtgtggaggcgctgctagcgtttggtgaggggctggcacagcggagtgagcccagggcctgggcagccctggagcagatcctgcgggccctgggagcttaccgagactccatcttccggcggctctggcagctgcaggcccagctggtcagctacagcctggtgttcgaggaggccaacacgctggaccaggacttggaggtcgagggagactcggactggccaggacctggtggggtctgggggccctgggcacccagtagcctccccacttccacagagttggagtgggatccggcgggggacattgggggccttgggcccttgggacaaaagacagcccggacactaggagtgccctgtgagctgtgtggccagagggggccccagggcaggggacaaggccttgaggtgagagcagacccccttgagggaccttctgccaggcaccctggggacatctctgcgcaccttctagcaagatcctgcccttccaaggaggtgtcagtggctctgtctccccctctatctctgtctctcggtgtctccttctatctcactgtctctctctctcgtctgtctctgtctacatcctcaagccccatctcaaattcactcctatcctgaggcccccagatgatgccccactcacctcctgactgtcccagtctctcctgaagtgccacctcttcagggaggcctgtcgtgacctccaaacatgagcactcctatcttcttactttatttcctaacagcactcaccacagcttgactttgcacatttacttatttttaaaaatttttatttattttttgagatggagtctcactctgtcacccaggctggagtgtagtggtgcaatcctggctcactgcaaactctgcctcccaggttcaagagattctcctacctcggcctcccgagtagctgggattacaggtgtgcaccaccattcctggctaatttttgtatttttagtagagatggggtttcatcatgttggccaggctagtctcgaacgcctgacctcaggtgatccgcctgccttggcctcccaaagtgctgggattacaggcataagccactgtaccaggcctcatttacttattaatttatggtctctctcctgtcaaatataagctccacggaggccaggaatttgcctatttccatccccactgtgtcctcagctcctagaacagttcctggcttgtaacagaaactcattacacatttattgaatgaatgaataaataattctctcctctcttggtttctttggctctgcctttgtctgtcctgtgagatctctctgctcccccagaatctcatctctatgacatccctatcctggccctcccccaaccacgtttttctttgttgctggttctccaggaagcagacacctctcactcccgacaggacatgctggagtctggcctcggccaccagaaacgcttagcacgtcaccaaagacactccctgctccggaagcctcaggacaagaagaggcaagcatctcctcatctccaggatgtgaggctggaggggaatccaggggcccccgatcctgcatccaggcagcctctgaccttcctccttatcctcttcctcctcttcctcctcctggtgggtgccatgtttctcctgcccgcgtcaggaggcccctgctgctctcatgcccgaatacccaggacaccctacctggtgctcagctatgtcaatggtcttcccccagtctgatgtgtgtaataaatggtcactgtcaaagg

SEQ ID NO: 1819 - DNA, 2433 bp, Homo sapiens
ttcaagtttatttaggaccctggggcataatagcctgccatgccaaggcttgtcaaaacccaagcctcaagcctcctaactactgggatgggtgaacccctctgggtagggctggtctaaatgctccctccatgggcaggtgtcacgtgagttccacctggtttcgctttctgctgtgacagggcagcactgagttcaaggcagagtcccacagttgctgcattctccctcccccaggtgcacagattctcagcaccacagcgaccactgctgggggagggggaggggtgatattggtgtttcaaggctgtctctcctaccttttcagtgcctctttcagcgacatgaagttaaacccaggtactgtgagtcctcgcctaatttttggttcttatgatgatggttttctggtggaaacagttgttaaatttgattttcctgcagggggaatgattggtagagactactattcagccatcttgctctgctcctcctccctcccttcactttaattacctcctaatagccctatttttaaatacaatcatatagggggttagggctccaagtatgaattttgaggagacacaattcagtctatagcatttggacttgggaagagggaggaaaagaacacgcacaggaaagtcacagtgtaagcaacagtatggaggtgggaaagttcagctcatggataggaaaaattgatccaagttggcagggcccacagggagatgtggtggggtggtgagtggcggccacatcaaaagaaccttgaatgccaggctgaggtgggaggcatttcctgttgtgtggaatgtgccatgaggtggtggggagggtaacgtgatgaaaggacatttgggaggatggatctggcatcagtgatgggtgggggtaaggagtgaacaaagctggaggccaggaaaccggacacatggcccagagttcaggcataggctgttcaaaggcagtttccacactgagttccaatgtggatccaagcatgcagcggatatatttggaaaagcaaaagcattcccttcccattaccacacagtttcccagctgagttcatcaccagagtcctacacatcagacagtcaacctgccccaaactctgtccctagaagctgtggcccagagggagcccttgtccagctgtagcccggggacgctgcagcctgagcaggactgcacctgttccctcccaggagcctcatctctgtccggcctggctttggcttcagatgccctcagctttggcttcgaaatctgttgggtcagattcacgagagctctggccttctttgggttgggaattttaaatagtttttccaagcaggcagtagatcaactctacttgcttacttctgggtgcatctcctgttccccggccccagatcttctttttccttggtttatcctctcattgtgttgcagcacatcttccagtggcttccagagaaacagtgaatggaagccaagctttctgaccctcacatattttagaatgtcattgttctaccccaattcctgattactagtttggctggatgtaatgctctaatttaaacataacttctcttcacattgggaaatattgctctattattttctagttcccagtgttgttgggaagaagtcagtgtcatgcggagtcttggctctttacatatgacctgtcttttctctctggaagattttaggattttctatctttgggttcttggaatttctcagtgatgtaccttgttataggtctttctacctatactgtgctagtcacttggtagactcttgaactagaaaattatgtgcttctgtggggggaagccaccagcatgtttgggtcctggtttgggtcccaatggggcacatgtgggaaagaccatgaatgcccatgtctccgactagtttccccatcagaagtgttgttgcaccaatcatcctcctccattaaaactggacagactaagggccactttcctaatggatgggtcttcttggttcatctcatgctcccaacagagctccctcccggggatgggaacgcgccatgccaggagagccctcttgatccagcctccagccaaagccagtccccctgccaaacaggccctagagttacactggagggtgacaggcctaacctggaaatttcttgctgaaaattgtcagtttcccacacaagtacagcctggcagttaattcaaattcaaaccagaagactgctgcttcagtctcgactgcttgaaaattaggttgtgtagagctttcatttgctggaaattgtgcggccagacattgtgcagattgacccagtagctacagcaagtacacacatagggcgccaagcaaggacaagtgtgcacatgtgcgcacgcacacacacacacagcagaaaatctagaaataaactattttaatgtc

SEQ ID NO: 1820 - DNA, 1803 bp, Homo sapiens
ttggaccaggaacttgtatcctgggatatgagacacttggccaatgtgagataacatccatcccttttcaagggaagtggggccctactgattaacaggcaccccacagtcacaggggaaggggcctgtcctgaaaggaaaagattcgagacagacaagaatatgacctgcagtctctacttcttacggtagtcctatgggcaatgttctgctactacctctgttttataagttaacccaaggctcagaaattaaatattttactcaaggtcacagagctagtgagaagcagttagaattcaacccaagatgtgccctggctgttgatgctgcgtctcagatgccggttattgaccacacaactcccgatccattctgtgtgtggaaggaaaggcctcttagatccttttatcaattagtgggagtctgtctgcttgggcccccataggtgcctcggggtaccacgtttaagagggccatttcctcttggaggggtgttggggaggtccagctccccctcacctgatctccatcctagaagctgtggttaggaatgagttacatgttggttttcttcccctgatagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactgtggtacagatagacatgaagagagcttagcagtgattgaggtggtgactaaatatacagtcattgaataaataccatgtagcaagtgt

SEQ ID NO: 1821 - DNA, 2649 bp, Homo sapiens
tgttccacttaccaccctattttaacttttatgtctcctccttggctctaagatctgagcaggcagggcctgtgaggcaccccaggtcccctgatgctgccagcacccaggggactgttagtacatatgcagggagggaaggaatgaaggaagagatgacttggggagtcctccagttcccatttgtaactggcacattgcgacaaaacactcatggcattttacctttttcatataccttttttttaaatttatttttatttgagatggagtctcgctccgtcacctaggctggagtgcagtagcacaatcttggctcactgcaacctccacctctcgggttcaagcgagtctcctgcctcagcctcctaagtagctgggattataggcgcccaccaccacgcccggcgaatttttgtatttttagtagagatggggtttcaccaagttggccaggctggtctcgaactcccgacttcaggtgatccgcctgccttcgcctcccaaagtgttgggattacaggcgtgagccactgcacctggctttcgtatatctataaaagagaatttgcccagaaaatctttcagatgcacctttagggttttaaggcacagatacatgaagcttgtcagtgagcagctgctgcttattcctttttctcttccaattcagagcggcctgcgtcccaagcggacagctgctcccttcctcttggctccctgctgcccacgctcccacagaagcagggagaagaggcaggaaggtgacgcgtgatcatccgctgggcgcccgcacagtgccgtctgcacaggtgccatctcctttacttgtcactctcctcgctgagccctttcccctttttgcagatgagagagcattgcctcccagaggttaagaaatgggcccagagtcactcagctgatcagcgtgcagccagatttgaaccacatcctgctgatctccatgcctgcaggcctggcctgatgagatggacagctgggtggtggagaccttgagaccctggatggctcccaaatagggcctgtagctcctggacagggagagtctggcacaaagggtttgtggagtgagctgggggagaaggtggcttagggtccctgtctctgaacaaacagatggaggggctattccagcgttttctcagcctctggtgtgctgggctcctggttctgggaggagagaatggagctggcctccattctgggctgggctggtttgggcccaattcagacaagcttcttagtttgccatgagtgacacttttgcctgccctggtgtctctgccaaaaatatgaagggtttcagaacccccaccccggcctgcttccctcccagacttggagtgggtctggggctgacaacagtctcatgccagatagcctgagcagccaccagtgccatcaggtctgacactgcggcccctgccccggagggaaaaacaaggccctctctgggggattttctgccagcttgtgaaaacaggcctggagtcagccagcgcccccatgcttagacacttcgtgtggttttcaaagtgcttttatgttgctagctcatatgatcttccccaaaaccccataagggagggcaggaagtttgagcaacagcctgtcaagcacccatacagcaggtggtttcattgccctccatttacagacaagtaaactgagcttcagggtggctaccgcttgtctcccaagccacccagccatttagccacggaagaggtcatgactttttacaccccagtgaagctgaagatttttctttccgtttttaaaaatgtttactccccagggcagtgaacacctggtgcctctgtctagcgcaagaggtgaacgtttgccacttccgtttctttcctcctaccagacctgaccctccttttgtgacgggaacatcctgcaggcagtctgtcctgctttcatagactttgagaaacggggtccaaattgccggctgtgggtggggcaggcgacactgcagtgaagaggtggagtatttttgtagcggggaagaaatacatttcctctaccctcttaggttcagtgtttgggggtctgtgaattaaactcactcaagataaattaatgagagaaaagacagatttaatcacatacgtatgggatttcactgaaaaacgtgactcaaaagagcaggtagaaggtggggcccgtgactggtccgaaggtagtgagttatctcagttgattgttcacagtcagttacagattagactccttgttccactgtctcccctcttcccacttgttttgttttttttgagtcagagtcttgcactgttgcctgggctggagtgcagtggcgcgatctcggctcactctaacctccgcctcccgggttcaagcgattcccctgcctcggcctcccgagtagctgggattgcaggcacccaccaccacgcctggctaattttttgtgtttttagtggagacggggtttcactatgttggccaggctggtctcgaactcctgacctcgtgatctgcctacctcggcctcccaaagtggtgggattacaggcatgagccactgcacccagccaactagtcttaaaaaaaaaaaaaaaaaaaaagaacttagggcccgtatactatcttaatagg

SEQ ID NO: 1822 - DNA, 2513 bp, Homo sapiens
aaaacgcttccaatggctgtgtttccggcgacggcgcgggggcagctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggtt

SEQ ID NO: 1823 - DNA, 2320 bp, Homo sapiens
attttgtggagatggggtttcaccatgttgtccaggctggtcacgaactcctgggctcaagccatctgcccgcctcgtcctcccaaagtgctgggattataggcctgagcccaccgtgcctggcctttcctgtttatctttgaaaattaaatagggcataagagagaagaagatgtacttacaatgcagtgggtggttttaactctatagcctttgggctctgtggttggtgctccccttcctaaataaatgaggtgtatgcagggccctcttctgccttagcgccctgccagctgggactccagcaaggcccggggcacctgaggacagagtgagatggagggccgctgctccagcagccgggcctgcatcccacaagtcaactgtgtcggacagaggatccttacaaagaagaggcagcagggttgggggctggccagctgctcgtccgccctaggtagcttgctcatctgtaaagtgggtggggcaggagttcccacctcatggggtcctggcaagcctgcagtatccccgagtggcaccagcctgcttctggggcagagcagtttgtgccccctgaggtaccactgatcctctttccctgctattaggtattgctctctccctccggtgtttgccttttcagattataaaagtaatatgtgttcccatatttggcgtctctcaggagctcaggaagtacttggctgagtgaacatgtccattgtggaaaaatggcaacaatatggattccatgggtatattttatagaagaatatgaagaaaagcagctacccctaaacccatggcacaagctgttcatgttaattctgtacccgacgctttccccacggggcctcccctcactctgaaatggcatccaggtccatcttgccctccacctctgcatggctctccatgccccatcgcctctcccagatcctagcactgggaccacactctcgccctgtccatttaggttgatgaaagcaggcagtcacccgggtgggccagtcttgcctgtgggaggaacatgcagtctcctgtctcatggcttgaagtgtgccaggaagcctggcccagcccacctccccctggagtccttcccaggaggaataaccccttaggtcattgactataagatgagttcgctcactggatccttcctctctgatgagacaggaagaaggtacacagtgaccaggtaggaggaggagagggagtagaaaggagggatgcgggtggctggtccctgcatttgcctgcttccctgcacgggtgtcccactggccgcctctgctcaccagtgtcatgggattctctcagaagatgaaaacagcccctgctttttttgctagaatggctgagctttcatggaaaggaagctggacccaagcaacagccgactaccgaaggttgcctggagcagtgcagatgtgggaggaagaagggccttggtgcacactggcttttcttcctgactgcaatgtggcattgtgccagctacctcctctttctcggcctcaggaaaatggagagaaagcagccctgaaggtggctgtgacgagggaaggggcagagggcctgacagtcaaccacgcgctatattttcctgttcttccttagggcaagaactgcatggccagactcaggaaaggcctaggtgtcggctgggcattgcctacacgtgaagagatcactccgcgtccctactgcacctgtcacaaagtgccttctgatatgcctggcaaaccaaaatcggtgagcgccagcttgcttccctagaagacatttctaaatattcataacatgcttgctcaaatcaatcaccttattttacatccgctccagggagaaatgaagacatggtcctacgttgttctgtaattattttctatgtaaattttgttccttgtcacaattatatatgtcttaggggaaaggaccatttcacatgtgtcacctcatgtgattctcaccacagccctgtgattgctcctgttttataaataatgacatagttccagttgatggccaaagccacagctaacgagaggcagggagagctcaggctcccaggagcttccactctcagaccttgcctcccgggctgccctgagtgaaacccctgcttagcatttggcacagccagaagcagcaagctagggtcacaacacagagaggggctgtgtaatactggctgcctctgtgctaagaaaaaaaaaaatcactgtgtgtttgtttattttggtgcaggcccagtgttcttgcttagacttaatactacccttcatgttaaaataaaaccaaacaaaaaccc

SEQ ID NO: 1824 - DNA, 2160 bp, Homo sapiens
cttgccctggcggccccagcagcccttgtagtgaccgtggcgtgtgcatggacggcatgagtggcagtgggcagtgtctgtgccgttcaggttttgctgggacagcctgtgaactctgtgctcctggtgcctttgggccccattgtcaagcctgccgctgcactgtgcatggccgctgtgatgagggccttgggggctctggctcctgcttctgtgatgaaggctggactgggccacgctgtgaggtgcaactgggtgagtagccccgtgctcgtgcccaccctacacacttgtgtacatgtgcacacatcagtaaaggcaccaagggtgggtggaacgggcagaggccaggaaggcaactactaacctggttctgggggctgggccctgggggacagagctgcagcctgtgtgtaccccaccctgtgcacccgaggctgtgtgccgtgcaggcaacagctgtgagtgcagcctgggctatgaaggggatggccgcgtgtgtacagtggcagacctgtgccaggacgggcatggtggctgcagtgagcacgccaactgtagccaggtaggaacaatggtcacttgtacctgcctgcccgactacgagggtgatggctggagctgccgggcccgcaacccctgcacagatggccaccgcgggggctgcagcgagcacgccaactgcttgagcaccggcctgaacacacggcgctgtgagtgccacgcaggctacgtaggcgatggactgcagtgtctggaggagtcggaaccacctgtggaccgctgcttgggccagccaccgccctgccactcagatgccatgtgcactgacctgcacttccaggagaaacgggctggcgttttccacctccaggccaccagcggctcttatggtctgaacttttcggaggctgaggcggcatgcgaagcacagggagccgtccttgcttcattccctcagctctctgctgcccagcagctgggcttccacctgtgcctcatgggctggctggccaatggctccactgcccaccctgtggttttccctgtggcggactgtggcaatggtcgggtgggcgtagtcagcctgggtgcccgcaagaacctctcagaacgctgggatgcctactgcttccgtgtgcaagatgtggcctgccgatgccgaaatggcttcgtgggtgacgggatcagcacgtgcaatgggaagctgctggatgtgctggctgccactgccaacttctccaccttctatgggatgctattgggctatgccaatgccacccagcggggtctcgacttcctggacttcctggatgatgagctcacgtataagacactcttcgtccctgtcaatgaaggctttgtggacaacatgacgctgagtggcccagactcggagctgcatgcctccaacgccaccctcctaagtgccaacgccagccaggggaagttgcttccggcccactcaggcctcagcctcatcatcagtgacgcaggccctgacaacagttcctgggcccctgtggtgagtctggccactgtcccaccctgttggccctggccctcgctcacagtgggcctgactctggtctccctgcaggccccagggacagttgtggttagccgtatcattgtgtgggacatcatggccttcaatggcatcatccatgctctggccagccccctcctggcacccccacagccccaggcagtgctggcgcctgaagccccacctgtggcggcaggcgtgggggctgtgcttgccgctggagcactgcttggcttggtggccggagctctctacctccgtgcccgaggcaagcccacgggctttggcttctctgccttccaggcggaagatgatgctgacgacgacttctcaccgtggcaagaagggaccaaccccaccctggtctctgtccccaaccctgtctttggcagcgacaccttttgtgaacccttcgatgactcactgctggaggaggacttccctgacacccagaggatcctcacagtcaagtgacgaggctggggctgaaagcagaagcatgcacagggaggagaccacttttattgcttgtctgggtggatggggcaggaggggctgagggcctgtcccagacaataaaggtgccctcagcggatgtgggccatgtcacc

SEQ ID NO: 1825 - DNA, 2420 bp, Homo sapiens
gctccgcaggcaggactgggccccggggcggtgcgctgggctgcacctccctccccgcgccccgtcctctcccgccctacaggccctagcagggcaggcgggagtccgtagttcgtggtccttcgccggtgtccccggagcccagcggctgtggatggcagaagcccagagtgggactggtcagctgcaggagcagaagaaaggtcttctgatagccgtcagcgtctccgttgataaaatcatctcgcatttcggggccgcccggaacttggtgcagaaggtgaaggtggctggggggaggctgttgggatgaggagagtaatggagctccgcggggggtgcgggaatggttggcgggaggtggctgggaggtgtctggagggatctctggagccatcggcatcgcgccacctccaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggctccagcacccgctcccttggaaccctgtatagccaggtcagccgtctagccccgctgagcagcagccgtagccgcttccatgcctttatcctgggcctcctcaacaccaagcagttggagctgtggttttccagtctccaggaagatgcaggtcagaggttcagatggtagaggatggggctgatgggctgggaggatgggaaggaaagagttctctcctgctggttcccactgctgccagaatgccattaatccagatctccgatcttattactcttctaattaaaactttctaaggaggcccatcgcccataggatgaaagacccaaagccttggctgtctggcctctgccctcttcccctgccttggagggtcttgccaacagtcttcccgcctggcccttcctgctccagggccctgcttatgctgttcctctaccttctgcccctcctgcttcctctgaactatcattcatcctttgagtccttccccagtgaggccctacctctaccctcggactaggccaacccccacgcctcattttgtatgtgcttctatggctctcctgtcctcctcctctgtagcctttgcactgtctctgttacttgtcaccacttgctgtgtgtgtcttcctatttgggctaggttccatgcaggcggggatgtcagtcctatagcccaccacatccttcctcctctctgccccagtgcccagcagagtgaggcctgggaagatgtgtgctgactggtgggctgctctggggggtcttctgggactaggtccagggcaggagctgatgttggcctgctcttttccaggcctgctctccctcctgtacctgccaacaggatttttctccctggcccgcggtggttgtccctccctgtccacagagctgctgctcctgctgcagccattgtcggtgctcactttccacctggacctgctctttgagcaccaccaccacctgcccctgggcccacctcaggcccctgcccctccaggcccacctccagctctgcagcagactatgcaagccatgctgcactttgggggccggctggcccagagccttcgggggacttccaaggaagctgcttcagacccctctgactctccaaaccttcccacaccagggagctggtgggagcagttgacccaggcctcccgggtctatgcctctgggggcactgagggctttcctctttcccgatgggcaccggggcgtcatgggactgcagctgaagaaggtgcacaggagagacccctgcccacagatgagatggcaccaggcaggggcctctggttgggaagactatttggagtgcctgggggccccgcagaaaatgagaatggagccctaaagtccaggagaccatctagctggctgcccccgacagtgagtgtgttggctcttgtgaagcggggggcacctcccgagatgccttctcctcaggagcttgaggcctcagcacccaggatggtgcaaacccatagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcct

SEQ ID NO: 1826 - DNA, 1712 bp, Homo sapiens
gagctcgggagcggggaccggtagccgactgcctctgggacagcggtggcgtctctgtgcccgtttagtggagttggagggaagctgcgaggaggcgcaggaagtccacctcagaaccccccccccggtctaggggcgcccgggcgttggaaccggcgggggaagggtgcgggggcgcatggggtgatcctgattcggctcccattttcccgaacgggcaccctgaggctcctggcccggggcatggtgttagaaatcatagctgcggagaagcccttgtgacaccttgctgcagactgggaagctgcagattgggaagctgcagatgattgggaaggtggaaggtggagacgcggtccttaggtggtcgagcgcattttctcttcctcagagtccaggaaggagcgcgatggagaagtggggcgcacggcgggtttcgggtccgcccctgcccttccgactcctccgaccacgtctgcctttggctgaaagcaaatatggctccgtgtgcggtttctgcaacaaaggctgggcgggccgggtttccctagggatggggaccgcctccccggggagtcgtgggggtgagccaccggggcctccgagagaatcgctggtgtcgcttcgcacccaagggacacatctcgggttagaaaggagaaacgacgtggatctaaaggcgaagcccatgctgaggacttttcaaaatggcctcttatcggccccactcacaggagcttcaggcttcggtggccctgtaggacaaccctggggtgtcattggagagaagctgacggggttaatggcgggtgacaggtgaaagagaccccggaggggtggggccggtgtgtgtggctaagctgagtcccaggcacagggtggattggaatttatgggtggcagagctagagctaggccctgcccttacctaggtcctggcttcgaggtccactgttctgtcgcgtcttttgacgcatcggtggaagaactgaatttcaggatgctcacaaacctgcagctggaagctagacttccaaaccttagtttaaaaaagcaactctactgaaatactaaaataaattgccgacggaattagggtgatttcttgttcacggtttcatttaaaaatgcacctatgttatttacaggaaaaacgttttagtggtgctagagctacaagaataaggtaaacagagggatgctgctagaccaggagtaccttacccagtctgggataggaggaggtcggggaagccctccctaagcaagacacgtgagctgagtttgaagaaaaagttaaaaggaaggtgaagtgcgggagagaaacagggaagggaatttggagcagagtgaacagcatatgcaaaggtgtggaaatgtggaaatgcatggcctgttaaagctgccttaagaaaatatgttgcctggggctgggcgcggtggctcatgcctgtaatcccagcattttgggaggccgaggcgggcggatcgcttgaggtcggagttggagatcagcctggctaactaacatggctaaacccttctctactgaaaatacggagattagccgggcgtggtggcatgcgcctgtggtcctagctattctggaggctgaggcgggagaatcgcttgggcctgggaggcggaggttgcagtgggccgagatcgcgcctttgcactccagcctggaagacgaaacaaaactccgtctc

SEQ ID NO: 1827 - DNA, 2740 bp, Homo sapiens
atataaccagcatttgggaaaactaccattcaaaggctgtctacaaccatggaacttaatgcagactctttgccactgaaagcacccagaactaaagccaaaagaccctacgcaacatatattatagacaccttctgaaggggagaaaaatcacatccaaatgaaagcaaattcaaaaaataaggagagacggcttatctagatgagaagcaaccagaggaacaactctgaaactatgaaaaaagtgtgttaacaatgctccagaaggatcacactaactcttcagcgatggatcctaaccaaaattaaaatctttgaaatacaagataaagaattcagaatgttggttttaaagaagctcaatgagatccaagagaaagttgaaaacacacacacatcagaaaaacagtttgggatatgaaaggagatatcactaaaaataaacccaaacatcttttggaaatgaaaaattcattgaaagaattacaaaatatagttgaaagctttaatactagtctagagaaaggagaagaaagaatttcagagctggaagacaggtcttttgaattaacccagtcagatgaatttaaagaaaaaaagaagtaaaataagtgaacgaagtccggtgtggtacctcatgcctgtaatcccaacacttttggaggcggaggcgggtggatcacttgagggtcaggagttcgagaccagcctggccaacatggtgaaaaccccatctctactaaaaatacaaaaaaaaattagcaggtcgttgtggcgtgtgactgtaattgcagctgctttggaggctgaggcaggagaatcgcttgattccaggaggtggaggttgtggcgagccaagatggtgccactgtactccagactgggtgacagagtgaaactccatctcaaaagaaaaaaaaagtgaaaaagtcttggagaaatatgggattgtataaagcatccaaacttacaggttatagatattctacagaagaaaaagtaaaaagtgtagaaaagctatttcaggaagtaaatagggaaaacttccctagtctgggaagagatttagacatccagaaacaagctcagagaactcctgaaagataaattgcaagaagaacctcatctaagcatatagtcatcagactgttcaaagtcagtgtgaaggaaaaagaagaaattctaagagtagcaagagagaagggattacctataagggaaatcccatcaaactaacaccaaacttctcagcagaaaccctgcaagtcagctggaagagattgggggcctatttttagcggccttaaagaaaaaattaccagccaagaattaattttgttttttggacagggtctcagtctgctggccagacctggagtacagtggcgtgatcacagctcaccacagcctttacctcctaggctcaggtgatcctcttgctcagcctcccaagtagctgggactacaagcacatgccaccatgcccggctaattttcttgtgttttttgtagagacaaggttttgctgtgttgctcaaactggtcttaaactcctgagctcaagcgatccacccgccttggcctctcaacatactgggattacaggtgtgagccaccgtgcacaaccaccggccaagaattttatatcctgccaaaaaaataagctttgtacatgaaggagaaataaagtctttcccagacaaacaagtgtgaagggaattcatcatcactatactgatcgtataagaaatactgaaaggagttctaagcatgttaacgaaaggacagtacttaccatcataaaaataaaaagctcaccgagtctataaagcagttatatagttgaaactctaaggcagctaacaatactgtgacaggaacaaaacctcacatatctatatctctgtctctatttttttttgagacagagtcttgctccattacccaggctggagtgtagtggcacgatctcggctcactgcagcctctgcctcccgggtacaagtgatgctcctgcctcagcctccctagtggctgggactacaggtgtgtgccaccacacctggctaattttacatttttagtagagacagaatttcaccatattggccaggcaggtctcaaactcctgacctcgtgatccgcccacctgggccttccaaagtgctcggattacggtgtgagccactgtgcctgtcctatatatatattttaagatggagtcttgctgtcttgctcaggttggagtgcagtggcatgatcttggctcactgcgacctctgcctcctgggtccaagcaattctcctgcctcagcttcccaagtagctgggattactggtgtgtaccaccacacctggctaacttttgtattttttagtagagatgaggttttgccatgttggccaggctggtcttgagctcctgaccttaagtaatccgcccactttggcctctaaagggctaggattacgggcattagccaccacacccagccacatatcaatattaaccttgaatgtaaatggcctaaatgctccgcttaaaacatacagagtggcaaattaaaaaaaaaaaaaaaagacccaaccatctgctgccagcaagagacccccccacacacactggttaaagacagttacagactcaaagaggtgaaaaaagatttatcatgcaaatggaaaacaaatgccagcagtagtatccattctcgtatcagataaacttcaaaccaataacagt

SEQ ID NO: 1828 - DNA, 2355 bp, Homo sapiens
ttatggaagacaaaagccccccaaatctgtgtaaaatctgctgcaaaggtgtcatccctcttgtgtcatcactggggttagaggtgggtccgaaataatcttctgtgtccttcagttggactctcggctgccaattgatctctttttcattgccatctctggggtggttctttggttttttgtgtgttttccccttcatctctacctgtgaaagtgaaattctattgtaaatgggaggaaaaagggttggttgtgaaaaattaaagacccacattctgctttcttactcatggtaagaaaagtggccatgagtagagattgggcaagcattggtaataaatggaataagactattattattattatttgagatggagtctcactctgtcacccaggctggaatgcagtggtgtgatcttggctcactgcaacctccacttcccgggttcaagcgattctcctgcctcagcctcctgagtagctgggattacaggtgtgtgcctccacacccggctaattttttgtatttttagtagagacggggttttgccatgttggccaggctggtttcaaactcctgagctcaaatgatcctcctgccttggcctcccaaagtgctggaattacaggcatgagccaccacacccacacaagactatcatttttaatgaccaagagcctagtatatagttggtgcctgtcttagtctgtttgtgttgctataaaagaacacctgagactgggtaattgataaagaaaaaggtttgtttggctcacaattttgctggctagaaggttgggcatccggtgaaagcctcaggctgcttccattcatagcaaagggcagccagtgtgtgcagaaatcaaatgacagagaggaagtgagagagagaggtgtcggggaggtgccaggctctttttaacaagcagttcttcaggaactaagagtgagtcactcccatgagaacagcaccaagccattcatgggggaatctgcccccatgacccagacccctcccgttaggcttcacctccaacactgaggatcagatttcaacatgagatttggaggaggtcaaacaaactaaactgtagcagtgtttcataaaattgtttgcctgactcaggttgctagtaagccagcagagggatatttgcctcctaaatctttggcagaggcaggagtaaggaagccatttctggagtccttgctactaatttggaaaactgagcttctttctttcattgctttttcccttaagagacaagtccttactatattgccctgtctctcaagggaagacatcaagactggacttgaactcctgggctcaagccatcccccaaccttggcctctcgagtagatgggattataggcatgtgccacggtgcctgacttgagtttcttattctagaacacttggagcctgaactctgaccaggcccctcacttgagcctttgctttctgctccttgtaaactgccatattgggtgcacttgccctgccacagtaatgctatatatttctgagcattgtttttctctagataattttatatttttgagtataccccacttccaagtgttttttgttttgttttgctttgtttttgttgttgttgttttgagacagggtctcactgtgtcccccaggctggagtgcagtggcacaatgacgactcactgcagcctcaacctcctggggccaagtgatcctcccacctcagcctctcaagtggctgggaccacagaagtgcaccaccatgcctggcttttttttttttttttggtcgagatggggtgtccctgtgttgcccagactggtcttgaactcctggactcaagggatcctcctgtcttgggctcccaaagtgttgggattacaggcgtgagtgaccatgcctagctcacttccaggtttaacagacaaaataaacttactctagtttccatctctatcattttataataaccgtagcccacattgtagtagtttttcagctctttactaagtcccaccaattcatgttttcacccttaaaatctttctcactgatactctctctggacagaaaaaaggtgaaataagcctactataaggaatatatgacatgctaaattttatttttaaacggttcttcaagtcagattaaagtaataatagcaaattatgtgattatccatgtcccagcattgatggcagtgcctcatcttcaactttagtgctcccctttacctaaccctacggcctcccatgcatctgtactccccctgtgtgccacaaatgcactacgttattaaatttttctgaagcccagagttaaaaatcatctgtccacctggctccaaagac

SEQ ID NO: 1829 - DNA, 2488 bp, Homo sapiens
aaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgagaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctcatgactc

SEQ ID NO: 1830 - DNA, 2818 bp, Homo sapiens
gtatttgtctggttcctgtctgtgtccgtcgttcgtccgactgtctttgtccgtctgctgtcttctgtccgtctgcccgtccgcccgtccgtccctcagtctctctgcggtccctttaccgtcctcagtctggctcgcgctgcctctcaggcacttccccagctcgccccggatcatctgggccccagcgcggagactgggatgggagcggagggagccccggactttcttagctgccctcgagtgaggcgggtgcgggtcgtcacggaccaccgggcggaactctgggttgggagagcaggaatcgagggaggttcgggtgtgcgcggggagtgcccggtcgcgggttcgggacctgtggggaggccaacctctgttctgtagctgcagccgcagaggggaggggctccagcaagaccccggctgggaggcccgttctcccttccctttccccagcccccctctcctttcctcttcccctcattaaatctgaggttcattcaggcagccccctccccctctggccccacacaaagaggccctgagagggagaaggggctgcagcggctgctgaatctcgggactcgctttccttcgtccctgacggggtgtgtgtgtgtgtgtgtgtgtgtgtgtgtgtgtgtgtgtgtgagagagagagagagagagaggagggggtgtaggggagagctgagggtctagagatttactttacagcctttttctgagaatgagatcagcatagacagcacagagaggcaagagagcctctcgcctcattaggcctccatttttcgtgtgtgtgtgtgcgtgtgcatgtgcgtgtgcaggaggaggaatcaagctggtgcctgaaatccctcccagcccaaagaattcaaggtttgggccaggtctctgccaacaagggtttgcttcctggtgagggaggcagagcttccacagtggacctgatttccatcggttgcacctgcattggaactgggctgaaggtgaactgggctgaaggcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggggggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacatccctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcagactcctgcatagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccgcttcctggacttcgtgccttactgagtctctaagactttttctaataaacaagccagtgcgtgtacc

SEQ ID NO: 1831 - DNA, 2274 bp, Homo sapiens
atagatattaaattaactaaaagtatcccttatgggaaacaaagggatgagccgaattaaaggaataggttgggctagttaactgcagcaggagcatgtccttaaggcacagatagctcatgctactatttgtggcttaagaatgcttttaagcggttttccgccctgggcgggccaggtgttccttgccctcattctggtaaactcacaaccttccagtgtgggtgttagggccattatgaacatgttacagtgctgcagagattttgtttatggccagttttggggccagtttatggccagattttggggggcctgctcccaacatgtcccctttctttgatttgcaaatcaataaaagcaagggcagctttgtcacagtgagctacttctcgcaggagtcaggatccacgtctgcagactatacaaggacaacacagattaaaagcacagtcatcattgaaatcacagaacttccaagtgtttttatccattttcagctccttttaagcactccagttctggcattaaggtcagctgtgcctgggatgctttaaatatttgttcttttaattttaaatccttatattaagctcctacaatgcaccatatcatttgaggttgaggtgccactatcccgccatggttccagataataggaacttttgccatacttcttatcatttctgccatctgaccgttttgttcagatcagctgaacatagtgtggccgtggcatgtagactgagaggtgcagtttaagctaaacatccccttaggggaccaattaataatgattccatagaaattgttgtgcagcacctctgcctgttccgcaatgcaatcttcctaaacaagtacgttcattttttctaactgggtccgatcctgtttacaaataggtttttgagggcggtatgcctcaattataggagcagatttattacggtaaatactgagattagaaagcatgtgtaactgtgtcatagagtgattgcatccaggcattattaccagtcaagattgataaatatgcccagtaagtataatcattctctgtgtcagcccttattgaaggaatactcaaggtagtggtgataactgctgtcatagctaccattaaattattcattgtgactggttgtcccgctttcctcaggttttcttccgccatctgtgacagcttcttgatctgtccccaggtgggtggctgtgttcgatgggtgttgctcgtgacagttggggtcctcctcagcgtcagtctctacatggctgcaaccggggagtccttgggatcctctcagagtctcttcctcagcatctggctcatgataaggtttcaggtgtcttgatagtacccaaatcggctattgattttggtctagagaaacacaagcataatctctactccaagttattattttacctatttcccaactttttgttactgaatatctccaccaaatcagttgttctgcttctttctttgcagctggtttctgtagatgctgttcagttgctgataacatctggcctttgggcaggttcaaaacatttaatgttaataatgctacgttcagttgtatctgtggggttccatattctctatttccccctttctgcttttgcaactgctgttttagggaaagattcattctttccactatggcttgtccttgaattgtatgggatatcagtaatgtgtttaatattccacatagagaaaaatgtagctagagcttggctagtatagcctggggcattatctgttttaatagaagctggaatgcccatcactgcaaaacactgcaaaagatgacgtttaacacaagcagaagactctcctgttggcatgtagcccagacaaagtgagaaaaggtgtccacacatacatgtgggcaccaaacgagggaatacgtgtgacatctatttgccaaagagagttaggttccaatccttgaggattaaatcctcctgtaaaagatgaggaatgtaccatttggcaagttggcatcgctggataatagctttagcttctttccaggtaatgctgtatctgtgtttgaggccagaggcattaacatgggttaaattgtgaaagtgtctagcattagatattgcattagcaactaggcgatcagccatttgattcccttcaatcaaaggtcttggaagaggtgtatgagccctaatgtgagtgatgtaaaaagggtgcattctacttctaactgctgtttgcaactgggtaaataaagtaatcagttgttcatctgt

SEQ ID NO: 1832 - DNA, 2157 bp, Homo sapiens
aaaattgcaaggagacgccgccgccttcatgctgccggcgggctgctcgcgccggctggtggccgagctgcagggcgccctggacgcctgcgcacagcgacaattgcaattggagcagagcctgcgcgtttgccgtcggctgctgcatgcctggtacgcggaccccggacccactggccagacctccctcgggccctcagagtcccgccccgagcgcccagggctgggagaccgggcgcagccgcccacttcggagctgtgggttgtcagtgccaccctccttaccctgcaggctctgagctgggggcctgccgcggggcccggcggccccctcgggtctgtttgggctgggccctgcctcctggccgtgcgatggctgcccgtgtctttgcagggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcggcagcccccatggactggatgcaggagtaccgctgcctgctcacgctggaggggctgcaggccatggtgggccagtgtctgcacaggctgcaggagctgcgtgcagcggtggcggaacagccaccaagaccatgtcctgtggggaggccccccggagcctcgccgtcctgtgggggtagagcggagcctgcatggagcccccagctgcttgtctactccagcacccaggagctgcagaccctggcggccctcaagctgcgagtggctgtgctggaccagcagatccacttggaaaaggtgcttctggaagaggaggtgggggtgcaacagaggtccgcagccttgaggacccgagggtaggggcttgactgctccaccccccaggacccaggaggatgggggcaagcctggggtctgtgtgtgtgggttgggaagtgcatgggtcagacggggctgggacggcaggagggagcctggagcctcagaaggagggaggagggctgaagcatgggggcctcgaagcctgtcccaggattgccccccgcctaggtgcccctgagaccttggccctgccctgccctgcccccaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcagatggggattgggggtgtcttccctggcactgtgctcggggacccagagatgcctgtgcttccctgggaaacctggtgaactggaccaggtggcctcactggctcttctcaggacaactaagcctgctggtcagggctggctttcagccttcctaaggctcctggactccagaggccagcggggagcctttcctggctccctctgttttctctcactgtagaccaaagagccgcttgtgtgatattaaagccactttagaaagc

SEQ ID NO: 1833 - DNA, 1850 bp, Homo sapiens
aaaaagaaatgtgaaaatgtttcctacattattccactgccttacatggtcacacactttcagatcatttccagtagtagatttagagaatgtccactatattcgaaggcatggttggatagtgccctcttgtgggaaaacaacatattgcttatgtcgtgcttgcttaaacattagcaaggattttaaaattttattaactgggtgcagtggctcacgcctgtaatcccagcagtttgggaggctgaggcaggcagatcacctaagttgggagttcgagaccagcctgaccaacatggagaaaccccctctctactgaaaatacaaaattagctgggcatggtggcatgtgcctgtaatcccagctactcgggaagctgaggcagaagaatcgcttgaacctgggaggcggaggttgtagtgagccgagatcgtgccattgcactgtagcctgggcaacaagagcgaaactccatctcaaaaaaaaaaaaatcggtgtgtacaagcatgttttgtacaaaatgctttttcactagaaaccattattaatttaaggtttattcctaatttcttccatgttttaaaagtaaaaaggcggggagggtaatggaggtgatgggggtgtgaataggatttgctctagttccttgggtgggggataaaattctctgagagtcagaaaatgtttttgagcagctcatggcagatatttgtaaagaaataagcataaacagctccaagtcaagtttttacagtgcatttcttataaaagccccttttcagccatgtaaactcttttttaaggaaggctccctaggctgagagggagcaagcgtcccttcaggtacttgagtctaatcaaatggtagaatgtaaatcacattttttcaataaaggatcatggttggctttggtgtcagacagggcagcatctgagtcctggctcttctgctcagtgatggtggactctggcaaagaatttcacttccctgcccctagtggtggtgatagtccagtacctttatttcaagtttttgagcattaactgggagaatgtgggggcctgacacataagtgtgtgcttcctgtgaaaaatgaagcatagccataggtgattggaaagacgatgaatggccccctgaaaaaatcttacaatactatggacctgccacttgggcacaagatgtctcatggggatatcgaacccccatctacatgctcaaccgaatcatatggttacaagcagttttagaaattattactaataaaaccactcaagccttgactgttcttgcctggcaagagactctgatgagaaatgctatctatcaaaatagactagctcttgattacttgctagcagctgaaggaggagtttgtgaaaaatttgaccttactaattattgtctacacatagatgatcaggggcaagtagttgaggatatagttaaagatataacaaaactggcacatgcacctgtgcaagtgtggcacggactcaatctgggagccatgtttggaaattggttcccagcaataggtggatttaaaactcttataataagagtaataatagtaataggaacctgcttactgctcccttgtctgatacctgtatttctccaaatgataaaaaacttcgtcgcttaaccttagttcaccaaaatgcttcagcacaagcatactatataaatcactatcaatctattgcacgaaaatacataagtagcaaaaataagagtgagaactcccactgataaaaagtgagagtctcaaagaggggaaatgagggaagagagagaccctctcatattgttttatattgttttatactcagtacctcttttaag

SEQ ID NO: 1834 - DNA, 1944 bp, Homo sapiens
gacagcgcgcggcaggcggcgagctcgggggccgcagaaaatgaaactgaagccgtggtcacgtgacaggacatgtagtatatagcaggctgccagcgactcctgctcttgcttctggatctgcagggcagtcccagcaggacccatggagtgtccttcgtgccagcatgtctccaaggaggaaacccccaagttctgcagccagtgcggagagaggctgcctcctgcagcccccatagcagattctgagaacaataactccacaatggcgtcggcctcggagggtgaaatggagtgtgggcaggagctgaaggaggaagggggcccgtgcttgttcccgggctcagacagttggcaagaaaaccccgaggagccctgttccaaagcctcctggaccgtccaagaaagcaaaaagaagaaaaggaagaagaaaaagaaggggaacaagtccgcttcctcagagctggcttccttgcccctttctcctgccagcccctgtcacctgactttgctttcaaacccatggcctcaggacacagccctgtcccacctgctgggccctgggggtggggcggggctgttacaccccccttcctttcacatccacaggaatcccctccataacccaggcctggggactgtgggtcctcttaggggctgtgacgctgctatttctcatctcgctggctgcacacttgtcccagtggaccaggggccggagcaggagccatccggggcagggacggtgggtgaaggacaacagggatgggttgactgagagttctctcttaccgagaagtccccactcatcccctaaactctgcgttgcagctctggagagtctgtggaagaggtcccgctgtatgggaacctgcattatctacagacaggtagggagctggcagagaggaggggcacagaggccaggtcctgggtggctgggatgggggcgtgcaggaggaaggacaagttgctgaccagattcctgttccccgtcccaggacggctgtctcaagacccagagccagaccagcaggatccaactcttggaggccctgccagggtgagtcaactgtggctggagaaaagggggagggaaggaagtggggggcttttcgggcttttccgagggtccagtgaacttctaacagccttgcatctccaggctgcagaggaggtgatgtgctataccagcctgcagctgcggcctcctcagggtcggatccccggtcctggaacccccgtcaagtactcggaggtggtgctggactctgagccaaagtcccaggcctcgggccccgagccggagctctatgcctcagtatgtgcccagacccgcagggcccgggcctccttcccggatcaggcctatgccaacagccagcctgcagccagctgagatggagggcctggcacagcggggcgtgcactgccccagccccccgtagcaggggcatgactgtttcccaaccagcacccaaagacgggcgccattgccaagtcacaggatgtgatctaccccggacttcctatctgagcttcaagggagacatctcagggcaaagctttcgtgatggaggaggcaaagacagtagccccctccttatttcttttttctatctgttcctcttagcccccaaactcccaggttctcacttccttcttctggagtttaaccagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtccccaagttttcaaataaaactttcc

SEQ ID NO: 1835 - DNA, 2266 bp, Homo sapiens
gtgccgtgtcggcagttaggagggcaggtggcggggtggggggttgtctgcaggagcagcggccagggaggggcatggggctgtggggctgtggggtgtctgatgggggcagatcccagggaggccaaggcagtggcagaaaagctggactctggagcccacgcacctgcctggcttcgtgccactgccaggtccaggacttgtctgtgcccttgggcgagatataacttctctgcgcctcactttcctcatctgtagaaaggggcacacctggtaggagtgtaagacgcttcccgcaggggctggcccagagcaggagctgggcctgggattgccgtggctccagggagcagccctggctgaggtcctgggtaaccacctctccctgtcgttccccaccttgggtgcatccagctcctcctccagcctcctgggccctggctgggctctcagacccaccaggcaaccctgcggcctcctttgtgcctctgttttgcctggacctcatgggagccccctgcccgcgtccacaacacacgggcactcagtgcagggctctccgagggcagggccaggcctgaccccatcacagcctcagcgggaccccgctctggggagggaagcggggaggggccaaagaggcaggctgaggaccacgtcttttcttcccaggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctctgcagatgtcagccgacccccaggctccaccgtgtacacgtgcatgctcaaccaccgtgggggcaccgagagtgacctgactgtcagccgcctggcacccagccaccaggcctccccgctggcccccgcctttgaaggggacggttactacctggccatgggcggggccgtggcccagcacaactggtcccacatcaccaccgtgctgcaggaccagaagtcccagtgccagctcatcgacagctccgaggacctgggtatgatcagtatccagggcccagccagccgagccattttgcaggaggtgctggacgcagacctgagcaacgaggccttcccgttctccacccacaagctactgagagccgcagggcacctggtccgagccatgcggctgtcctttgtgggggagctgggctgggagctgcacattccaaaggcgtcctgcgtgcctgtgtaccgggctgtgatggccgcgggtgccaagcacggcctcatcaacgcagggtaccgcgccatcgactccctgagcattgagaaaggctaccggcactggcacgcggacctgcggccagacgacagccccctggaggcaggcctggccttcacctgcaagctcaagtcgccggtgcccttcctggggagggaggccctggagcagcagcgggccgcaggcctccgccggcgcctggtgtgcttcaccatggaggagccgctgtggacgcgtccccaccctgcggtttctggggccccagctttctctactgcttcttccagcaaagtacccatgtttggcctggaggccatccggaggaacggccaagtggtgggccatgtccggagggctgactttgggttcgccatcgacaagaccatcgcctacggttacatccatgaccccagcggtgggccggtctcgctggactttgtgaagagcggggactatgccctggagagaatgggggtgacctatggtgcccaggctcacctgaagtcgcccttcgaccccaacaacaagagggtgaagggaatctactgagggctcagaccacatgccccatcccatgctgtccatccattctcacaggtcccaaatggccctgggtcccaggaccctggacccagccagaacttgtgccctccctgtccttagccaaggcctagtcctgcgaaaacccccaaaccagatacggacagagaccaagatggcccatcctgtggtcactgactggaaggcagtctctaatccaccccaatcctcccagaaagcaaacctgtaagtgtcttgggctcagggaccatggcttgtagccctttccaagcttctagaaggtgcttagtaaatacttgataagccccacgtg

SEQ ID NO: 1836 - DNA, 2554 bp, Homo sapiens
agtgatgtaatttttataatctgtttcactttaaaacaaaaatctttgcacacctggtccaagttttctcccctttcttcctgttgctgccatgatgaaagcagaagggaccaccctccagggagagcagcaggaagggaggtgcgggtaggggccctgggtcagcaggggcggtcagtccggaggtgcacccccatttattcctcgttctggaagagatttctagtcacatgcatgtggctcctgtgccacatgtgtcatgaggtgcccaggtgggtttggatttggatgagggcatctttgaggatgcaggggctttgtcataccctgtgggccccgtgtacacccctggggcagatgtggcctctaacaggggagggtgcatggatctctaagccggggaggaaagcagattgcagacttgccgaagtgggagctgtctgctcttgtgttttctttaggggcaggagaattttgcccagcagtccctcgtggctccctccacaccactgacccttacgcgtccaaggttggagccctggcaggtaaagggtgagcaaggtgcagttgcctgtgagcagctgtggaggggcctttcctgttgtacacttcctgtgagggtctcagaccccttgcagactctggacatcacttcctagaggggcctgggctcctttagtcctgtgagtaaagctttggttttgatgactgtctcagggaaaggtagaaaggtgcttggtggcagtgaacttcctgctgcagaagtgggtgtgaccccagtgctggagaatgggctgtgagccgagtttcccgcacctgcatgagtgagcgccatggtccttctccacagagcgtcctgctgtcactttggtttgtgttaactttgacgcctttcttgtttcttactctgctttcctgcatggagcacacagccccggctccctttcagtctgcatggcagacacctggcctctgcaggtccagttcattctgtgtcccctttcggtcgtccctatgttgccgtcaggtgattgagggtgaaggtcggccttggcagcccagtggaaagtcccttgactcctggccgtcagtggcaggtctccagcctttgggaggaggaaacttctatttaacaaagaaatggaattgactttgccacacacagccagagcgatgatttgtagagccaacctgctgagacattcaaagcatcagtcgtagggtcaggaccgccaggtgaggtgtggctccacctgcagcagcctggggcaggttgcctagcctctggctttagcatccccttctgtgaaatggggaaagtgatgggacctggctttgtagggtggttgtgaggacctacaggggtttttgcaaaatacttagcccagggctgactaaaagattcagagacgctgggcatggtggcacacacctgtagttccaggtactcgagaggccgaggcgggaggatcacttgagcccaggaattaaagtccagcctgggcaacatagtgagaccttatttcttaataaaaaaaggtaaaagctttggtaatagttttaaacatatattttgttcattacatcttcttctgtacattcaacattttgtcagaacaaagtaagagaaagagtggcagggctttgtgtgtatgtggtttcagagctgctgacctctaggatggggtcctgctacatttactcttctgaggcctccggagctggccttggctgccctatgccataccctgtgctatgtgccgtgcctgtggacctgccctgcctgcgtgctgccccgtcccgtctccccaggcagttcctgcacctcctgccgtgtggatgctggccgttgctgtctgactcgcattcttggagacactgacccaggctcctctcagcgcttccagccaggtttggcagtgggaacattagggggagattagagggtgtgtggagcgaggcagggcctcacttgctctgcttccgtgggagtttcatggcgatggccgtctaccctcatggctgtggccccagttcttcctgggtgggccctgctgtagttctgctatacgctgtccctgttctggactctggtgacgccacaccttccctagtccctccagccctaggggtggcagccccacgacgtgctggtctctggtgcttgcttcttagtgcatggccgtgccatgccctggtgcctgcccgggatgcctgtgtggaatgcccagagtgttctaggcagggtcccctctgtgattagctcctcaagggtggtgtctgtgtcacagacactttggggtcctgtcagtggcctctcgaggctcccagggtaccctgtactttctcaccccttgttgctcatctattgtgggtttgtctgtgtgctgcaaaatgcacggctgtactgagcgcaccagccagcagctgtaagctccatgtgcagggccaccatctggccgagcacctgccatgtggtgaagatacagtacatacttgttgaatgggtgatgaaacttgcgcagacctcaaataaaagctaataatttaatgt

SEQ ID NO: 1837 - DNA, 1606 bp, Homo sapiens
taaaaacttgagcccacagtgtagacacactggttccaaagacccctcaggatgtgcctcccttctcagatctgggctttccctgttcctaagcatcacctgcacctggggggatcactctgggtcctcatctccagccacatgttcactcctcacgtgggcctctctaactgtccccctcagggcaagcccttcctccccacttccagaaagctgctcgttccctggccatcccacacctctgacctcgtgccacttccggggcctgttggctttaacaccttagtttcctccctacctcctaaccccctctgtctagagtgctcacctccctcccagcctctgtctcatactattttttctttcctctcagtaccaagcgctgggacaagccagtctgtactcaatgcctgtgggataatagacggaggaatctggagtttggttgggtgattagctttggaattgatgggtcccagggagctatctaaagttttcagtcacatgagggcatgctcacagatctgtgaaaagatctgttggctcagagaactaagagatgaataaatgttagtccaatggcctcatcatgagatgagaggtcaagagttttgagtttccagagggagaagctactattctaggcagcttgtatgaactaactcgtttattcctcacagccattgtaggaaataatctaacctcataaaccccattttagagatgaggaaacaggcttagagaatttgacgtaaactcaagaccgaaaatctaggaacaagaaaagcctggatttgaaccaagcgatctgatgccagtgttttaactctcaaccattgtactactttacctcctcatgaccttttttttttttttttttgtgagacggagtctcgctctgtcgcccaggctctggagtgcagtggcgggatctcagctcactgcaagctctgcctcccgggttcacgccattctcctgcctcagcctcccgagtagctgggactacaggcgcccaccactatgcctggctaattttttgtatttttagtagagacggggtttcaccgtgttagccaggatggtctccatctcctgacctcgtgatccgcccccctcggcctcccaaagtgcccatgacctttttattgttgggcagtgaaagccatggtgaaatgaagaatgtcctactgtcatgtgatgtgatcagaaaacatactgcccagagtcccctgcccccacccccaaaaccagtacttgatccatcctttgactgttgtggggattggcacaaaggttgggcacagtagtagttaggctcatgggctctggagccaacctacctggatgctacacatcccagctctgcccctcgctagtttggtggcaagcaacttaacctctctgccttaatttctccagcggcacaatgggaataataatagatctcgccttgtggctcctttgcagattacatgcgttaattatgtaaagtcaagcattagaatggtggctgtccaccatgagtacaacacaaatgctcgttcttaatgattcaacaaacatggaatttcattaaatctgaaataaaggtattttgagaaattg

SEQ ID NO: 1838 - DNA, 2140 bp, Homo sapiens
tatggagcagcgaggggtgtgttagcgaatgggcatggggtctggccactgtgcacagccaagcaagctagctgccgtggtggggcaggcatctccaggcactggcgccatgcaaggttgcagctggattagatgtgcctcaagcagcttccactgcaggcacccacatctggacgaggggaacatggtggtggtgcccagaagcttggagatgccaggaaccacaagccccaaagaggatgtcacaaccctggctcagggagcccataggtctgaactcccaaagggcctcagctctttccttctcattgcctacaacgtggcgagcaagggggcatgtttcagccctgtttgtgttaccattttttgagtaccagaatttgccaggtcctgagttcttgtcctgcgcccaggaagaatgaggtatgtggacaactggagggtgaacaaggtggagaggagcttcattcagtgacagaagagctctcaggagacccctagtaggtagctcctttctgcaagcaggttgtccaggcaagtgtccagctcttagcagagaggagacctgtagtagttgctccttcctgcaggtggatcatcccagcaagtgtccagctctcagcagaaaggagtgggtagctcctttctgtaggcatgtcatcccacagagggtatgagtctggctgtctggggttattttgtgctctgaatggtggaagtgtgtgctgattggtccatgggaggccacggatgggcctggaaaaagcacctcgagttctcactctgggccatggacttcaaccagaactggcagccttatccccccaggcccgcctcccatgctcgtcattacccaaagtctggagagggctgaggcagcagggggcttgtgaatcagtgccgtcatgagcacacccagtcagttgtgacaggtcccaggcttggccacaactttgctccaccccagagtgggtgccaggagctgggagaggccagggagcaggagcaggtactttcaagcatgtgggggcagggagcttcttaagaccctgagaacacagggaagcatgggtccaaagctgcagctgggtagctgcagctgcacccaggagcgctgggctcccacccctccaactcagtaggtggcccggcttccacctgttcctggcctccacccattctgtggagcatgcagccctggccacaacttccccactgcagtcggcatccctgcagcagctgctccagatgggctgccaccaccatcataatcccagctacttgagaggctaaggcgtgagaatcgcttgaacctgggagggagaggttgcagtgagtggagatcgcaccactgtactccagcttggacaacagagtgagaccctgtctcaaacaaaaatattagctgagtgtggtgccatgcacctgtagtcccagctactcgggaggctgaggcaggagaattgcttgagcccaggagtttgaggctgcagtgagctatgatcatgtcattgcacaccggcctggaggaatagagtgagaccatgtctttaaaaacaaagaacaacaaaaaaccactgggtctaccaatgggtaaaagcaaatactggtgctaaacaaggaaatgctcaactgggctttgaagtctcaaatgcagtttggtctcgtatacacatgaacacagaaacatggtttggaacaaagatgtcccagtaatatagtcctctgtgtttaaacaagaatatgtgagtcggacagtgtgctctttgactgaaaacctgattcagagaagttggcttattcctttgcctttgaccacagctttgttggaggtcagcagcatcctaagagccagggagcaggccaggcacagtggctcacgcctgtaattccagcactttgggaagccagggcaggtggatcacttgacgtcaggagttcaagaccagcctggccagcatggcgaaacctcatctctaccggaagtgcaaggcaattagccaggcatggtggcaaatgcccataatcccagctactcgggaggctgaggcatgagaatcgcttgaacctgggaggtggaggttgcagtgggccgggatcatgccactgcactccagcctgggtgaagtgagactctgtc

SEQ ID NO: 1839 - DNA, 2183 bp, Homo sapiens
attcgagcagctgagacagcagctgaagccaggtcctcccgaagcttcaggaagcctgcttgatgctccacggctgagagtgacagagaatccagaatagcttatggatgggtcagttctcgtctcaccacactcccaatatccagcttcctggactgttgtgtagggaagagccacttttttcagttgaagtctgagttcttatgggccatgaccaaggctgctgcttcctcaaaaggcacgaagggggccgcgtgcggtggctcaggcctgtaatcccagcactttgggaggccaaggcgggcggatcacgaggtcaggagtttgagatcagcctggcaaacatggcgacaccctgtctctactaaaaatacaaacattagcccggcgtggtggcgtgtgcctgtagtcccagctacttgggaggctgagacaggagacttgcttgaatgtgggaggcggaggttgcagtgagtcagatcgtgccactgcactccagcctgggtgacaaaagtgaaactcttgtctttaaaaaaaaaaaaaagaaatgcaggaagggaacagggaacaaggctggggagggaggagccgacggctgcagcaagctccggcctcagcctcccttccctgctcctctgagatgccgagggcggggcgtactcactgcaagcctgccaagtaggacctccatgtcctctgacattcgagagatggactttttggccctgagatcacgtctcctactgtgtcgtcattctagcacctgtgggtgacttcctcatgtgagtgaggcataagcacccggaatccggactggaggccgtctctgcctctggattgcacactggcctacagacctggggacagagtctttcacgagttgtgtatcgtttaacagaaacccaacagttccacccaaacctcctgacacattctcgggcttgggaagtgtcccaaagcaccaagggggtgagacacacgccttgaaaaatggcagtaggcatacttacctgtcttcatgcgctcacatacgaggtgtacctagaacgccctcatgttatattcccagcactaatgaagctactggtcaacagctatttgttcccaaagaattttcccttgcgcagccgcagcctggaggaagcagggcgtgtgccctcgtctgctggcggcagcagtgaggggtgtagccaagtgcccacttctctcattcagctgcttcggggcaaactggaaagatcctttgagctcacagccccctgctcagtgctactcctgaacctgcgggcctgtgtgcacagccacccacagcgcgcacaacacatgggcctgcccagggcaacggcaccgtcaacagcgtgtgccctcgctcagggccctcccggtactacgcttcccagtgtgcagggttcccagacgtgtgtcctctcatacattgcatttcctccctaagctgcacggggcaacaccgtgttaggtcccgcgcatctgctcctgggccacatccggctccgtctgtattgttcctgaattcagtttgctgtcctagaacaaggcagcaggaggggagaacagcttttcagtgtctttaattaggcaacaggaaaaaacaaagtctggctgaaaattactatttgaagcttggccgatgccaacacagcactcgctccctgcgttctggtaagtgatggccgttgatttcaaggacgtaccaaggggcgaaaagcaagagcaggaagtcacctcgctctggaaaagaagctggttttcatctgctgtatgtgctggtcccaaacatacccttttctctttttttagtattttttttcccaattaggaattcaatgtggaaaacataccctttttcttcaacaggcttttaatgttgggaagacaggttaaaaaaaacaacaacaacaggctggctgtgccggcgcacgcctggaatcccagcactgtgggaggccaaggcgggcagatcacctgaggtcaggagttcgagaccagcctggccaacatggcgaaaccccgtctctactaaaaatacaaaaattagtcaggcgcggtggtgtcgcttgtaatctcagctacttgggagactgaggcaggagaatggcttgaacctgtgagctgggatcgtgccactgcactctagctggggcgacagagcgagactctgtctc

SEQ ID NO: 1840 - DNA, 2342 bp, Homo sapiens
cagtgacagtcatgggctcggcctcccttgatgagctgctgcgagttgacatcggcactctggacctggccagcagccgcctggactcagccatggctgtgtgctttggccctgcagctctgggccacctgctggtgtccacctcgtccaacagagtcgtggtgctggatgctgtgtcgggccgcatcatccgggagctgcccggtgtccaccctgagccctgcccctccttgacgctcagtgaggacgcccgcttcctgctgattgccgccggccggaccatcaaggtgtgggactacgccacacaggccagcccaggcccccaggtgtacatcggccactcggaacccgtgcaggctgtggccttctctcctgaccagcagcaggtcctcagcgcaggggacgccgtcttcctctgggatgtcctggcccctactgagagcgaccaaagcttccccggggcccccccagcctgcaagacaggcccgggcgcaggaccgctggaggacgcagcgtccagggccagcgagctcccccggcagcaggtccccaagccatgtcaggcatctccaccacggctgggcgtctgtgccaggcctcccgaaggtggcgatggcgccagggacaccaggaattcgggggccccacgcaccacctacctggcttcctgcaaggccttcacgcctgccagggtcagctgcagcccccactctgccaagggcacttgcccgcctcccgccagcggtgggtggctgcgtctgaaggctgtcgtcggttacagcgggaatgggcgggccaacatggtctggaggccggacacaggcttctttgcctacacgtgcggccgcctggtggtggtggaggacctgcactctggcgcccagcagcactggtccggccactctgcggagatctccacgctggccctcagccacagtgcccaggtcctggcctctgcctcgggccgaagcagcacgaccgcccattgtcagatccgcgtctgggacgtgtctggcggcctctgccagcatctcattttcccccatagcaccaccgtgctggccctggccttctcaccagatgacaggcttcttgtcacactgggggaccacgatggccgcaccctcgccctgtggggcacggccacctatgacctcgtgtcccccacccgcctcccggagccggtgcatggtgtggccttcaacccctgggacgccggcgagctcacctgtgtgggccagggcactgtcaccttctggctccttcagcagcgtggggcagacatcagccttcaggtgcgtcgagagccagtcccagaggcagtgggggctggagggctgacctcgctctgctacggggcacctcccctgctctattgtggcaccagctctggccaggtctgtgtctgggacacgcgtgccggccgctgcttcttgtcctgggaggcggatgacggtggcattgggctgttgctgttctcgggttctcgattggtcagcggcagcagcacggggcggctgcgcctgtgggccgtgggggctgtgtcggagctgaggtgcaagggctcaggcgccaggtccagttctgtgttcatggaacacgagctggtgctggacggggctgtggtgagtgccagcttcgatgacagcgtggacatgggcgtcgtgggcaccacggcgggcacgctgtggtttgtcagctgggccgagggcaccagcacacgtctcatcagtggccacaggagcaaggtgagggacttccagcctgggcagaggcggggcagccgaacctggtgccctccctgcctgccggctccatctccgccagcccagatgattccaagtcctgccgtcactggctcgcagcggccgccttggggttcccagcggggaagtcttgggtgtgcacgtcccctcaaagccgtcccggttgtgtctgcacaagcgagccgcctggcaggccttgcaggtcttctcaaactgtcctttccctgctattgctttgcgtttttttgtttgtttgttttttgttttttgtaattgtcaaagaaatcacatcagtccgggcgtggtggttcatgcctgtgatcccagcactctgggaggccaaggcaggtggatcacctgaggtcaggagttcgagaccagcctggtcaacatggcgaaatcccatctctactgaaaatacaaaaattagccgggcctcttgatgtatacctgtaatcccagctactctggaggctgagacaagagaatcgcttgaacccaggaggcagaggttgcagtgaaccaagattgcaccactgcactccagcctgggcgacagagactccatctcaaagg

SEQ ID NO: 1841 - DNA, 2675 bp, Homo sapiens
aaccttttgagcacctgctgctccatgtactcttgggaaagcaacgattaataagacccagtcctgccctcgaggagccagctcatggtttggtgaggaagcccaggcacacggctaaccctggagtaagccagcctgttatgtgatacagggagggcagagtgctgaaggccgggaaaggaagagcaggagctgggccttgagcagactgtttggtgtggccgatggcccaagagccaaccagaggttctgttgagattttcaacccaggaggtgggcagaggggtggcactgggggcagaaatggagtcactgtaagggaggagtgggctttagggaagagatggcagggcaggtgggaatccagagccaagacacgtgcgagaggctggggttgagttcaagcgtcagcagctggaagcggaagcaaccagagtggtggattcttggaagggggaatgacctaaagcctaagatgaagtctcctggccctgcagcagtggcttctctggatgatgaccattttaatggcagagctgtctgcccctactgtcctagagaggtgatactggggcccactgaccaggggcccactagaggacaacagaggcatacatatgtttaaagcgtgagtgcctagcactgcatatatgcatattgttgaatctcttcatgtgtcctgtgaggtacctgtttctatcccctctctcaagacaagggaacttaaatctcagagaggggaagctgccaccctgggtagcagcactgggaagggacagaatcaggactctcacccagcagtgctggggtggacagcatggctgtgtgcgctgcaagccctgacttcctggcctgcaggagctgtctagggagggcgtgtaggggagacgtgtccttgggaggtgtgtgtctgtctccattcagaggtgtgatagggaattccctaactgcccccgccacccagctccccagtgactgctttctctgaaccaccttagtgaaattatctaggagatcagagacggcttggcctgggacggcttggtctgggacctgggatggtcagaagcccccctcatgccccgtccccttccttcctctcctctgggaggctggttcctgacgctggctcctcacctctgccctgcctctgtcgcttcctccttccccctcccctggttgcagatacagtacctggactccgtgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtacct

SEQ ID NO: 1842 - DNA, 1642 bp, Homo sapiens
agctctgggagaggagccccagccgtgagattcccaggagtttccacttggtgatcagcactgaacacagaccaccaaccatggagtttgggcttagctgggtttaccttgttgctattttaaaaggtgtccaatgtggtgtgcacctggtggagtctgggggagacttggtccagccagggcggtccctgagactctcctgtacagtctctggattcgcccgtggtgattatgccatggcctgggtccgccaggctccagggaaggggctggagtgggttgctttgataacaaataatgctcgaggtggggcaacagagcacgcctcgtctgtgagaggcagattcaccatctcaggagatgattccaaaaacatcgcctatctgcaaatgaacagcctgaaaaccgaggacacaggccgctattactgtgctagagtcgtctattattatgatagtggtggtaaccgtagggaggatgcttttgatgtctggggccaagggacaatggtcctcgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcaatacaacagcacataccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatgagtgcgacggccggcaagcccccgctccccgggctctcgcggtcgcacgaggatgcttggcacgtaccccgtctacatacttcccaggcacccagcatggaaataaagcacccaccactgccctgg

SEQ ID NO: 1843 - DNA, 2462 bp, Homo sapiens
gtttccgattccggggtggccgggtggcggcggcggcgctccggtcgcgatgggccagaggtgacgccgcagccgccgggagccgcgagggacggggcaggatgaaccgggccaagcccaccacggtgcgccggcccagcgccgcggccaaaccctcagggcaccctcccccaggagacttcattgctctgggctcaaagggtcaggccaatgaatcgaaaacggcgtccaccctgctgaagccagccccttccggcctgccttctgagcgcaagcgggatgcggcggccgcgttgtccagtgcctcggccctcaccggtctcaccaaacgccccaaactctcctccacaccccctctgagtgccctggggcgcctggctgaggctgcagtggcagaaaaacgagccatttctccgtcgattaaagagccatctgtggtgccaattgaagtgctgcccacggtgctgctggatgagatcgaggcggccgagctggagggcaacgatgacaggatcgagggcgtgctgtgcggggccgtgaagcagctgaaggtcacccgcgctaagcctgacagcaccctctacctgagcctcatgtacctggccaagatcaagcccaacatcttcgccactgagggcgtcattgaggctctgtgtagcctcctgcggcgggacgcctccatcaacttcaaggccaaggggaacagcctggtgtctgtgctggcctgtaacctcctcatggccgcctacgaggaggacgagaactggcccgagatctttgtcaaggtgtacatcgaggactccctgggggagcggatctgggtggacagccctcactgtaagacgtttgtggacaacatccagacggccttcaacaccagaatgccccccaggagcgtgctgctgcagggggaggcgggccgcgttgcgggcgacctgggtgcagggagcagcccacacccctccctcacggaggaggaggacagccagacggagttgctgatcgcggaggagaagctgagccccgagcaggagggccagctcatgcccaggtacgaagagctcgcggagagcgtggaggagtatgtcctggacatgctgcgggaccagctgaaccggcgccagcccatcgacaacgtctccaggaacctcctgcggctcctcacctccacctgcggctataaggaggtgcggctgctggcggtgcagaagctggagatgtggctgcagaaccccaagctgacccggccggcccaggacctgctgatgtccgtctgcatgaactgcaacacgcacggttccgaagacatggacgtcatctcacacctgatcaagatccgcctcaagcccaaggtcctcctcaaccacttcatgctgtgcatcagggagctgctgagcgcgcacaaggacaacctgggcaccaccatcaagttggtgatcttcaatgagctctccagcgcccggaacccgaacaacatgcaggtcctctataccgcactgcagcacagctcagagctggcgcccaaggtaggcccagggtccctggccttgccttccacgccggaatatggggctctgggctggaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctgggcctctggttctgacactttctgctggaagctgtcaggctgggacaggctttgattttgagggttagcaagacaaagcaaataaatgccttccacctcaccgc

SEQ ID NO: 1844 - DNA, 2197 bp, Homo sapiens
cttacccgcgaggctttgcggtggctgcttggcttggcggtggtcgcttggcttggcgtggcagtgatcgcttggcttggcatttctggcttggcggtcctcctttcgcagattggaaaccgcgggctatcctgctgggaggttgtggccgaggcagtagctcgctactgatggcctcctggggtggagaaaagcggggaggggctgaggggtctccgaagctggcagtctacgccacgaggaagacccgtagcgtcaggagccaggaggaccagtggtacttgggctacccgggggaccagtggtcttcgggcttctcctacagctggtggaaaaatagcgtcggcagcgagagcaagcacggtgagggcgccttagaccagccccagcacgacgtccgcctggaagatcttggcgagctccacagagctgcccggtcgggcgacgtccctggggtggagcacgtcttggctcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttggtgataaaagtccatctgtatcaccatcaatgcctgaaaatcagtcagcaaccaaagaactgggacagatgaacttaacagaacgagaaaaaatggacactggagttgtacttctctcagggaatgatactctccatgacctgtgccaatcacagctaccagaaaacaaagagagcaaagaagaacaagacttggagctgacatcagaggaagagcaagaaagacttaaaggatgcgaaaataagcagccacagaaaacgtctcaagaaccagaaatggctaaggattgtgatagagaggatatacctatatatccagtacttcctcatgtgcaaaaatctgaggaaatgtggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtgaaggatattccctttaatttgacaaataacatacctggttgtgaggaagaagatgcatctgaaatatctgtctcagtggtattcgagacatttcctgaacaaaaagaacccagtctcaacaatatcatccatccatactatcatccgtactctgggtcccaggaacatgtttgccagtcatcttctaagcttcatttacatgaaaataaattagactgcgacaatgataacaaactaggcattggacatatttttagtacagataacaactttcataatgatgcaagcactaagaaagcaaggaacccagaagtggttacggttgaaatgaaagaagaccaagagtttgatttgcaaatgacaaaaaatatgaaccaaaatagtgacagtggcagtacaaataactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaaaatgttcaacttcataaagaggttgaagaagaaatggagaagcacagaagtaatagcacagaattatcaggaaccctaactgatggtactactgttggcaatgatgatgatggactaaatcagcagattcctaggaaggaaaatgaagagcatgacaggtaagcctatagcagcgtttaacaggagacaattggtcaagcgtggtggctcacgcctgtagtccagcaatttgggaggccaaggcgggtgaatcacctgaggtcaggagttcaagaccagcctgaccaacatggatgaaccccatctctgctaaaaatacaaaattagccgggcgtagtggtgcatgcctgtaatcccagttactcaggaggctgaggcaggagagtcgtttgaacctgggaggcgggggttgtggtgggccgtgatcatgccattgcactcgagcctgggcaacaagagtaaaactccatttc

SEQ ID NO: 1845 - DNA, 1744 bp, Homo sapiens
cacttccagggtcggggagacggaactgcggcgaccatgtatttctggtttatcaaaccgctaacacccagtctaagggcaggttctgtcccattgttatcactatcgaagcagccgatggaggaggggaggtctgagcagagggcggggtgcaggcggaatggccctcgtgccctatgaggagaccacggaatttgggttgcagaaattccacaagcctcttgcaactttttcctttgcaaaccacacgatccagacccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcaaacactggaacatctctgtagcaatcactctgtgattcttttagcatgccgaattcgctatgaacgggataacaacttcttagcaatgctggagaggcaatttattgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaaccatatttaatgaaatgtcttactgtacaaaaagtctaagccaaaggttctcaggggagaaagcacatgtgcagttttaaaacaaagcagtgctttgtcccattgctgtgatttttagtcagactttactcagtctgaaatgcaattaacattaaaggattaagtgtgagatttcgatttatgctatttgtgtatcccatactcctcccttttaataaacagtttccactgatgatatgaagggccggtataaagaagtctttaaatgagtaagctttcttggtaagattaaatcttacaaattatttttaaaaccttgtgatatatacaatgtttagctgagttttctaattttctggatgtaaaacaaaaggtttaacctatacattccttgagctgttagtgctatttaaatcttttgccctgtttaggtcctaaacacttttagttgagtaggatatgagcttttttgggtctcatatcatgctttttgccttaatttcaggtatatatatatataagtaaaggaattaagtaaaaataaaatttcagttactttttaaaagcacctgaaatctggccggatgcggtggctcatgcctgtaatcccaccactttgggaggccgaggcgggcagatcacctgaggtcaggagttcaagaccagcctggccaacatggtgaaaccccatctctactaaaaatacaaaaattagccgggcgtggtgtcaggcgcctgtggtcccagctgctcaggaggctgaggcaggagaatcgcttgaacctgggaggcggaggttgcagtgagctgagattgcgccattgtactccagcctgggggacaggagcgagactccatctc

SEQ ID NO: 1846 - DNA, 1865 bp, Homo sapiens
tatccaatgacgaaatcaaacgggcaattctaacaatggacgaacaggaagatctgcccaaggacatgttggaacagctcttgaaatttgttcctgaaaaaagtgacattgacctattggaggaacataaacacgaactggatcggatggccaaggctgataggttcctttttgagatgagccgaattaatcactatcagcaaaggttgcaatcgctgtacttcaaaaagaagtttgcagagcgtgtggcatttggaaattatatgaataaaggtcaaagagggaatgcatatggattcaagatatctagcctaaacaaaattgctgacacaaaatccagcatcgacaaaaacattacccttttgcactatctcatcactattgtggaaaataagtaccccagtgttctcaatctaaatgaagaattgcgagatattcctcaagctgcgaaagtaaagagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggaggaagaagaacgtcgagctcgcatggaagctcagctcaaagaacaacgtgaaagggaacgtaaaatgagaaaagctaaagagaatagtgaagaaagcggagagtttgatgaccttgtttcagctttacgctcaggagaagtgtttgacaaagacctttctaaattgaaacggaatcgcaaacgtattaccaaccagatgactgacagcagcagagagagaccaatcacaaaacttaatttctaattttccatgaatacttttttttagaaagctcattagcagccctctaaagtgactagaacgtttcattacactgccttgcaatccaaacagtggcaattttttccttcatctgtgagtgaatgtgtgaacgtgtgtatgtaaatgtatgtgtgtatatattaaaaaatgtatatagatgtctgagtgttgtctggagacctatacgtatggttaaaaagatttatgttaatgtatgtgctccaaaacctttcgtgtatgcattcacattgagtgtggctcattttctttccccgaacgccatgactgttcagaagcacaatactatctcctgaaagagataagagacattccctagattcaaaggcaaaacagaagaaacaaacaaacaaaaaaaaaaaagcttgcaaaatattttatggtttccaagcttgatatcctttaaaattattttcattgatggaactggagttgttggaaaaacatagatttaaaatgatttttgatagctgacattgtgatgttgatgtatcacatcagtaataggaccagctttgaatttctgacattggtgtggggatacagtctgtaaatgtttattgagaacatcttgcacacaatttgaattatgtagaatgtcaatcaagtttttgtatatttaaaagttggacatcaattttttcccctgatttcatcaagttatctctgccaagtgctcttgataatttcttcagatttttggaaaaaaacactatataaatgcaatccatgctttttttaaagaacaacattgccagagtatgcttgttctaacaatatagatatataaaccttaaaaataataaaatatctcacccaagacttaaaggaagaattctctgaagggataaagattact

SEQ ID NO: 1847 - DNA, 1920 bp, Homo sapiens
ttaggctcaacacattccacccttagcataatcgtggttttagcctttgtattagtccgttttcacgctgctgataaagacatacccaagactgggcaatttacaaaaggaagaggtttattggacttttagttccgcgtggctggggaggcctcacaattatggtggaaagtgaaaagtacgtctcacatggtggcaaacaagagagcttttgcaggcacactcccttttttaaaaccatcggatctcgtgagacttattcacaataatgagaacagcacaggagagatgtgcccccatgattcaattacttcctgccgggtccctcccacaacatgtgggaattcaagaggagatctgggtggggacacagccaaaccgcatcagccttcttttggaaaactgactttgtctgcccaccacagccactctgcttccaatcatagcacctctttccctgggcatacagggaatccttgcccttctcatactgtgtcacttttgtaaggctgatgcttaccacacttcttacacaaggttctttgggttttaggcacattgaccatctccgcagcagagctgccctgtctatacgatgaaaacaggaaactgcatctgcaaccctcacctcgtgtcactcacacataactggatttttctattttttcaaaaatcattgggatgttgacaggggttgcactgaatctgtagaatactttggtagtactgacatctcacctaaattaagtcttccaatccatgaacatgagaaatctttccagttgtttatatattctttaatttctttcagtaatattttgtagttttcagtttacaaatcttctctttggttaagacaactcctaagtattttactctttttgatgctattgtaaatggaattactggccaggtgcggtggctcgcacctgtaatcccagcactttgggaggccgaggcaggtggatcacgaggtcaggagttcaagaccaaactggccaacatggtgaaactctgtcgctactaaaaatacaaaaattagctcggcatagtggcatgagccgataatcccagctactcgagaggctgaggcaggagaatcgctcaaacccaggaggcagaggttgcagtgagccgagatcgtgccactgcactccagcctgggcgatagagcgagactctgtctcaaaaaattccagatcagaactctaggagaaaatgaatttcccaccacctgtctatcaatcaaatacttactgaatgactatcacattgccaacgctatgctaggcactaaagatacaaagatcaaaatactgaatccctaccttcaaagagctcatcatctaaggtggtaacatgcaacacatggggcattagggaatatgtactgtgctccaggtcagggttaaggtagtaaggaagacatcaggaaaggaagcagtaaccactgagttgaatcttaaaggatgaataggaggtagaggttataatgtgttgggcactgtgctaagtgttcaagctacaaagattaatcagaggaagtctctgcacatagttctgtaagggaaaaagccacataaaaaaacattttcaaaacaatgagattaaaagttttaagacagacatgttataaaaatagaggagaacaagctcagtagggaaggggaatagagcaaaggaaaagttacacaaagaaactcatgtctgaactgaatcatgaaggataagcagatattcaataggtgggcaacgcagggaggagggcattctaggcagggagaatagtatgagcattggaacaaaggtaccaagtgtgacttgagagagcccaatgtgattaggaacttgcatgtggcttagtttcactgaaatgtaggctatgaaacaaaaaagaggttagaagggaaataaagtaag

SEQ ID NO: 1848 - DNA, 1649 bp, Homo sapiens
acaggaagtgtgcccctctctcaggcagctgctaacacctgtcttccttcaactcccacagacaacggccctgtagggaagtgacacacgggcacagccaccgtgttcgtcactgtcctggatgtgaatgacaaccggcccatctttctgcagagcagctatgaggccagcgtccctgaggacatccctgaaggccacagcatcttgcagctgaaagccacggacgcagatgagggcgagtttgggcgtgtgtggtaccgcatcctccatggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcgacgcctacaccagcacccaggccaaagccctcttcaagatagacgccatcacgggtgtgatcacagtccagggcctggtggaccgtgagaagggcgacttctataccttgacagtggtggcagatgacggcggccccaaggtggactccaccgtggtctacatcactgtgctggacgagaatgacaacagcccccggtttgacttcacctccgactcggcggtcagcatacccgaggactgccctgtgggccagcaagtggctactgtcaaggcctgggaccctgatgctggcagcaatgggcaggtggtcttctccctggcctctggcaacatcgcgggggcctttgagatcgtcaccaccaatgactccattggcgaagtgtttgtggccaggcccctggacagagaagagctggatcactacatcctccaggttgtggcttctgaccgaggcacccctccacggaagaaggaccacatcctgcaggtgaccatcctggacatcaatgacaaccctccagtcatcgagagcccctttggatacaatgtcagtgtgaatgagaacgtgggtggaggtactgctgtggtccaggtgagagccactgaccgtgacatcgggatcaacagtgttctgtcctactacatcaccgagggcaacaaggacatgaccttccgcatggaccgcatcagcggtgagatcgccacacggcctgccccgcctgaccgcgagcgccagagcttctaccacctggtggccactgtggaggacgagggcaccccaaccctgtcggtgagcgatgggggtggccacagggaggagcgggtgggccagggcagctccgcctccgagtgaggggaacaagatgggtgagaatggaattccacacagcaggcgaatccttgac

SEQ ID NO: 1849 - DNA, 2071 bp, Homo sapiens
caaggtgcctggggagacggggcaccccggaggcctgggagtgagggtgggccatgggaccccggaaaccagggcagagccccaagggctgatgactccccgcccccgcagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcggtgaggagccgccccctggacctccccagtggcgctgctcgcatgggcgcaggcggtggtgccgggagcggccagcaggtggcgcccaagcctggcctaccgaaagggaaggggttgcagaaagggaaggggttgcagctcctcccgaccccagacggggtgctggcccttggcccagcctgggagaagggcgggggcgaggaggaagttgccctcacacctagcttccaggggccattagcccagccaagcgccctcagccctggccagccccctatccccaacaggccaggcttgactgctcagtgccagcccccccacttttccatctggcttcactaactctcaggaatgggccccaggcccctgaggtgggggtgggggactaaatcacttccctgggcaggtagggctggtctgtggcccagcagccatacccccttggccaagaggagacggactcaggcagctggagactcaggctggggtacacctgcttcctgtcccccagcccctgggagcagaagtggcccctccagtctcccctccagcatttcctattcctggcccccagctgttccccctgctctgccccacatccatgccaggcctgagtcaggattcctgccctcctgggatcaccccggccccagcccccagaaacttgcagaagcctggagaagtttggggtggtggtgaaagccaggaaggacaagttcctgcccagaacgtgctaaaaccaagcttcccccacactcactcctctcctgcctcccacagacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctg

SEQ ID NO: 1850 - DNA, 2560 bp, Homo sapiens
acttccttattgttatacaaaaatacacactcatgactaaacatttggaaaatatgtaaaaatgtagagaaaagtaaacatatctcagaatggcatctctcatatgttgccacggattataggtttggttttgagagttttttctaatgtaattgagatcgggacccagggattagagtccctgtattacccacttaacatgaaattgtgcattttccccttcatgtcattacaaattagttggcaactgtgtgtaatggcagcatgccaaagaagctctttctagcagtaagggatgtctagcaatggagtaggctgcctggagaggtggtgagctccccatctcttgaggtaggcaagcagagtcttgaaggagctgaggaggggcccagcaccatatgggagtggagtggcctggccctgagaacccacgaaatccattgtctggctaggaggggctattccacgtgaatcgccaaacgaccccagactccagtgtcctgaacgttcgttgctcctgcctgcgggcatgcacagaaatctcctctcacacgctcatcctttgctcatcctttgcatgttctggcctcccagaaaatcacagagcggttcttccgcaacccagcgaagcccgcggaggaggacgtggcagagcgcgtgtttctggtcgcggaggagcgcatccagctgcgctaccactgccgtgaggaccacatcacggcctccaagcgcgagttcctgcggcgcaccgaggtggacagcaaaggcaacaagatcatcatgacgcccgacatgtgcatcagcttcgaggtgggcctgggggccacggcgggcaggggtcggctgcaggaggaaccggggctctctgtcttattccagccacttgggagaaccaggatgggcgctggtgaatcccggcgaggaaattcatctttgctctttgggaaaaccaaaagttcccatctggggacccttctctttgagctcctctgaaaatcttccttttccaccaaaaaagcgaactcagcaggctaagacgactctgcagtcctggtcagggcaaacctcagatcctagggaggctctgtgggaggggaagagtctcactacctctgaggggctagccttcctagtcaaacgctcactctcccggcacagtccccagcttttctgagtcttcagttcctcttttattattatctgtatttttataagtgagaaaattaaggctcagagaggtttagcaacttgctcgaggtcacacagctggaaagtggcaggggtagatttgaacccaggtggtcctatgccccgatcatggcagcctctctgtgttactaaggtggttgttgtcccaggtggagcccatggagcacaccaagaagctgctctaccagtacgaggccatgatgcacctgaagagggaggagaagctgtctagacatcaggtctgggagtcagagctggaggtagggtcctgtgggagagtgagcaggtgggcggtatctttgtttttgagacagggtctcgctctataacccaggctggaatgcagtggcgcaattatggctctacatcccgggctcaggtggtcctcccacctcatcctcccaggtaactgggaccactagcgcacaccaccatgcctggctaatttcttgtttttgtttttgttttttaacagatggggtttttccattttgcccaggctggtctcaaactcctgaattcatgcaatctgccctccttggcttcccaaagtgctggggttacaggagtggaggaggggtgtctccatcacgccctccaacacttctcatttcaggtgctggagattctgaagcttcgagaggaagaggaggcggcgcacacactgaccatctccatctatgacaccaagcggaatgagaagagcaaggaatatcgggaggccatggagcgcatgatgcacgaagagcacctgcggcaggtggagacccagctggactacctggccccattcctggcccagctcccgccaggagagaaactaacacgctggcaggcggtgcgcctcaaggatgagtgcctcagcgacttcgagcagcggctcatcaacaaggccaacctcatccaggcccgctttgagaaggagacccaggagctgcaaaagaagcagcagtggtaccaggagaaccaggtgacgctgacacccgaggatgaagacctgtacctgagttactgctctcaggccatgttccgcatccgcatcctggagcagcgcctcaatcgacacaaggaactggccccactgaagtacctggctctggaggaaaagctctacaaggacccacgcctgggggagctccagaaaatattcgcttgatgtccctcctggggcctcagccagagctgccagagaaaggaaacctcttcccgcagcctggctcctgtgttccctctatccagccaatgcctgtttacacagacacctggcctcactgccagcccacctcccctacagccctgtttgttcctgcttctcatgattttcctgtaaataaacacactcttaatttgc

SEQ ID NO: 1851 - DNA, 2331 bp, Homo sapiens
tagtatacataaaataattcatactggagaaaaaccctacaaatgtgaagaatgtggcaaagcttttaaacgatcttcaacccttactatacataaaatgattcacactggagaaaaaccctacaaatgtgaagaatgtggcaaagcttttaatcggtcctcacaccttactacacataagagaattcatactggacacaaaccctacaaatgtaaagaatgtggcaaatcctttagtgtattctcaacccttactaaacacaagataattcatactgataagaaaccctacaaatgtgaagaatgtggcaaagcttttaaccgatcttcaatccttagtatacataagaaaattcatactggagaaaaaccctacaaatgtgaagaatgtggcaaagcttttaagcggtcctcacacctcgctgggcacaagcaaattcatagtgtacaaaaaccctacaaatgtgaagaatgtggcaaagcctttagtatattctcaacccttactaaacataagataattcatactgaagagaaaccctacaaatgtgaaaaatgtggcaaaactttctaccgattctcaaaccttaatacgcataagataattcatactggagagaaaccttgcaaatgtgaagaatgtggcaaagcttttaaccattcctcaaaccttattaaacataagctaattcatactggagacaaaccctacaaatgtgaagcatgtggcaaagcttttaggcggtcttcacatcttagtagacataagataattcattggaattcatactgaagagactgtacaaaagtgaagaatgtggcaaaggcctttactgctcctattcccttactaaagaatgtggcaaagcttttcaccagtactttacccttaatacacataagataattaatgctggagagaaaccctacaaatgtgaagaatgtggcaaagatttctattgattctcataccttactaaatataagataattcatattggagagaaattctacagatgtgaagaatgtggcaaaggctttaattagttctcatcccttactaaacataagagaattcataccatagagaaatcctacaaatatgaagaatgtgacaaagcttttaaccacttctcaaccctgcctacacgtaagataattcatactggaaggaaaccctacaaatatgaggaatgtctcaaagctttttactgattcttataccttactaaacataaaataattcataaaggagataaattatacaaatgtgaagaatgtggcaaagcttttaacaaatcctcatccattagtaaacataagataattcatactggagagaaaacctacaaatgtgaggaatgtggcaaagcctttagcctgtccctccaatttactgcacataagataatttatactggagagaagccctacaaatgtgaaaaatgtggcaaaccttttaaccaatcctcaacccttactacacattagataattcatgctggagagaaaccctacaaatgtgaaaaatgtggcaaagcttttaaccaattttcaaaccttactaaacataagataactcatactggagaaaaatcttacaaatgtgaacaatgtggcaaagtttttaactaatacaccttattgcacagaaaatcatttatatttgagaaaaattgtagaaatatagactgtgaaaaagacgtcaatatctgctcacatcttactaaacaccagagagttcatgcttaataaaagcatgataagtgcaattactgccaaaagatctttcagaaaatattatcctttaaagtgaaggagagtatttatattaaagatgaacattacaaccataaagagggttgaagtacctttacttgtatcagatcttattgtccacattttgtactacagaaaaactctgaagaggtcactcaaactttgttcaacatcagggaatttatattggagagctgtcttgcaaatgtaataaatttgggaaaacaaattttcaaaaactacagcttagaaaacaccagagtttatacgaaaatatattttcaaaggtgtagtaaaaataaaaaaaattttaatccaaatttgtctatgtaaataccagaatttatagtagaaatatatgaggaagcgacacttcgaatattctactaaatgagagttctgagtatagaaaataaaactaaagttggtagaaaaattatttgtatataatgttaagaggagtaaaagattttttgtagaataataactatattcagattatactttgtttcttgaaaaaattacagattttttgaaaagcaaaaaaaaaac

SEQ ID NO: 1852 - DNA, 2183 bp, Homo sapiens
aagcatttacctatctaggtaagtcaggaggagctcaaaaggagaagaaaacagtaggaggcaggggaagcagcctctgtctccatctctgccctttgaaacaaaagggtatttcttttctctcttcagcccccaacccagtggaggcccggcttgggacattgttcacttcccctcgcttcccctctagaagccccctttgccatccctgcaccttgtttcgggtgatgcccgagagggagctgtggccagcggggactggctcagaacccgtgacccgtgtcggcagctgtgacagcatgatgagcagcacctccacccgctctggatctagtgatagcagctacgacttcctgtccactgaagagaaggagtgtctgctcttcctggaggagaccattggctcactggacacggaggctgacagcggactgtccactgacgagtctgagccagccacaactcccagaggtttccgagcactgcccataacccaacccactccccggggaggtccagaggagaccatcactcagcaaggacgaacgccaaggacagtaactgagtccagctcatcccaccctcctgagccccagggcctaggcctcaggtctggctcctacagcctccctaggaatatccacattgccagaagccagaacttcaggaaaagcaccacccaggctagcagtcacaaccctggagaaccggggaggcttgcgccagagcctgagaaagaacaggtcagccagagcagccaacccaggcaggcacctgccagcccccaggaggctgcccttgacttggacgtggtgctcatccctccgccagaagctttccgggacacccagccagagcagtgtagggaagccagcctgcccgaggggccaggacagcagggccacacaccccagctccacacaccatccagctcccaggaaagagagcagactccttcagaagccatgtcccaaaaagccaaggaaacagtctcaaccaggtacacacaaccccagcctcctcctgcagggttgcctcagaatgcaagagctgaagatgctcccctctcatcaggggaggacccaaacagccgactagctcccctcacaacccctaagccccggaagctgccacctaatattgttctgaagagcagccgaagcagtttccacagtgacccccagcactggctgtcccgccacactgaggctgcccctggagattctggcctgatctcctgttcactgcaagagcagagaaaagcacgtaaagaagctctagagaagctggggctaccccaggatcaagatgagcctggactccacttaagtaagcccaccagctccatcagacccaaggagacacgggcccagcatctgtccccagctccaggtctggctcagcctgcagctccagcccaggcctcagcagctattcctgctgctgggaaggctctggctcaagctccggctccagctccaggtccagctcagggacctttgccaatgaagtctccagctccaggcaatgttgcagctagcaaatctatgccaattcctatccctaaggccccaagggcaaacagtgccctgactccaccgaagccagagtcagggctgactctccaggagagcaacacccctggcctgagacagatgaacttcaagtccaacactctggagcgctcaggcgtgggactgagcagctacctttcaactgagaaagatgccagccccaaaaccagcacttctctgggaaagggctccttcttggacaagatctcgcccagtgtcttacgtaattctcggccccgcccggcctccctgggcacggggaaagattttgcaggtatccaggtaggcaagctggctgacctggagcaggagcagagctccaagcgcctgtcctaccaaggacagagccgtgacaagcttcctcgccccccctgtgtcagtgtcaagatctccccaaagggtgtccccaatgaacacagaagggaggccctgaagaagctgggactgttgaaggagtagactctgcgaccagtacagaccctgtcctggctgaacaagaagagacacatgctccacttgggagcctttgccaccacgcaactcagggctcaagatgaatgggagggagagatttgagtccaagcatacatttatattcagtgttgtgcc

SEQ ID NO: 1853 - DNA, 3114 bp, Homo sapiens
tgtggccatgaaaactgtggcaaacgatgtgcggtaggtcctcctgccctggtggtgaaaatgactcctaagatgtagctgtggcactctgtggctcacttcctgtgtgtctgcttttccctagatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacaggtaagaacctgcatgaaaatgtcgtagtctggccctggttaatataccattgttttcatcataaagaaaaaggcaaaaccaaacatgctcgacctaccagcatttattctgatatcatctttgtagcaacacaattatagcattcactttagctgtcagtaacaagcttcctcgagtctcacagtcacaggattgtcttagttctttgcagttggctctatgtacacaagaacatgctgcccatagacacagcgctcccttcaggatctaattcactgcctctgctctcgctgcagagacagaaaaaaaagtgatgtctgctctttgtttgctgttatattcccaactagtatacataagtaatagccaaccattcaatgcatcaggcactatgctaaacccatatgactcaaatattaagcaataggcttaagatcacctactcaggaaataacaggcttcaaaccttgagtcgctctgtgcaaaagctcctacttttaacctgtattccacacttgctgtttggttggattttctgcaattccttcctaataaggagtcataaaaatgcctaagcagtaagtatggagaatcactagcaatctttgaacagcagctcatgaaaagcctttcgttgtgaaagaaaaccaggaagcacttgtttcctggggatatgatttaggagaaaaaaaatgcatttgtttgtagcagtgaaagttcttgtttctatatcctcctaaaatatatatattattgaattaatgaaagtccagctttgatcctatctttgagagggttattttatgtcttatatttttcaaaccatttactcctctggtgccagatctgttaactttcttttaaaaataagacaaaaacctaatgaaaactgaaagcccattgctaccatgaaaaactttgctgaaaataaaaggaaactttctgtaattttgggggaaggttaaaatgaaaatctagttttccttatcaggcaagtatagcaagattaataatttctttggcaaatttccaagaaaataagggaatgggaaaccttcaatatggagcttctttcaagcagtacggttggggaagggcagagaagtatcctctagggattgctgtcatgcagcttacctttagccttgaatttcatacaaggcagagttcaaagtaagtgattacttgtactaaatgtactcacttagtacgttttggggacaggcataaagagccagtgaccaaaatggctgaagtgatttggcagggaatgatactctcctctgatttggggtagtaaatacaccaggtttcccagctgagtcactgtagggatggcttcttcccagatactacagggaggatctgttacctttgtttataagacaaaagacactttcaaagggcaggccttttcatgtagaagagtcaggtccataactcggtagcatttaatttgaaaggttacccacattgagctcataccagtgtgaaacttccatggcattatcttttaaatccctaagattaaaaccccacacaaatgcactcaaagcaacccaacatcagtatcctgcagtttctatgggccctttctgcagcctttactcatggaagacaagggatctgggtttgtttaggaaacattttgtgagcattgtccaagccctaagtatggttggcctaagctttgctgaagctaagatcagtctgtttatgtttgcttaaaataggaacttaaaggactaaaatgtcatcgttatttatcctgattatagcctaatggtattttattttctctacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagagtgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacc

SEQ ID NO: 1854 - DNA, 2580 bp, Homo sapiens
aactgctccgactgtcgcggtgagggccccaggacagaagcagacagacacggctcctgctgtcgattccgatccagccagaatgcctccaactcaggccgaaagtgttataaggagtattatacgagaaataggacaagaatgtgcagcccatggagagattgtttctgaaactctgattgcttttatggtgaaagctgttgtcctggatccaagtaatggctttaacatggatagaaccctcatgaaaagtgatgtgcagaatcttgttaagctttgtatgactcggctattggatactaaaaatccatccctggacactattaagatgcaagtctacttcgatatgaattatacgaatcgagtggaatttctcgaagaacatcaccgggtcctagagtctagattaggctctgttacccgagaaattacagataacagagcatgtgctaaagaagaattggaaagcctctaccggaagattatcagctatgtgttactccgctctggccttggatcccctacagacatcaagactgtcagagaggtaacagctgctctacagagtgtttttcctcaggcagagcttgggacatttctaactctttctaagaaggacaaagaacgccagctgaaagaactcaccatgattgttactggaattcgtttatttaacagagactgtggaaaaggaggagaaggcattgatgatttgccagctgttctccatgtagcaatcccagccaccatgcagcatattgattaccagcttgagactgcccggagccaggtataccgctacacagccatccttgagaaggcagccaacgacccactcatgagggctgaacttcagccatatatgttaaaagaagcgctatataatatacgacaatatgaggtcttccttcagatcattttgtcagatataattactggtgctcaagaagtggaaatgatgacaaaacagttaggagcccatctggaacaactaaaaatgaccataaaatcaaagatagcggtcccaacatcacaagtctttcctatcttcattgcactttctactctgtggaccagcttgcaagacgaaactattgtggttggtgtcctcagtaatttattcactcacattcagccattcttgggtgctcacgaactatactttcctgagagagtgatgcaatgtcatcttaatggagcgactgtgaaaactgatgtgtgtagaatgaaagaacacatggaagatagagtaaatgtggcagatttcagaaaactagaatggcttttcccagaaacaacagcaaattttgataaactgttaattcaatatcggggattttgtgcttacacgtttgctgcaacagatggtcttctccttccaggaaatccagcaattggaattttaaaatataaagaaaaatattacacattcaatagtaaagatgctgcatattcatttgcagaaaatcctgaacattatattgacatagttagagaaaaggccaaaaaaaatacagagttaattcaactattggaacttcatcaacagtttgaaacatttattccatattctcaggtaagcagggtcaatattttatgaatttatgacatttaaaaatatagttaatttaaaagttgtattttgttgtagaatgcttcccaggtccacacagagagagtcagatgagggtctttacaggttgtctgaaagggattcatatctgaagatgaaaactaattgaatcaaagaataatgaaaacaggatatggagtcaaattgatgaattaggaaatggggaaaatctgaatcagaacaacttcattgacttataaataattgaagctgcagtatatttctgtatctgaaattggaggagctcaacacagataacacagatagtaacttatactcagagctgcaaaacaatttaacaggtttaaattgtagtagtctgaaaggccacagaatggatctcaaggtgggtttcttgtatgtctgtgcctattgattaattcattcatcttatttagtaagccacttattgtgtgtcagtaattattcttggcataagggatttcatgaaacaaaacagataaaaatctctaccggtttggaactcacatttgaatgccgtatattctaatgttcttcctctttgtctctcattttcgttgttcatctctttttttgttctttttagaggcaaggtctcactctgtcacccaggatggagagcactggcacaatcatagcttactgtaccttccaactcctgggttcaagggatcgtcttgcctcagtctcccaagtagctgggactacaggcaggtgccaccatgcctggctaatttttttaaaaaacttttttgtagagatggggtctcgccatgttgcccgggctggtctcaaacttgtggcttcaagttatcctcccgccttggcatcccaaagtgttgggattataggcacgagccaccatgccaagcctgttgttcatctcttaagtggtctttctttctctcctgtctcttgttgaattcctctcttttaaactcactaaaatgaaaacattttgaaat

SEQ ID NO: 1855 - DNA, 2210 bp, Homo sapiens
tttcagagaggtcgcttgggtccatcagagtctctgccgtcactacctgcaagaggggaccggaagccagtgggcaggggctgggtgctcccctacagcacctctcctctttgacctcacctgtgctttgaggcctcctgattcctccctgctggagcccagagttccagaggcacctgagcagggcaggcttccaggcaggccagggcgccccagcagaggcacccgacgagatggggagggctggggagggcagcctggggcaggagggcttgggggacaggctcacctccacactgccagtctgggatcgtagcatgcggcccacccacgaggagcgggccagctgcaggaggcaggacttctgcaagttctgcagctcggcctccatctcctggagcgtgcgggtggtctgcagcagccgctcctccaggtgctccttctcctgctccgagagggcctgtggttggtggtgggggggtgtcttctgcagaaggcccccaggccagccccagcctggctccccaacaccaggaccctgcccactccctgtgcccctgcctcacccacggggctcgctccttctgttccttcaactcctggatcagcttctggacctggttctgcaggagtttctcctgactgtgggagctcctggaggaggggtgacctcagcagcccccaccctgctcaggcaggggttcctaatgtcaggtcagtggcgaaggaggggagaaggaggggctccactgccaccttggccccaagggcacacagtacagccccgctggggctggccagcctccggctggtctggacaagggtctagcacccatccacatgcgcagggttagggtggaggctatagcgtgttaacttaggatcagggtggagggtcagcgcgggcaaggatgagggtaaggatctgcctcagcggttggggttggggtcagacagagaccaggagtccgggcgaggacagggcggggttgggttgggctggggactgtgctgcagacctcttgggcggaagccccgccacctcttccaggatgtggcagagccgggcgtcctcgccattctggatggcccaccgcaaggcctggatctccagttctcgctgtctccacagcagccgcagtgtgcgagggtccagggactcaagagccaacctgcagcggcagcagaccctgctgcttactcaggccggcccctggccacctggcccaggaggctcaccagtcctccctctcctccttactgcgggtcggcagagcagaccaccggtgtggggtggggcgtggtgtctggcaggcacgtgggagtctcgggggctgcaggtgcgcctgctggaggtcccaggtgaccactgaccgactcttgctctgtgggggacaggagagcctcttcctcggtttctttaacctcctggccagacttgggggccattctcaatgttcttcgggagctgggaggggtggggggcccgtctgccgtgtgcgcctcgtgtggccacacaggttggagcagcccaggcgtcaccacttgctcacagagcgttgctctctgaagggacccacatgtgggtgtccacacccgtgtgtttctgaccaggctggcgcagcaggtcaccacccgacatgtccctggcgtgtacccctgccacccaggtgctggccctttgcctgtgatgtggtgtccctctttctctctcttgtccccccagctcagggccctacccccagcactcacctgaggcccgacctccaagcaggcctgggagggaagggctgtataccgttgccatggataccagcacccagaaggggtggggctgtttgttaccaggagcctccagggagaccccagaccaggcccctagagacagggtcttgctccgctgtccaggctggaatgcttcggtgtgatgacagcgcacgttaacctcgaattcctgggctcaggtgatcctcccacttccgcctcctgacttgctgaaactacaggcacccgcctccaccgccaggcccagcccacagctcctttgacctcagtgacaggcactcacctacctgacccccaaactgaagcctcacttttcccagccgtgtccacaccctctgggctaccccattaccatgacaagtattccctctgctccaggagaaaagccaggtcccagacctgacccattaaaacccaatcattcc

SEQ ID NO: 1856 - DNA, 2554 bp, Homo sapiens
agctggaaagatggggcaaggcagaagctgggcctcagacacaggcaggggacatgggccgactgcccacctcctggcccctgaccatggtggagtgggaggtctggatggagcagtgagaagcttgtctccaatgttctcattttctcctgcaccaacatcgtgggtgtctgcacccactatccggctgaggtcccccagagacaggctttccaggagacccgagagtgcatccaggcgcggctccactcgcagtgggagaaccagcagcaggaacggctcctgctgtctgtccttccccgtcatgttgccatggagatgaaagcagacatcaacgccaagcaggaggatatgatgttccataagatttacatccagaaacatgacaacatgagcatcctgtttgctgacatcgagggcttcaccagcctggcgtcccagtgcactgcacaggaactggtcatgaccctcaacgagctcttcgcccgctttgacaagctggccgcagagaatcactgtttacgtattaagatccttggggattgttattactgcgtctcggggctgcctgaagcaagggctgaccacgcccactgctgtgtggagatgggcatggacatgatcgaggccatctcgttggtccgggaggtgacaggggtgaacgtgaacatgcgtgtgggaattcacagcgggcgagtacactgcggtgtccttggtctcaggaagtggcagttcgacgtctggtctaacgatgtcacgctagccaaccacatggaggctggcggcaaggcaggacgcatccacatcaccaaggctacactcaactacctgaatggggactacgaggtggagccaggctgtgggggcgagcgcaacgcctacctcaaggaccacagtatcgagaccttcctcatcctgcgctgcacccagaagcggaaagaagagaaggccatgatcgccaagatgaactgccagagaaccaactccatcgggcacaacccaccacactggggggctgagcgccccttctacaaccacctgggtggcaaccaggtgtccaaggagatgaagcggatgggctttgaagaccccaaggacaagaacgcccaggagagtgcgaaccctgaggatgaagtggatgagttcctgggccgtgccattgacgccaggagcattgataggcttcggtctgagcacgtccgcaagttcctcctgaccttcagggagcctgacttagagaagaagtactccaagcaggtagacgaccgatttggtgcctatgtggcgtgtgcctcgctcgtcttcctcttcatctgctttgtccagatcaccatcgtgccccactccatattcatgctcagcttctacctgacctgttccctgctgctgaccttggtggtgtttgtgtctgtgatctactcctgcgtaaagctcttcccctccccactgcagaccctctccaggaagatcgtgcggtccaagatgaacagcaccctggttggggtgttcaccatcaccctggtgttcctggcggcttttgtcaacatgttcacgtgcaactccagggacctgctgggctgcttggcacaggagcacaacatcagcgcgagccaggtcaacgcgtgtcacgtggcggagtcggccgtcaactacggcctgggcgatgagcagggcttctgtggcagcccctggcccaactgcaacttccccgagtacttcacctacagcgtgctgctcagcctgctggcctgctccgtgttcctgcagatcagctgcatcgggaagctggctgccaacacgtaccagctggagtgccggggcgtggtcaaggtcaagggcaaaggcgagatgatgacctacttcctcaatggagggcccccgctcagttagcagctgttggccaatggtgccaggcagcctggcctccagaggcatggaagcagcttctctgtgtgccgggggtggcggggaagccatgctccagcccgcagggctgcgctgctgagattttccacttggactccagagcagcttctgcctttgctggtgggcagcggcctctgtcccaggccccggggtgccagcgtcctgcgagcacccagctgaccaaagatgtttccctctgtagaagactctgctagactgggtctgaagcttgagttttctaacaggtgctgctgcacaggtggagaggagccgtgggaatgtgtgtgtggcacggcccagacaagggcagggctgaggggcctccgactcagctgggggtagacgggctcgaatgtggcctgggagagcctagggggccccaggggtctgcttttctatgtgagcctttaaacttcagacaggccaccaccctgcacctgcaggggctttggcacaggagtgctggctttggagggactgtggccttcatcgtggtcctctgcccacacctccacgcacacagacagtgccctaggagggaaacagaactaattacgagggggaggcaagaggacgccaagcaaggagtggtgattctgagaaaaatatttattaaataaaacaaaac

SEQ ID NO: 1857 - DNA, 2122 bp, Homo sapiens
atttgttatacattagactatcagacactggacctaccttaatggttagacactttatgcaaaaaaagagaaaggtcccaggtgattttccacaaagaatgtgctaaaatgtccactgaaaacaaagccaagcctctgccctgcctctcccagctcccacaagggttccaggaattcctggtgttcccaggacaccagactgcaataactggaggcgcctccttcctgcccacccttcgctcacgccccagcgccctctctgaccagcctccgcttggtggccttcctctggccgtgtgatgaggtggttgctgtctccataggggccagctccccagggcagactcacgtgcccctctgaggctcagaaaatgcccagcccttcctcaaaatgagcagccacccatgactttgtgggctccttgttagcctgagaccaggctttgcagaggggcggggggtgaggcttagcccagaaggagaactgagcaggaaaccaaggctcttctctgtcccctgcccttcccctcctgccagggggaggctcaggttggtccccgagtgccgcctgtactcacaaaggctgcctttcctctagagtcactaattttacctgatgctatgagagaatcatattgaagatgaaatgtctaatatataatgtatattttaaagcagagactattttggtggataggtgggagggagcaaggggagtttgagggaatcagagcttgatgctactgtacagaactggacaggttgggccggcagtggtggggccagagggctctgtgctctaggagctaagccagcagcccccgagaggggacttggctgggcctttcctatgggcaaggcccagtgctcttcctgcccaccagggaccatggagcagtggcaccctatggggctatgatccctaggcctgggcctgggcctgcctatggcccagagctaccctgggagtgtcagtgctagcagcacagctacctctggtggcaggagaagagaggcccagcacagcagcaggccaggccttcctgtccaggtctgcatggagcactcggtgacccagagcagggactggaggcacccccagccctgccccaggccacagcaggacaggccgggacaggcctcacccaaggccaaggctggcatcagccaatcattcagagctgaggccctgggcctagcctgcccttctcaggtgccaataccaccccagccctgcccttggcctcactttttcccagcaataagtggggttcaccacccgcctcgggaatactttccccttctaaatgggacttgctgttacctcaggaggctccttagtgcaaatatgaccctggtcagggctttgccaccgttgaagccctgcagaaggtgcaatgtaggggttctggggccacagaggagaggccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctccagcagccctgaccacaccatgagagccaggaacgggtcaccctgctgaagatcactctgtgccctgggggaggagccaagccctcaccccacaaggggcaggtgggggcttggttgctgacccggcccaagtccccacagagcaccttctgtagctccagcttgtctccctggcttctctttgaaggagaaaaatgtaaaatatgcactgagaaagccagccccgcctgcttagtcagccccggcagcagggcagccatgggaactcaggaaaagcaggaaccctttccaaaagcccagagatgccctgggctcagatctgtaattctcccaggagctgtgatagagcaggccacacaaagtccctacgcctccctgctgcctcccccagatgcatgtggtggcatcaccattccccaaattgaatatcagcatgcggcctgaccagggactctttagatgcatgaatttatttatatgaaggctctcacagagacacacacagcacttcagtagcatttgcattcctggttaaagaatcacc

SEQ ID NO: 1858 - DNA, 2173 bp, Homo sapiens
tgagtactggttccaagtgacatgacccagcgattatgtttacagtctggacttctgatcaagagcgttcttgaaattttccttcagttttaagacattttcatgcaggcagagtgttcttcccctaaaggcacttgacactcattttttaagtgtgtagtgaacagtactaagatctaataatgaaaacaagttacatggctccctaagaacaagtactaacaaatgcagtagccaacaagattaccatgcaatcattaaggagaaccaaagtaagagagccactcaaaccagattttgaacgctactaaaattaaagtagttctttgatgaatatgaatgagtagggaaaggattctttgtgatagtgatacctctgtggtaagagaagggtggtatgtgagttttagtctacagattatggcaaattcagtgacaacaatcaaatggtctaagattgacagtagcacagttttactctgtgaaggtaatgttcaggacaaatttcaagaaaactagaaaaccattctttacagctgaaatctttccctaaccattgttatttccacttttaagtcctcaagagatgagaaaagggaggtaaggcttccttatacatttcctgcacaatgaaacatttttcctcctccaggcaaagattcaagcagaactggcaaatatcttatcttgctcttctcaataataataatgttgttagataataaagttctatagcaatttaaccctagaatctttttgaaaagtaattctttaaagttgagaatcacagctgtctagcaagcatttccttgggcacttgaagctgtttattcactttggtctttcctcccaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgcag

SEQ ID NO: 1859 - DNA, 2026 bp, Homo sapiens
atgtgtggctacggcatctgtacagcaccgacgaggtgtacaagggctacttccaggagggcctgcggcacggatttggggtccttgagagtggtccgcaggccccccagcccttcaggtacacgggccactgggagaggggccagaggagcggctatggcattgaggaggatggtgacagaggtgagcgctacattggcatgtggcaggctggtcagcgccacggcccaggggtcatggtcacccaggcaggtgtctgctaccagggcaccttccaggcggacaagacggtgggcccgggcatcctcctctctgaagacgactccctgtatgagggcaccttcaccagggacctgaccctcatggggaagggcaaggtcaccttccccaatggcttcaccctggagggctcgttcggcagtggggcagggagaggactgcacacacagggtgtgctggacacggctgccctcccaccagacccgagcagtacctgcaagaggcagctgggcgtgggtgccttccccgtggaaagccgctggcagggagtctacagccccttccgggactttgtgtgtgctggctgccccagggacctgcaggaggccctgctgggcttcgacgtgcagagctccagggagctgcgtaggtctcaggattacctgtcctgcgagaggacccaccctgaggacagtgtgggcagtatggaagacatcctggaggagctgctgcagcaccgggagcccaaggccctgcagctgtacctcaggaaggctctgagcaactcactgcaccccctgggaaagctgctccggacactgatgctgaccttccaggctacctacgcaggtgtcggggccaacaagcacctgcaggagctggcccaggaggaggtgaagcagcatgcccaggaactctgggctgcctacaggggtctgctgcgagttgccttagagcgcaagggccaggccctggaggaggatgaagacacagagacaagggacctccaggtgcatggattggtgctgcccctcatgctgcccagcttctactcagagctcttcacgctctacctgctgcttcatgagcgggaggacagcttctacagccagggcattgccaacttgagcctctttcctgatacccaactgctcgagttcctggatgtgcagaagcacttgtggcccctcaaggacctcacgctgacgagcaatcagaggtactccctggtcagggacaagtgtttcctgtcagccaccgagtgcctgcagaagatcatgaccacggtggacccacgggagaagctggaggtgctggagaggacatacggggaaattgagggcaccgtgtcgagggtattgggccgggagtacaagctgcccatggacgacctgctgccacttctcatctacgtggtgtcgcgcgcccgaattcagcacctgggagccgagatccacctgatccgtgacatgatggaccccaaccacacaggaggcctgtatgacttcctgctcacagccctggagtcctgttacgagcacatccagaaagaagacatgaggctgcaccgcttacctggccactggcactccagggagctctggtagcctggcctttcctggacagactgaagagctgagcagggcactgccagcctgtccctcattacccaaggcaaggggcaggacaggccctcagaagcagctcttggaggagatgagcattttgttttgcacaggaagatgctgctgctgccctgactgggatgagggtgaggggtgacgggtgtggccctggatgtggtggttttcccttggccactagcccatcttcaatgaccccttaatctgcagcagctcacaggctgggggtgaggagtccctggcttctcttagcctgagcctttctcccaagttccagagcctctccgggcctcagtgctgccatctgtacaatggtggagtgagtacgctgtaaaggaccttccattcattttgctgaattccagagtccttttggaaaactg

SEQ ID NO: 1860 - DNA, 3595 bp, Homo sapiens
attgccgccaccgaaggcggaggagggggaggaccgccaagagcaacgccgccgtgtgcccaacggtcggtgtccccggctgaggcagcgcggccgcagcagccctgtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgctgcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaattttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatc

SEQ ID NO: 1861 - DNA, 2707 bp, Homo sapiens
agtcacacaagtgcttttccttgaaacaacatttatacttttgaacatactacaaatatttaataagcacagcctgccctccatattcgtgggttgcacatccatggattcaaccaaccacagatcaaaaatattcaagaggccaggtgcagtgtctcatgcttgtaaccccaacactttgtgaggccaaggcggaaggatcacttgagtccaggagtttgagaccagcctgggcaacatggcaagacctcatctctttaggcagggcagggaggagggaagaaagaaaaatattcagggggacaaaaatggatggttatgtctgtatggaacacatacagacttttttcttgtcattattccttaagcaatacaatataacaactatttacatagcatttatgttgtattaggtattataactaatctagagataatataaaatatatgggaggatgttcataggccatatgcaaatactacatcattttatataagggacttaagcatctgtggattttgggatccttagggagtcctgcaaccaatgtctgatggatactgggggacaactatattatgtacttcctatgtcatgacattgaatattaaaaatatatatacttaagattttgaggtttaataaaatttatgaattttactgcttcatcaaggatattcttaagggaatttggcatttttaaaaatttcaattgcatggcagtgaagaatctaagaactagtatactttggtgcactagttttggtacactaccttgatttattctaaagcactagcatttttactttccattgcttttacaccgtcagtgcaaatgacagcatggtgagaaaggcaaatgatgtcctgttaccaccatgaaaatagtttctaactcacagactcctgaaatagtttcaggtatccccaggagtctgtagaccggactttgagaaccactgccctacatgattatccaaaacaatatgtcccttgagttctgaatggtaggagaggggaggggaaggcagaaaaattgtcaaactaggctgttttttctctagttctgaaagagagtaatagggaaggaggaggttatattgagtttcacagaatagattgggcacctgagggtttatctcactcatttagttgcagtcttccttgtgacaattagaattatgtctgcttggccttaatgggtcatatattccacagaattctgtacaaaatgtaaatataatattgtcaaatgtctttttttttttttttttttttgagacggggtcttgctctgttacccaggctggagtgcagtggcatgctcacagctcactacagctttgaactcttgggctcaagcaatcctcacgcctcacctcctgagtggctgggaccacaggtgtgcaccactatgcccagcttttttgtagagatggggtcttgctatgttgctggggctggtctcgaacaccagacctcaatcagtcctcccgcctcagcctcccaaagtactaggattacaggcatgagccaccacacccagccaaaagtcttttctaaacagaaaactgctgatttattgtgaaaacccagtcacccattctcagaacgattgtaacttttattttgaatttagatcttttgtagaaaccagaatatataaggtgggataaaagctattagggtttcaagtctggggaaaaggcacacggtttccagtttcaaggttttttccatatcctaccataacacagcccacagctttttgttgttgttgttgttctgacttctcgtctgtagactaaagatagatattagtgacataatctttaataataagtaacagctcattgtcttgaataaggtatgtttaccttgacttaatatcgtttgtatttctaaacacatttataaattgaatcatatttgaaatgtattaggaagatttgttctttgttgtttatgtctttttaaagcaaacaattgcccattaacttctatttttaaaattggtaatgtgccttggttgtttaaagcaagatatatctagtctagcttcctagaatttgtttcaactttaaacctttctttaaacttttaaccctttccttcattcctattcaatcttctgcaaaacgctcaacctttattgcgcaattgctgtattgaacccattgtctaaaactaaactttctcctcgtaaagtaatgttgatttttcacagtgagatgacttttcatacgtgttactagcctactatctcctacttctgttcactttggactactgcagtggtgacctagttagtggtctctgcctgactagtcacttctgtatttaattcatccaaaagactgttgcaaaatttattttctttgcatgttcctaccccattcaagaatattcattatgaggccaggtgcggtggctcacgcctgtaatcccagcactttgggaggccgaggtgcgtggatcacttgaggtcaggagtttgagaccagcctggccaacatgatgaaaccctgtctctactaaaaatacaaaaattatccgggcatggcggtgggcgcctgtaatcccagcttctcgggaggctgaggcaggagaattgcttgagctgggaagtggaagttgcagtgagctgagattgtgctgctgcactccagcctaggcaaaagaataagactcctatctcaaacaaac

SEQ ID NO: 1862 - DNA, 2263 bp, Homo sapiens
acaaaaacaggacacaacatcccactgatatgaatgccacatcttctcgttctcatgctgttttccaaatttacttgcgacaacaagacaaaacagcaagtatcaatcaaaatgtccgtattgccaagatgtcactcattgacctggcaggatctgagcgagcaagtacttccggtgctaaggggacccgatttgtagaaggcacaaatattaatagatcacttttagctcttgggaatgtcatcaatgccttagcagattcaaagagaaagaatcagcatatcccttacagaaatagtaagcttactcgcttgttaaaggattctcttggaggaaactgtcaaactataatgatagctgctgttagtccttcctctgtattctacgatgacacatataacactcttaagtatgctaaccgggcaaaggacattaaatcttctttgaagagcaatgttcttaatgtcaataatcatataactcaatatgtaaagatctgtaatgagcagaaggcagagattttattgttaaaagaaaaactaaaagcctatgaagaacagaaagccttcactaatgaaaatgaccaagcaaagttaatgatttcaaaccctcaggaaaaagaaatcgaaaggtttcaagaaatcctgaactgcttgttccagaatcgagaagaaattagacaagaatatctgaagttggaaatgttacttaaagaaaatgaacttaaatcattctaccaacaacagtgccataaacaaatagaaatgatgtgttctgaagacaaagtagaaaaggccactggaaaacgagatcatagacttgcaatgttgaaaactcgtcgctcctacctggagaaaaggagggaggaggaattgaagcaatttgatgagaatactaattggctccatcgtgtcgaaaaagaaatgggactcttaagtcaaaacggtcatattccaaaggaactcaagaaagatcttcattgtcaccatttgcacctccagaacaaagatttgaaagcacaaattagacatatgatggatctagcttgtcttcaggaacagcaacacaggcagactgaagcagtattgaatgctttacttccaaccctaagaaaacaatattgcacattaaaagaagccggcctgtcaaatgctgcttttgaatctgacttcaaagagatcgaacatttggtagagaggaaaaaagtggtagtttgggctgaccaaactgccgaacaaccaaagcaaaacgatctaccagggatttctgttcttatgacctttccacaacttggaccagttcagcctattccttgttgctcatcttcaggtggaactaatctggttaagattcctacagaaaaaagaactcggagaaaactaatgccatctcccttgaaaggacagcatactctaaagtctccaccatctcaaagtgtgcagctcaatgattctcttagcaaagaacttcagcctattgtatatacaccagaagactgtagaaaagcttttcaaaatccgtctacagtaaccttaatgaaaccatcatcatttactacaagttttcaggctgtcagctcaaacataaacagtgataattgtctgaaaatgttgtgtgaagtagctatccctcataatagaagaaaagaatgtggacaggaggacttggactctacatttactatatgtgaagacatcaagagctcgaagtgtaaattacccgaacaagaatcactaccaaatgataacaaagacattttacaacggcttgatccttcttcattctcaactaagcattctatgcctgtaccaagcatggtgccatcctacatggcaatgactactgctgccaaaaggaaacggaaattaacaagttctacatcaaacagttcgttaactgcagacgtaaattctggatttgccaaacgtgttcgacaagataattcaagtgagaagcacttacaagaaaacaaaccaacaatggaacataaaagaaacatctgtaaaataaatccaagcatggttagaaaatttggaagaaatatttcaaaaggaaatctaagataaatcacttcaaaaccaagcaaaatgaagttgatcaaatctgcttttcaaagtttatcaataccctttcaaaaatatatttaaaatctttgaaagaagacccatcttaaagctaagtttacccaagtactttcagcaagcagaaaaatgaaactctttgttttcttcttttgtgttctaaaaaaataaaatttcaaaag

SEQ ID NO: 1863 - DNA, 2057 bp, Homo sapiens
ttcctgggctggtgcgccccaaaacacggccccgacacttagtgtggccccaggccccagcgagcctcgccctcccagttttgctctgcccagcagtgttggtgcccagagatgacaagggccagggagcctggcccgggtgtgagaattcagagattctggcctccagctgtcaccacaccgtaacggggccatgtaactgtgcagcatggacagggatgcgacggggcagctggctgtgtccatggccaggtggccaggtcagggctgcaagccaggggcccagggcccttccgttcagcccaaatgctgccccaatgctaactccttggattgtcaacccccatcccccaaatggaaattccgaaggaggcctcctcgcacctgccctccgctgctcctcagaccccagcccccagcgagccgacgtcccacccgttcctgctctcatccccaggttgggcacgtggggttcctcctctgtgggcctggcagacccttcatgagtgggacccaagatatcactgacttcaacccagaggatcgagcccctgcaccctgcctggggccctggggtgtggagcagtggctggggtgggcgtggtgtggcctgagagactgcccagctggagaggccttcctttacaaggccacgcgtgcagctgtcccatccagaccccgactggccaagacctccacgtccccagagtccagccctggaaatcccaagggccctggcgtcctctgccttccccgcttccccgtgagcgtctgcaaaacacttgcctgaatacatatcacgtattttagactcgaagcctcgaagcactggattgtggtcccctgccccctctgtcccgtccccctgcccaagtgactgaaacctactgagctatattcactgtgctgtcctagggggagggagagcagagctcgcccctgcactgcagccttgtgggggagggcaaggctctcctcccagccagggacgccaggacatagctgctcctggtcagtggaggtcagccgggtatcaaaagccatgaaactgtgtctctgtagcaatgagtgatactgtgacaaaaccatccttgcattcttcctagaagagttcctctgctccttccattccatttttgtgtttgttttgttcttttctgtcactgatccgtattaccacttttggaaaaaaataaataaataaataaataaaaggcagcttgagtttccaaacgtgtgattcacttgtgaacaaaagtcattctaacaattgccttcagcgtcacgtgcattgccactgcgctttcggcacgagggatgctgagccctggtgtcagagtcgtaatttaaagcgtgtgtgtatatggactttgtcccttaaggtcgatataaagaatcctcgcagaatcacagacctgtgccgcccgccaccttctgccattgttacattacagatttggtttagtttcgttttgttttgttttttctcttagaactgtatagtattgaaaaagaaatcaaatgtaaatgtctggttttcatataatgtttaaaaagaccattgagaaggaggctggcgctcgccccatgtcccccttgattgtaaattgcttctgttctgtttataagtaaactgtgcatgactcctgcttagcggtcattatcgtgtctgttggtgaaatttttattaaaaggaaaattctgtagatgcacttattgaatatgtgattaggatctacgtctgagactaggagtcctgaactgctgacgcgaaagaggcgcagttcccaattaatacggaaatcgctgtgggagaagaatgaaataagacgtgaagtgtaggaaatcatgaaaagaacaattttgcaaattgcattctgatgcttgtgatgaacacaaatgtacttgtgtagagacatttccttaagagaaagcctaggagaagccgatttggaggttaatgctgtagaataggactgtataccaaatgtaatctttccaatgctccaatgaatttatacatgagattgatatgcaataaatctgtgtgcttttct

SEQ ID NO: 1864 - DNA, 2128 bp, Homo sapiens
ttagatctccttgtatatagtaagagatgtattaatattaaccactcatattcatagtcggatacaatggaaagcgtgttatacccatgcccttgcaaatgtacaaacctgcacctatactcatgcatgaatatttatatcctgtgagcagaagaggacaggctgcctgagtgccagggaggtccaggtctagcctagctgggggagacttcccactctgccttcccagccccaggacccttaggagaactttcttgctgccctgtggtccccagggcaccagaaccctggatagccggctctgtggttttcctagagtgctaattgttgcccaggagcagggaatggggaatcgggagctccctccttcccaggagaaagggctgcagtggctggcctgggagccagggagagtcttcacgtcccagcagttctggtccagaggcagctcagttggattattcgtcccggttcctaatgaaagtgaaagctgctggtacctgccagccctctcttggcacacagcgagctgaaaatgcagagactggagaacgttgccaccagagtcagcttgtcctggtgcagctcagatttggagctgagggttatcgatgcattggtctatcttattccaggatttcctaggcttcagttatctcccaactaggaaccacagctgctccttcctaacctggtccctccttgccaatctgtggcctgtgctatcagcagaacccctgtgccggacatagagctgcccaggtcagaaacccaaaccttccacagggacacagtcagatttgagttatgggagatcccacagccaggggtcagggcggatgcaggaaaccaggccaggaagctgtggctgtcatctaagcaagagacagacaatggtgacacagggaggcaagtatacccccaggcctggccacctctccagctctgctcctgacatgaggctcacccagaaggtccttggccatagggtacattggtgccagctgcgtcttcagacaggagaaaaccccagtatgtgtctcaagacagtgagatgtcaagagtcctgctctcttagccctgaattatacaaactggagatttcagccaagaaacaggcagggtctgccccacttacagctcatgtgtctgttttgccgaactaagaaagtgagggcttctctcaatttggatattcatatttctggtttatctgctagctttcctcccagaacttctgaaagcatactctgcttttgggaaacctaagatcacaataaaagtggcagacctctttatccctgtctcacaaataaatggaggcacagaatggggaagtggaggccgagggaacaaagccaactaagactgccagcccggttccctggccacagcactgagggtttgaggggtgcctccagtgagggctccccatccccgaccttggaacaccagctcatagtttctgccaggcctatttcatacgcactcttccaactttttcctgaattaaaaacaaacaaacaaacaaaaacctctgttatgaagtaatttcacacttacagaaaagttgcaagagcacaaacaatgcccgcccaaactcaccagttgcaccagttagcactttgctcatgtacacgtgcatgctcttccctctgtttgtatatgcatgcctgtgtatatgcacacatgtgtatatgtgtaattttcataagcatttgaaaatgggttcattatgcacctttactcctaaataattcagtatttatttccttagaacaaggacaaatttgcataaccacagtagggttgtcaaaatcagcaaatctaatattgatacactatacaatcctatgaccaatctcatctacaactttattcaaattttatagaggctgaggtggaaggatcacttgagtttgaaaccagcctgggcaacatagtgagaccccgtctctacaaaaagtaggaaaaaaaaaatagcgaggtgttgtggtacacgcccatagtcccagttactcggaaggctcaggcaggaggattgcttgagtccgggagttcaaggctgcagtgagttattattccaccactgcactccagcctgggtgactgagcgagaccctgtctc

SEQ ID NO: 1865 - DNA, 2359 bp, Homo sapiens
gattacaggcatgagccaccacgcctggccaaggcggcactcttgtaaataaaaatagacagggtacccagtgttgcctggctatctacatgcccaggttctataaaagttttagctctgagtgcattttggcttggtaataggagtttgtttccaggtcattatttatgactccagttttaatatgcatatcaaataaaaacttgggcaattgtcatgaaaggaacatgcaggatattttaatgaacacttctgcatttaaggaggtctgggagaagggtggtgagaatggtaatgagtcatacatctatgttgcgccactacccttagccattgcttttcggagaccctaggcctaattaaataatagctagactccatcatatgacaaatgattgactagctatgagcatggggcatcctcatttctcagcccagtctcatgttcatcatgtgctattagtcataagtctctagcatttatagaaaataaacacagttgctcagttcccacccccaaatgaggaaattagtatggaatggagccctggaatctgcattttgtaaggcttctttggtgatcctgatgcacatccatggtggagagctctgaaggggttgtgagaagagagacgggaaagcgaaggaagctacagaaacccagagaggcccgcagaggtctgaggaggggctgggggcacggaggcagcagtgcctggaaaaccagtcccgccccaagttcacatgcaggaacagagtgggcggcacagcgggctgcacacagggcacgtcttcgattcagagctggagtggaagaagcagccgccgcagccccggtggaaactccgtgactcttttctagcagccatcatggctgcaagggccgggctgtgaccaaaggaggggtctgaggcagggagggtggcatgtgcccttacagagaaggtcccacagagcagagccacccagaggcacagcctcaaaggactgacctgttacaagatcccagagccctaggctccccaggaacactgtcactggagagatcctctctgggcccagacccaaccatcacccaactccaatcctctcccttgagcccaagaccctggaccttccctgggcgggaccacagcagagccagcactgaccctcaggttttggcaaaatgtctagtgagggaacatcttcatttatggtccaaccaattcagtacaaagcctctgccttctcgctctgtgaggtaaggggaaggggtcatgttttagagacagtaatctcccccttctctggacagccagacatgtggtgcccgttgccacagggaaggtgacatagcagaagcgagccttggctttggaattttaaaagcttgattctgaaggtgggtggcaagaactcaggacacttacagtgcatttggaagaatatatgatgggttaaagaataaaagcctcctctctcccccactggtcaagattccataggttggcagggcttggggagcaaggcgaatgttgacatttctggaattcttgagaaaaggaccctgagaaggaggttgcggctaaagagggggaaagtatgacaaatactccatataggtttggaggtgataagtgtaggcaagcactgggtagaagaacccacacgcttcctgggtagagcctgggaaaacagcaagccacagagcggaacaagggactgggctgtctatcttagcagttggcctggaacagaattactgagcttcctgaagccagagggtgtgcagggccaggagctagaatcttccacatgctccaagccacaggtccccaaataggctttgtggaagtgaaggagcccctggcagaccttgcatgaccaactgatgaccagatggggaggggatgtccaggcaggtgcgagcatggacggatgatgatagccgaggaacagagtcttacatgacttaaagccacacccccacccgaccgagcttaaccccaggaaaaggtcagggggagactttgaattgactgagattaatttctaccacctgctgaaacggggttcctaatagaaattacattctgtgttagaaaaataaagttatgcttcttgcagattagagtttgtaggctgagttgtacctactatataagtaatgaattaattttttctttatgattttgtaaagaaaagagaagaaagaaatttcagtagaatagcgctacattgcaagagaaacggcacttgtgatttttatccattttccttctagtctttgaatttagaaagcacaagtcccttgccacaagttcaggtcaaatgactgcagcattttgagtgaaaccaataaaatctaagttcatgg

SEQ ID NO: 1866 - DNA, 3167 bp, Homo sapiens
ttatgcctctagcctgcacctccaggctggtaacccaactgcccacctcaaactctagctggagttttactgggtaccacggatgttacctgcccaaaaccagactctcgacttttaccctcaaatctgctactctacaactttccccattccatattgtttttctacttgttttggcaaaaaacctcaaagttcaccttgtttcctttctatccctcccatgccatacccagcctaccagaaaatcctgacaactctctctctaaagtagatccagaatcccttcatatctcaccacctccatcacaaccgccctcatcccacatggggatgacacagtggccatctgtgtagtctccctgaccccattggaacagatcccttgtcctgggctggcccccagcccctttcagccttgtcttctgcctcccctcgcccactgctgtccagcccctggatgtgcagcagacgaggacatcctcaggtgtcttgtatgttgttccctttccctggaatcctgtcttcccaggtttggggatgacttgctccttcacctcttcacatttctgcacgaatatcacctcgttagaaaggctcctccaacccctgtatgacataggaaccctccctgctttgttttcctctagtgctcaccgtccccagcagatggaatatttgtttgtctgcttgtttgtgcccccagctagaatgtgaacttcaagagagtggcgcaggggctttgttctattctcagtgcctagaaaggtgcttggcacacagatgtgtttcccaaatatgtgctgaatgaacggaagagtatacagccctcccaggggctttctgctcctgcccagcctaggggcccctcctctccctccaagagcggctctcagctcacagacctgggccctggtttccccaggtgcgtcttcctgcctgaccagggtgccttctttgtgaactatgtcatcgcctcagccttcatcggcaatggcatggagctgctgcggctgccaggtctcatcctctataccttccgcatgatcatggccaagacggctgctgaccgcaggaatgtcaagcaggtgccatcccctgggcccagggctgtgcctctgactccctcccatgtcccccttcactgacccgagggcctctcacccccactacccccactagtgggtagcatttacctgactacccactagtgcaggcactgggctaagtgcttctcaaacccgggtccaggcaggcgtggcctcctccagcctcctctctagctcacaggctggaggagagagcttgggactttggcatttgaaacggtttgatcgcacacatacatacatacaactcaaaccaacagactctttttctgtaggcacccatttgcataaattcttagccaaaccccagatgtcaaaggcattttcggcttgtggcatttattccaggattccctgaactggagggtgtggctttctcttttattctcctctgccatggtgggcactgtgcgaggaaagtgggagaagtgctgcattccttcatttcattctcagcccccttatgagctgggcactgctagtatcccgatttcacagaggcatgaactaagctggcccaggatcccctgctagaagggctggagtcactctacacctcttccctgaccacctcttccctccaggggctcacatgcctgttgggtggaacgaagggagcactagcaaacacgcatcaccatgcctcgggagggctgggtgcactgagtgaagcagggcaggctgggagggatgggaaggaccttgggaggcggggagccacgcatctcctatttccaaagtcctcctccaccctgctctcccatcaccacttagagagcacaaaagggtgtttgaggtggaacaagtccatgagctcctcaccacctcctcctcccagaaccaggccttccagtacgagtttggagccatgtatgcatggatgctgtgtgtcttcactgtcatcgtggcctacagcatcacttgtcccatcatcgcgccatttggtgagtggccctggagcctgtcccagggtacatgggtacatggacggctgattgcaccaaacctctcggggacagctatcaccagggcacaatggagttcccaaaaccacagccacaagagccacaagctgctaaagactcacgtgacaccagatttcactcatttctttctttttttgttttgagacggggtctcatgctgatgcccaggctggagtggcatgatcttggcttgctgcaacccctgcctcctgggctcaagccatcctcccatctcagcctcctgagtggctgggattacgggtgcccgccaccatgcctgcctaactttttgtatttttagtagagatggggtttcaccatgttggccagcctggtcttgaactcctgacctcaggtgatccacccgcctcggcctcccaaagtgctgggattataggcatgagccacagcacccggcctcattcatttttaaatgaattcctcccactggccctcagctaggacctctcttagtatttctggtctgaggttctctgcccactgactatgtcgttcatggttgatttctttagcagcaagtaagacagtgccagagtcacaatcaaagctctcgtgctgctttcactctggcagatgcctgcctccacgtggattaccacatttctcacctcatcctacaaggcagttcctgtttctattcccccttcacacaaaataacttcgtatgttgttagtaagcaggagaaccagcctttgaactcaggactgtttaaagaccaaggtcctggccactgaaataaaacatctgcaactggcagattaatgaaaggctctagaaggaaacaaaaaacccaagagactgctggcagtgatagctgagttttagggggaaaagttgttttagttttccctgtatactttcttgtgtagttttaaaaatctacagtatttacactttcaaaacaaaatttattttttaaaaaagaacaaagtgctgggattacaggcgtgagccactgcgcccggccacattcagttcttatcaaagaaataacccagacttaatcttgaatgatacgattatgcccaatattaagtaaaaaaaaaaaaaaag

SEQ ID NO: 1867 - DNA, 2809 bp, Homo sapiens
ccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctgttctgaataggacaactacaagacctactaggcccaaacccagtgggatgcccagtgggaatggagtgggaacaggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacctgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactgttgtaatgatgttttgagatacttttataacaaaattaacatcaaaaaggtatatactttttaaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacaatgagattgcctaccattttataggatatttactatgtatttatacgttaagacctctatgaatgaatgtatcagagaatgtctttgtaactaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagtttttttt

SEQ ID NO: 1868 - DNA, 2082 bp, Homo sapiens
ttttatttataggatgaggaaattagattaaatggttttgaggtcctttcttgttctgatatgtccagtactcactggaaaattggatctataactgatgggtttagtaatctgctcatttcttgctctgaaaattgtagtcagcaaaagagatcatggaagaaatcactgtaatggtagtaatagtaacacatgccatttgtattgtgccttaggtttaccaggtgtttccaaatacattagcatatttgatatgtgcaggactagataccttgggacctgccacactccactttcaagatatgtattagcttcattagaattaaagggacttgaactcaggacctgcagcctattctttatccacatgtctctggtagggctacatccagatcacaccatgacttcttatagagcaagagaaaataatattattatatcttcctttgcctaaaatctctccacttattcttttttatgattctgcaccagttcactgggttattctatgattccatatttttttttaaaaaaatcatatttaaaatgaacttacaatgtctgaattttcctggccttgagtcacagaagtaatatgtttcagatggctgcccaatatgtattatcatgtaatacatatctgtgtccttttctgggatgaggaaggcttcaacttctggcactgagaactttgtattacagacacaggtttagtttctagcttagtcatgcctttagagtttagtagcacaaatccatgcaacccaacagaatacatggtgagggcctagtatgtagaatttgaaagtagttcaaatttgaattagaagaatgaagctaggacttatttggaaaaggagatagaaaaaaaatgatcagaaactgtggggccttattacctttgcagtaagttatcttcttcatgatatatgtgaattattttatgtgcagattgtgttttgggattgtcagatctaaacttatattcttgctggctaatgtgctgatagccaggtctgaaacttgatgtgctatccagacacatatgatcagaaaagatctagagtgcaaagaggtgtctgaggagcaaaatgtggttttaatgttgtggaaagatcacttgcaagtatataagactgtataaagaagaggactgtgtgcaagtggggtgaaaaaaaaggatacgcgaatgtgcatatgactgaatagggaggaaggtcagggctagaaaggaggctacataaaaaggggcaatggagagtgcacaggaaagacacaggggaaggtcaagtcgagcaaggtagaaacaggagtagctagagccattgggaatccattttgaaacaagaaggagttttgaaagggaataggaaagtaagtgtcttgaagtaaaagataaatatggatggagaaagaagaaattctggatgatagagatgataaaaatatttattaagaaatgaagtcaggttcagtgtatgaaatggaaaggaatttttcagaattttaagaaaggggaagttcctcttggaaaagatatagcaaccattggggaatgaccttttcatttcagaagtggatgaggaaggtggtgtgagcatcaggtatattctggaccatttcaagtgctggtgagaagaaaggaactctttgcctgaactgggcttggttttccaagtgctgctttggaaatgaagacccagagatgcagagcttatggtagttcataaatcttcatgttctattatctttcatctgccaataaagttcattttcaataatgtccaccattgctgtgcccagaataaccacaggcaaacatcaaaacaatacgcataagttagacaagattaaatcttgtctgatatctgcacaaacagatatgcaccatgttggaaacatgtgttttcctagtcccatccaggcttcccacaagaaagccatgatgtgggtctaaaccatatgttttgagtaaaggagaatagaagaaggggagtgtccgcaaaatggaaagagatgaagatgttccaaggaaatatgctgaaacagaacagtgaatgttttgcccaaaactacaaaaat

SEQ ID NO: 1869 - DNA, 2910 bp, Homo sapiens
tgtagacactatgagtttatatataggcaagatattcattcattcataaactattgcctacactttgaaattttcattttttgaagttgacttacagaggttcatgtctgagttactgaccttcttaaagcctcatcttcagccctctctgcaattacacaatccgtgcaaatggctgtctcgggttttcatagaacaagacgatgacatgctggaggctgccaaggcatcactgggcatctacttaacactgaccaggttagtgtattttaaagtaattattgaacggcctacaagtcaggaaagcagaaaacatttctgagaatgtgctgggcgtgttgcttactttcatcatttgggggaaaacatcctgttgcagttcctttctttaaccctgacttacatgaaaaggagattgcatttgcatcgctaggaaaacctggctggctgggcagttctcaggtagtataactagattggtatctgaaaacatggcttctgatttggtctccagtaagtcagtacacttctctgaatcttaattgttgttcatttaagacctcttttcacccctaagacttacttttttgtattaagcttcagtaagatgatctttgcctttgtaaaggtgaatacaaacttagaaataatcaaagaagctgttctgaattttcgtttcagtcgaatttgggctgataccttcttgaggcaaatgtctgaaattggttaagttatgttactgatgatttatactgattgtctctgctttattaaaataactgtacttggggtaatatcttcttgtggcaaatatctataattggttatgaagctaataaccgatgaccttttccactgtttctgcttctgctttattaaaaccctcacatatttgctttatttccatttctttcttggcctgggagaaagggatttcttgctaatgatctgtggtgcagcgttgtgccgccagtacttacttgtattatgacactgctggcaatggctgctcttagactcttgagtgtttggggccaattttcaaaaggtcctaatcaagaacacaaaattcctgcatgtgatttgaattaggttcaaaatggtcaaatacaagttcagtctgaaaatgcacacgcctgtaagagtgtatcttaattgtactcaaagttagctccttactcctcaggaagtggaaacccctgaatgaaactgactttgtgtgtgaatttctcactttctgaatccagttcagtgtgtccagagaggcatgtgcttacaacatagatagtttttttcagatgtagttgtatttgttaagatttttttggttgtaaatgatagaaaccaactctaatttgagcaaaagccagcatttattggctcataactgggaattctaaagggtcaagttggagtcaggtataactatatgtacagggactataatcaatcatgtcatcaatcacttctcaatttttctctgtctcacagttttgaattcattctcaaggcatggccaccggcagttcaaggcgtacctcagccttacagttataatcttccatagctccagcaaaagtcccaggggagacctgattaacccacttgggtcacagagccttgtcagaaccagtcattgtggccaggagcatggagtgctctgattggtcagtctgggtcacatgcccacccttgttgagggtaaggaaggaggtttaggaattatcttaccacatggaattggttacctataagaatgaggagttctgatgtcgagagaaagaacaacagataacttttattgggcagacaaaaactagaactgccaaagtcagtggattttgctttactgagtcagatttctttagagcttatggggaagggaatgggttttgaaattttttcttttaagaagtgatgcatagatttaaaagtaatctaataggttaatttatggtatgtgaattatatctggtaaaactttatttttgtaaggtcgttaatctgcattctccattatcttcattttcagaggatgtgaagccactgaaaccttgactcagggaaaagaaatgtgggaccatcacactcatgaaaatggctataatcctcactgtattttcttgttcttcttgaaaaatataggatttgattccacagttcttcttgactttttgattttatcagaaacctgttttcttgaatattttgttagatatttaaaattactgcaaaaggactgggataattttttcaccatttgcaataactttgatgcaactaaatctaaatatgacataagtatttgtggctgtgtcccctcacttgtccaagaccaaagctccaaccaaacaataccccatcgtttgactgctcctcatagtcacagagatgtgtgtgctcggcactcctgggcttccgatgctccctctgaaccactgaaagctgtgatgtccaagggtgctcacaccatgtgtgcttctagtctgtcttccccccgggcctctcaaagtctggtagattacgacagctctgatgattctgacgtggaatccacagaccagtgtttagctaacagtaaacagacatctttacaccagcaagcaactaaggagattcaggatgcagctgggacaagcagggataaaaaagaatttagccttgagcctccatcaagtcctctggttctgaaagaatttgatactgccttctcctttgattgtgaagtagccccaaatgatgtcgtctctgaagtgggaatattttacagaatagtaaaatgcttccaggaactacaagatgccatctgccgtttgcaaaagaaaaatcttttcccatataatccaactgcacttttgaagttgttaaaatacatagaggtgataagtaataaaactatgaacactttgt

SEQ ID NO: 1870 - DNA, 2025 bp, Homo sapiens
agataggagtcagggcgcctggcccgcaggacactagagatctgcggaggagaagggatgagtctgccaggcccaccagcctggcccccagaccctccccaccccacacacgcagacacgtcttacaagtcctgtgagataggggctgccagcgtctcccaggatgtggcccaccgtgatctgaagtgcctctgccgtcccccggcatctgggcaccaccacagactgcagaacataggcacagcaggggggcaccccaagtgagggcacccttgcctgctgttccccacctgccaaggacctgcctggaggagtgacaggccattcagaaaccccccgagaggcaggggctgcccgaggtatgcagaacgagctccccattggaggcgtatgtcaacaaggggatggctagaatttggcaaagcatttatggactggggagcttgcggcgtgagaccagtgttctcaaagcgtgctctacggaatgctacggcaggatcacttgggaagttcatcagaaatgcaggtccctggaccccagcacggacccactgaatcagactcagaggacacagggcctggaatctgggtttgtcataagctccctcaaatctgactctcatgcacaatgacgtctccaagccaccggaccggagagcccctgaggtcccttctccagagataacctggattctccccattgtggagatagcatcaaagagaacagtgtcctggacaggcgcagtggctcacacctataatcccagcattctgggaggccaaggggggcggatcatgaggtcaagagatcgagaccatcctggccaacatggtgaaccccgtctctactaaaaatacaaaaattagctgggcgtggtggctcatgcctgtagtcccagctattcaggaggctgaggcaggagaatcgcttgaacccaggaggcagaggtcgcagtgagctgagatcgcaccactgcactccagcctggcgacagtgcgagactccgtctcaaaagtaaaaaaaaaaaaaaaaagagagagagagcagtgtcccaaggaagggatgatctggaagtcagtggggcccacacgcccactcaggaatctgcaggacgcaggtgtgagttcattctatccttatagcctggggtgtcaatggtggttgccaccgctctacctactggacaggtgagcaaaccaagacccagagaggttcagtcacttggccagggtcacacagctagtgaggagccaggctgggagtgggagcagatgggctgctgcagagtcctcgagcctgggctctgctgccctctgccctctgacctaacccacaggctccaaccacccagacacctgcagtttccacccattttcctatcagctcctcgtggctttcttggccgcccaaagctgttcacgtgaacgtgccctgcccttagcttcctgctcccttgttctgtggaccctgttcacacacaccctaaggcctcctccctccctgggcccctgctgaaagagaagccgatctcctgtctcaggagccagtgccggccggcaaaggggaccttcctctacttcctgccacagaccctgtccccacacacttcctgcccctgctctgctggaaggccacttcctcccccagtgctggattccacccccagctcaccctcaaacatggccccctctctcctcctgcttgcccctctctgctccctggaggctgttctgtcctcccctcttgaaaagcaatgccagcttcctgggatcttctgccaactccagctaccatgccctttgctcctgtcagctcagctcctcaagggaattgtctaccctcggtgtcctgcttcccctccctcaccctcctcaccctgctccaagctggcaggccagggaagctgtgggggcaggtgcagctctgtttggaccacctcagagagaaccagctatgctggggggatgttaatctccctgagcctaaaagtggacaatcccatgaataaaacatttgccaatgcc

SEQ ID NO: 1871 - DNA, 2286 bp, Homo sapiens
aatcacatcagcaccaaatggctcaggatgctctggtttcaaagcttataaaacagagggtgattcccttgggactcactcagctcggctccgaaaagcaaaggccagaaggcagcagtgagcctgggtccctgctgtgtagggagactcaggggctgggaagaaggatggaatcagaaatgctgaaggtttacgtgagctttgcaccgagcgcctccgaaccactgcctctgggctcaacagaacacagggattaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgacgagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactccttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaattttatcagatatccaaagtaaaggaaatgttttaaaactgcaacaagagacacagacagtaaaatcaaagtattattaggatgactaaataaattataaagtctgtgagaatatcaaccatagatagttctttctatattatgtttttgcttttgtattttaagctttacttagatattcaaaacctggtatatcaagtctctgttagtactattggcatttagaagactttaccattatttcagtgctaggcattattgattaggtcttggctccactgtttacctcttgctatgtattttctcccggtaaaaatgaattgaaccatttcaact

SEQ ID NO: 1872 - DNA, 2075 bp, Homo sapiens
gttccaggagccccagttaccgggagaggctgtgtcaaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcaggtgcatggccctgtgggaagggaagctgggggagcaccgtcccccagcgtggagccaagccaggatgggctcaggcctgtgttaagagtcctggggtcagataagggtttgctgggtctgtcacaggaggctgtggggaccaagctgtttagccgggcctcttggtgcctgaggtccagtcaggctcaggtgtccacacctggtgatacagagagggcctgccttcccccacccctgttggggggctggagcttctgtcacctaatatgcatcagggcttccttcctagaatgggccagcgctgttctaccaaccgggcccccagagcctctctcccctttctgcttttcctccaacatctcagcaactcagagggccaggtggtgcagctctggccagcgtgtgcccgtgtgtgtccctctgtcatgtgcccgtgcgtgctcctgggtgtgccccgtgacatgtgcttgtttgctaacaactcttccatccactgtcccgaggacacacaatggaggggaggcttcaggtgtggtccttgggagggcagagcctctggtgaagtaccctgggcataggcctggctcggtgtgctctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgctgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctgggagaatcgctcctgcagccccagcccagccccactcctctgctgacctgctgacctgtgcacaccccactcccacatgggcccaggcctcaccattccaagtctccacccctttctagaccaataaagagacaaatacaattttctaactcagc

SEQ ID NO: 1873 - DNA, 2611 bp, Homo sapiens
gcaatgggccacagagccgccatgccggaaccgcgcgggtcgtcgcagctgcgggtgaacgcggcgtttgccgcgcggtacaaccgctaccgggagcgcgaggaactgcagcggcgtgagtgcggggcgcatgcgcgcgggagcctgcgcgcgccggcctgttgggaagtggggagtcgagtggccccgccggctgacctggggggggggggcatcccgtctgtgtcccgcagtgaaggatcgctacggggaccgagacagcagcagcgactccagttccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacggggagacttccaatcacagactccaggagacatcgtcgcaaagttatgtggaggaacagaaacagctcaaggaaagcttctgggcatttgtggaggacagtgaggacgaggacggcgctggggagggcggctccagtttgctgcagaaacgtgccaaaaccaggcaggagaaggcccaggaggaggccgactacatcgagtggctgaagggacagaaagagattcggaacccagattccctgaaggaactgacgcatctcaaggaatactggaacgaccctgagttggatgaaggggagcggttcctgcgggattacatcctcaacaaacgctatgaggaggaggaagaggaggaggaagatgaagaggaaatggaggaagaggagggggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcaacatcgcgtcctccgtgcgccgtaaggatgagcgcagaaaggagaagagggaagagactcgggagcgaaagaagagggagaaagcagagaagcaggaacagctcaagcagctgaagaacctgaagaggaaggagattctggccaagctggagaagctgcggaaagtaacaggcaacgagatgctgggcctcgaggagggggaccttgaagacgacttcgaccctgcccagcacgaccagctcatgcagaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgccgcggccgtggggcaggagaagcccgtgtttgaacccggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagcacaggaagaggaagcccctgtatcaccccacaagaagccagccccccagaagcggaggagggccaagaaggcacggctgctgggccccactgtgatgcttggtggatgcgagttcagccgccagagactgcaggcctttggcctcaaccccaaacggctgcacttccgccagctgggccggcagcggaggaaacaacaggggcccaagaacagcccctgagcaccagggagcaggcaggggcctcaggctcctctcctcaaatcaagccctggacaggtctcgcacccacaagtactatctgctgcagagatcctctcatctgtggccaggcacgcctgtaatcccagcactttgggaggccgaggtgaaaggatcacttgagcccaggaattggagaccagcgtgggcaacttagcgagactccatctctacaaaatgtggtgacacatgcctgtagtcccagctactcaggaggctggggaaggaagatcacttaaggccatgagtttgaggctacagagagctatgattgcaccactgcactccagcctgggcaacaaagcaagaccctgtctcttg

SEQ ID NO: 1874 - DNA, 2020 bp, Homo sapiens
agcttggaagcttaggggagctgctgtggcccagggctcagtggggaggaagaggaggccaggagtcttggactagctgcagggtttgagctaggctgaagcagcagaaccacagaggtggctgagcaggggcctggccctgggacccagccatccacactcacacatccacttctccctccagagcccggccctgaagcaggtctctgctccacgcttttccttagttggggaatcgagagttgggggatcaaagccccccacatctccctcacccgctgcagctatgtttatcaaggtgatgtttggggctggctgctcggtgctggtgaacacctcttgcaggctggtgaacctcaccgcccacctgaggcagaaagcagggttgcccccagatgtctctctccatgtcctcccagcgaccattgctctcctggctgaggatggcaacctagtgagcctggaggaggacctgaaggaaggggcttcccgggcccagaccatgggcaactccctactgaaggagcgaaccatatatgtcctcgttcggatcatcagtaaggtggcccaaggttctctcccctgcagctatggtagaatgtaagaggggggcatagcagaccatagaccacccaaggccctgtccagcctcccacctcggctggggacctagccccaatccatccctacccaatgctctgctcccagcctggactagcaaacagttccagagtgagaggcagagtagggaccattaggccagtcaggtgtccttcatcgtctctccacatgtcacagagggagaggacatggcctccacccgctatgagtccctattggagaacctggatgaccattacccagagctggcaggtgagtgtcagggtacagcccagggggagggcacaccttctccctaacccctaccaacaggacttcctgggccttccagaggaactgcgcaggctgtcaggcctctcctctgtgggccacaactggaggaagcgtatgggcactcggcgaggccgccatgagcaaagccccacttcaaggcccagaaaggtgagctccctgccacccaggagttgctagctggggcagggagccaggtacagagcagatttggacatccacagagacacccagagtgggatcccttcctgcaggacagacacatatgatgaggggcagaccctcaacaccaactccacgcacatatacccccagatggaacacactgtaccctgagacaggtccccaccaccccacgggagtgccagcgcactaagggccggaatgtcctcaggcttcacagatgtggcataggggctggcacacagtaggagctcagtgcacaactgctggatgaactcaatgaaggcggcagcatggtgtgtgatggcacggcccacactgggtttgaagggcttgttcttccattctggcaggcttggggacctggcacactactgccaactagccaagttggactcagacccaggggggttagccatgacctctgccttgtgtgatcaggtgcaaacagacaacaacccagcaggactcctcttgcagaatctggaattgctgagaagttgcatcagcaagaggggcaaggtcagacaggatttgaggccgccaggggcacctaagctgtgggtgcagagaatgggatgcagaggtagagacaagaagggtagaggtggcaggtatccctgataagggggagaccatgggttcatcctgggattccaccctcagagtcagatgcccttgggatcaccgactaatgcctctccacctcactctggactgcccaaggaatctgtcctgtgctacccacagtgcagattgcaacagggctcctcctccccacccagggccctgattaaggggatggattgcacactgtagtgagacatccatcctgaccccacctcatcagccagggagctccctgaagacaggccatcgagagaggcacacaacaggctgtggtctaaaataaacttttaattgc

SEQ ID NO: 1875 - DNA, 2657 bp, Homo sapiens
attacccaggagaagaacagagtgaaggaagcattagaggaagagcagacaagagtccaagagctggaggaacgcttggcccgccagaaggagatctcagagagcaacattgcgtacgagaaacgcaaagcaaaggaggccatggagaaggaaaagaaaaaggtgcaagacctggagaatcgcttaaccaagcagaaagaggaattagaattaaaagagcaaaaagaggacgttttaaataataaattaagtgacgcactggccatggttgaagagactcagaaaacaaaggcaactgaaagtctaaaagcagagagcctcgccttgaaattaaatgaaacattagccgaactggaaactaccaagacaaaaatgatcatggtggaagagcggctaatcctgcagcagaagatggtaaaggccctccaggatgagcaggaatcacagagacacgggtttgaagaagagatcatggaatataaggagcaaatcaaacagcacgcccagacaattgtgagcctcgaagagaaactccagaaagtcactcagcaccataaaaaaatagaaggcgagattgcaacattgaaggacaatgacccagccccaaaggaggaaaggccgcaagaccctctggtggctcccatgacagagagcagtgccaaagacatggcgtacgaacatctgatagatgacttattggctgctcagaaggaaattctgtctcagcaggaagtcatcatgaagttaaggaaagaccttaccgaagcccacagcagaatgtcggatttgagaggggagctaaacgagaagcagaagatggaactggagcagaacgtggtgctggtccagcagcagagcaaggagctgagtgtgctcaaggagaagatggcccagatgagcagcctggtagaaaagaaagatcgggagctgaaggcccttgaggaggcactcagggcttcccaagagaaacacagactccagctgaacacagagaaggaacagaagccccggaagaagacccagacgtgtgacacctctgtgcagatagaacccgtccacactgaggccttctccagcagccaagagcagcaatccttcagcgatctaggggtcaggtgcaaagggtcccggcacgaggaggtcattcagcgtcagaaaaaggccttatctgaacttcgagcgcgaattaaagaactcgagaaggcgcgctcaccagatcataaagaccaccagaatgaatcatttctagatttaaagaacctcagaatggaaaacaatgtccagaaaatactactggatgcaaaaccggatttgccaactctctcaagaatagagatcctagcgcctcagaatggcctttgcaacgcaaggttcggctcagccatggagaagtcagggaagatggatgtggctgaggctttagagctcagtgaaaagctgtacctggatatgagcaaaaccctcggaagtctcatgaacatcaagaatatgtcaggccacgtgtccatgaaatacctctcccgccaggagagggagaaggtcaaccagcttcgacaaagggacctcgacctggtgtttgataagatcacccaactcaagaaccagctggggaggaaagaggagctgttgaggggatatgaaaaggacgttgaacagctcaggcggagcaaagtgtccattgagatgtaccagtcgcaggtggcaaagctggaggatgatatctacaaagaggccgaagagaaggccctgctgaaggaggccctggagcgcatggagcaccagctgtgccaggagaagaggatcaacagggccatccggcagcagaaggttggaaccagaaaagcctccctaaagatggaccaagaaagagagatgctaaggaaagagacctccagcaagtccagccagagccttttgcattctaagcccagtggaaagtactagagaaacctcgtcccaccaggcctcatgtgatcctctgtgagttcatgtgactcttctgtgtcatctgtgtcaaaatactgagttgcttttgtaagtctttaaagattgttaccctagtgtttcgtttcctagaccagtattttgaacaatattatattttggagactgtggggagaagggttcttctttaaaaatacctatgaatgtacacgaactcaggtatatgaagaatagaagtgtgtaacccagatgtccagacctggtagatataattatgtggtccacgttgggtcatgatgttcccaaatatcaaacctcctaagacttccaacagactcacacttgagaaaacctaagacttgtactggagcctcagggcagaattgtaaccttggagctctcagggccttgggatagtgaattcaagtctccgttatggcctggcaggatggctcatgcctgtaatctcagcactttgggaggccgaggcaggcggattataagatcaggagtttgagaccagcctggcaaacatagtgaatacctgtctctactaaaaatacaaaaattagccaggtgtggtggcacatgcctgtagtcccagctacacaggaggctgaggtgggagaatcacttgaacctaggaggcagaggttgcagtgagccaagaccacgccattgcacgccagcctaacagagtgagactctgtctt

SEQ ID NO: 1876 - DNA, 2572 bp, Homo sapiens
gaatggagaaggtgggggtgtggtggccatgcctgtcatcccagcactttgggaggccaaggcaggagcatcacttaccaggagtttgagaccaggctgggcaacatagtgagaccccatctccacaaaaatatttaaaaatttagccaagcgtggtgatgtacctgtaagtcccacacaggaggttgaggtgggaggatctcttgagcccaggagttccaggctgcagtgatctgtcacaaccatggtcacaaccatgccactgcccctgagcttgggtgatagagcgtgaccctatctctaaaaattttgtttaaaaagaatgggagaggatcttgagctgataagacccaccgtgtcaggcactaagacatcttcttgcagtgctgctcactcctccctggactgtcttcagtgtcaagatgaggccgcttcactaacgagatgcgatgattcgtatgatgcaaagcccacggcttacagagagcacgtgaagatggtgtcggcagcagggttatcacatcctctggcaggcagcttgggaagggaagtttcaatctgtgttgatattttagcactgattaaaggtggatgtacaattagaccttttaaatttaaagacagtttgcactctatcaacaccttgtcttattacagttgtaatccatgagaaagcaagttaagaatgagaagtcatgggcaaaagtaattacacaatttcctcatgtggtataaaatggtacaaattgaaaatcccatcagcttcacagcccttgaccgaccaaaatgacatcccccaatgaatgctggtggcaggagcttaaggtgcttcctgcttagagagatctgcatttctgtttagaatgaagcaggtgtagataccttagttcacagtgatgatttgggctgagtgctcacattcaataggcaccgggttccagtggtttgcggggtttgatgatgcatttttaaagtgaagccgtaccaatgcaggcccatgcttccctgaggacgcggcctccgttctgctgagtgcaaaggtggtgccgagtgcaaaggtggtgctgggcacccacctcctcagcagctcctgccccagctgcagtccagccactgcactgggtccctaatggtcctggcgtgggagctgtggcctgggcctcctgtgcactgcaccgtaccctcggctgccatgagcacgggcaccccacggggacagcaagctcagcacccagtgggcctgatcagacagccacctgcgtcgtttcatggctttctccttcatgttgaaggagtgacagggacactgagggatgaagtccccacgctctggcctgctctgctcagtcagggccgctggcatgggccgttcttcccctgggactgcacagcctggacccccaccaagtcctgttgcccaccctggctcagctctcctccagcccagcatgcctgccttcctccctcctttccccatacccggtcctgccatctcccagctgcaaggtccatgccaccccacaggaagagcctcagcggctgtcctcagaccccaccctgtctgccccgaccctgccgcctcaccaaattctaagcacaccatgacccggcctgccctggtgtgctgcccatggcccggcgtgacccagtgtgctgcccatggcccagcgtgacccagtgtgctgcccacggcccagcctgacccgacccggtgtgctgcccgcggcccggcctgacccggtgtgctgctctgggaaggaagcctggtgggaacagtgctcactcactcactctgtcactcgctcactccttcacgccttgtctctggcagctttcgccacaggcagagctgcgtggtcacggtggactgcccgacccacaaagcctccgacactcactctccagcccgttacagaaaccttttctcaagattgtagaacagcagttctgcaaacggggcccctgagcaccagctggaggtcgttaaaaacgcagactcttgggccccaccccagaggttcagaacatgtcctggaggcaaggccagcaagccattgggagcagcccccagggacctcaatggcactggagccgagtaccactcacagctgcagtccaagagctcctgaagacaaacccctgccccctgccagctgggagctcctccacagtagacactcagcaaatgcctgctggccggagcagcggcagggaaggtagacgactgcaaggcattggaaacggcccctctgcatcaggagacaccctgggtgcaggaggaggcttcgctgaaaagcattgcaacagcattatcacatacgtggaaataagaattgcatctcaacccttcccttgccctccacccatctaacatgcctcagccctcctgtggccatagtaacctgaacagtaactacagcagcaggctgcttaggtgccaggtgtaagaagagaaatttcatgaaaacaggaaaatatagcctgcttttctccccagctctaacctttcaacctataactactccctactgtaatttttgtgggatttgctgatattgaaggaagatgattg

SEQ ID NO: 1877 - DNA, 2509 bp, Homo sapiens
gctgtgagtcgcgcggttgcggaggagcgggcagagggaggtcgcacactctgagtttcggtgacccggaagggagccccgtggtagaggtgaccggagctgagcatttcagatctgcttagtaaaccggtgtatcgcccaccatgttggctgcaaggcttgtgtgtctccggacactaccttccagggttttccagcccactttcatcaccaaggcctctccacttgtgaagaattccatcacaaagaaccaatggctcgtaacacccagcagggaatatgctaccaagacaagaattaggactcaccgtgggaaaactggacaagaactgaaagaggcagccttggaaccatcaatggaaaaaatctttaaaatcgatcaaatgggaaggtggtttgttgctggaggagcagctgttggtcttggagcgctctgctactatggcttgggaatgtctaatgagattggagctatcgaaaaggctgtaatttggcctcagtatgtaaaggatagaattcattctacttacatgtacttagcaggaagtattggtttaacagctttgtctgccttggcagtagccagaacacctgctctcatgaacttcatgatgacaggctcttgggtgacaattggtgcgacctttgcagccatgattggagctggaatgcttgtacactcaatatcatatgagcagagcccaggcccaaagcatctggcttggatgctgcattctggtgtgatgggtgcagttgtggctcctctgacgatcttaggggggcctcttctcctgagagccgcatggtacaccgctggtattgtgggaggcctctctactgtggccatgtgtgcgcctagtgagaagtttctgaacatgggagcacccctgggagtgggcctgggtcttgtctttgcgtcttctctggggtctatgtttcttccccctacctctgtggctggtgccactctgtactcagtggcaatgtatggtggattagttcttttcagcatgttccttctgtatgatactcagaaagtaatcaaacgtgcagaaataacacccatgtatggagctcaaaagtatgatcccatcaattcgatgttgacaatctacatggatacattaaatatatttatgcgagttgcaactatgctagcaactggaagcaacagaaagaaatgaagtaaccgcttgtgatgtctccgctcactgatgtcttgcttgtttaataggagcagatagtcattacagtttgcatcagcagaattccttgaggtttagaagatagcctgtcaccatgtttaaaatgtgcagtaatgcgacccttcaggcatgccttttcttttagaaaataaatgcaatagatgtcttccaaatatattttcatctcttatgctttcatactttaaaactgctttgatgaatgtgtgaacaaatatattttagaagatttcaagtattgttttatgtattggataagtaaaatttagcaaatttgcgtgtcttcatattgtggaagcctgcagaatatttcagtggcatcatgagtgacaagtttttgtatagaggtcagagagataaaaggcacctgcagtcagtttgaatgcccaggacaacactgattgtggtgagccagtgaaagacatcagagatgtggaacaagggaccaccaaatgtggggttaacaaagacacggatgtttcttctgtgctcttaatgtccttgaggttgactgctcattgtcaggacagtccagagtgttaaccatacagagaatctctgctggaattatgtctgtgttttactatgaagtctttagaacaagcaggttggtggtggcgcacacctttagtcccatcatctgggaggcagaggcaagcagatctctaaattcaaggccagccaggtctacaaagtgagttccaagccagacaaggacctgtctctaatacaagcaaacaaacaacaacaaacactacccgctatgctcggtatgatgtactactccaaagctcaagactcctttgctgtcagatgtgtggtgtatatgcagttggacaggatttaggttttggtttttggttttgttttattttgatatttttctcagtgtctaattgaaagcatgcttgctttctcatcacagctttgacagctgtcagaaaagcctctttgtggcttatgctaagattaggattggtttttcttctaaaactgttggcttcctccgttccctctcagcttaagcatgaacaaagcaaacttagttgaccttgggaagtatttgaatgaaaactggaatggggaggtgctcagcttccttgtgacataagattttaatacagatcacttgtttgtggtgaggggttcttcattgaagtctgtatgtatttacaaaataactatttttgagaagtatttattacagtaatccataagtaattcttttaatcactttaaagtacactgaatgctaatttctgaaataaaagtttcagctaagtggc

SEQ ID NO: 1878 - DNA, 1860 bp, Homo sapiens
gctttccttttagcttttgtaagttacacgtcaaaatggccgatctgacatcggtgctcacttctgttatgttttctccctctagtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagactatttgccggtttcacaagacataatttttatcaactagctcttaagagaggcatagcaaagtgggggttgctaccatttctagagagagaggacacagtcccggcctgggctgcccccgctccagtcaatgctcactgaaagtctgtcttagctgcctgtttgaatgactgttctttttctcatttttaattcttggactcatgtcctcattgcttcactcaattgaaaaaaaattattctccagtcccctcccactttgcttcttgtatgcattgtgaccgaccccacttcctcagaatgtaacggggccagagggaaacttctcacaaacttcgtagagcctcctcaggggaagctaggaagaagacatcaaatgtttttaagtcatgaccaaacaggcttgttggggacatatcatggggtgagctttgaagtgctggtggtccagaggggttgcagatacgtgacttggagcacccgtgtcttacgatggacagtgataaaggtgaacacacagagacagactattctctaagaatgtgaaaaacctgatctggaagaggagctatataaacactatctgactatctttgtcttttggggccagtggctgttggcataatcacaagcctgtctgtcttcgagaagggacagtggagtcatccaggtgctgccacatgacaggcacggtgggcaccgatccacagtgggccccgccttccccagctcgcctccctgcctgtgctggcctggccttgcctgctggcaccattggagtaggagggggtggaacacagggggcccatcctgatcaggccccatctcaaggttggcactcctgcccatcacccttagaaggatcttttcccatggcttgactcccttcatttccctaactgaaatacacccactctcttggaataatgacgtaccactcagttggaccctcaagagtcactgctttgtctgtgctggtagtttgtgagaagtgacccgcacgcttccatttgatgcatttgatgtgagtgaatccatacatttgaatgtcattgtccttgagaccctacatgtgcagtttggctcatctcattaaagatgcttgatgt

SEQ ID NO: 1879 - DNA, 2101 bp, Homo sapiens
aaataagggagtccggcggctcctctatcaggaagattgtgcatgccgtgggtctgacggcttgagtagcgctagggagaatccctgcaggtaatatttgacttttgcttcatattaatctgagtggaaaataaaagggccctcttctcctctcgcttccctgccgggcaggcgccatggcggaagcctcggcgacgggcgcctgcggagaggcgatggcagcggcggaaggctcctcgggcccggcgggcttgactctgggccggagcttctcgaactaccggcccttcgagccccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcctttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttgaaaaact

SEQ ID NO: 1880 - DNA, 2139 bp, Homo sapiens
gacgccgccagctcttcactccacgcccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaaaagcaagagcgctaacagaaatggtatacatagatgaaattgatgtagatcaggaaggaattgcagaaatgatgctggatgaaaatgctatagctcaagttccacgccctggaacgtctttgaaactccctggaactaatcagacaggagggcctagccaggccgttaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggctttgtttgagtatatctttcatcatgaaaatgatgttaagactcaaaatccttttcttcaagtgaaatcttatcgagaccctaatacgtaaaacagacaaaaggctttggatctggctgccctctccacagaacattctcagtacaaggactggtggtggaaagtacagattggaaaatgttactacaggttgggaatgtatcgtgaagcagaaaaacagtttaaatcagccctgaagcagcaggaaatggtagatacatttctgtacttggcaaaagtttatgtctcattggatcaacctgtgactgctttaaatcttttcaaacaaggcttagataagtttccaggagaagtaaccctgctctgtggaattgcaagaatctatgaggaaatgaacaatatgtcatcagcagcagaatattacaaagaagttttgaaacaagacaatactcatgtggaagccatcgcatgcattggaagcaaccacttctattctgatcagccagaaatagctctccggttttacaggcggctgctgcagatgggcatttataacggccagctttttaacaatctggggctgtgttgcttctatgcccagcagtatgatatgactctgacctcatttgaacgtgccctttctttggctgaaaatgaagaagaggcagctgatgtctggtacaacttgggacatgtagctgtgggaataggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaagggaaaaaaagcactatgtctgtgtatgtatgtatatagtgtaatacgtatattttaacaaacctgtccttgatattagttaaggtgacacataagggtgacacagaatgtgtaatgcaaatttcatagtaatagtaactttataaaataatattataaaatacaggatttaaacctttctaaatagatcctgaaactgtctctcacattatatagtagatgtttgtttataatgtttacaaaacattttggtgaatttcctcaatgttttataaatgtacattttttaagtccttaagctgactcttagccatcatgtagcttaaggagtctgaaatctgccattaaaactgcacctttaagccaggtgtggtagcatgtgcctatagtcccagctacttgggaggtggaggtgggaggattataaatagagactttccttaagactttaaaaatgtatttaaaactattttttattaaatactttgtgatttcctattaagctttagaataaatcattgtgtaaaacacc

SEQ ID NO: 1881 - DNA, 1744 bp, Homo sapiens
atagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggggcagatctgcaaggagtatgaagctgagcagcctccctttccagaaggatatatagtcaaacaggagcctgtgattacggttgcgccagtagaagaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagcccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccggcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaaggaccagtcttcactttctgcattatccccacattttattcattcatccagattacttcttcagtgcctcaggagtattcttctacaccagctgctgttaaaatgtacaatgaactctagtcccaaggaatacagaagtgctcttattaccagttttcccacttgtggccgcctttgcaaagatccatattctaatttaagtccccaacctctgaatttggttttaagtttacctagtgactgactactctctttataaaaaagaccttatacttaatgatcatttccaaaggagaccactccttaacttttactgcaaacccaacaagatgagacacttaaacccagacagatgtaacaaaggatttttgttgtctaagtcccaaagtattatatagaaagttcctgcttttatgggtaaacttattaccttaatatgttctgtggtttgctgttaaccaagattctcccatttaaaatgccacagaccgaccctcaaggcagatccgaaagcctagtagttagttgcactgggttgttttgacaagctaccacacgtcttaagtaaatagtaaagcctttatttttgtgttaagaacagcattttgaaaataaaacctatctgcccatgctttacagccttttaaatttgtaatatttatatagtcgtttatggtacatattgattgtcttgaaatttctttaacttcttttttataagtatgcaacagtcagccgggggaagataaaggtacattataaaacacacattaatgcatttgataaatatatattatctatcaaaagtgagccttagctcttcatcagttaataaaaagcacctgctgagaactcc

SEQ ID NO: 1882 - DNA, 2384 bp, Homo sapiens
gttttgccaacgtactcgcaatagttcccatggtttcctttgctcccagcggttgcgcgggctgggtttttggagcaaaggcaacggatactgctgaggctcctgagaatgtcccgttttcgaggctgcagtagctccggtgtccggttctgcagtgccgagagggaggcctcgggctccgggcgtgggaatgtgttgcagtttgtccaagagccccaagcccagcaaagccgcccgttccccgctggggcgcaactctcactggaactcttgttctctgactggggaatggaatgggctcagccaaggctcccgaaaccagccctgccgctcccagttgtggtcgcattctcaagagcggctgactgcgccgtggaccatcactttcgcttctgcctgctcttgcgcctattgcggcaactactcacgctcctacgggacgaggagagggaggtgaatccgtggcagagaaaaatagtagtctagtcattcaagtgaaaggtccaagaaaggaagaaagaaaaatttatcaaaaagaaaacacaagaagtattctgaagatagcgacagtgactctgattctgaaacagactccagtgatgaagacacaaaaatgagagcaaagacagctaagaaaaaggaaaagaaatgcagatggccagattttttcctttaatttttattatggaaaaggtcaaatgtgtataaacatacatagaatggtataatgatccctcaggcacgtagcacccagcttgaacaattaacaacttgtgggaaattgccattgccccctaattaatttgaaaccaatcccaggtatagtgtcatttataaacaattcagcatgtttctctaaaagactgttttctttattagtctgttttcacacaccataaagacatacttgagactgagtaatttataaagaaaagaggtattgattcatagttctgtatggcttgggaggcctcaggaaatttacaatcatggcggaagccaaaggggaagcaaggcacatctgacatgggagcagaagagagagtgagaagggggaagcaccagacactttacagataaccagttctcatgaaaactcactcagtatcatgacaacagcatgggggaaacccatccatccaattacctcccaccagacccctccctccacatgtggggattataatacaagatgagatttgggtggggacagagccaaaccatatcagatacacgttctttttctaaaaacataactacaataccattatcatgcctaaaaaaattaacaataactcctcaactctcatcacactccatttttaaatttttgttgttttctagcctagcagtttcacatgaggaagacagcataaagaaagccaaggtctgactgcttctttttgatgatcaattaatctagaatattaatcagggaactacctcctccctcttgcttctagcagcactaaacaaaaggttccctttttgtgtttttatcatcaggaaccagggtcctttcaaggaggttgaatgagacaaaatacatttgaatgcatgattgtcagcttctgagctggggaatatgcaacaatatgccttctgggctggggatgggtgagcaaagggagaactgcctcattctggctttggtagagtctcctcttgtgtttcatttgatgcagaggaactttgggccagaatgattcctatttccctatgtcctccacagaaagggaggatagtgaacagaatttgcaatatactagatagatgtttggctgccaccttcccataaagccctatgagtagcttcttcggaagattcctttagactacagggttgtgtctaagctcttcagcataaatggagatgggccctgtcttgaaacacactgttcttttactagggactttccccacccccattttgcatatgtatgtatgtgagccgtacagggcgtattggtgattgaggaatgtcagctcataaaatgaggcttccttgtaattctgtttaaatgacttttcctttgaaattcttatccataccttatttggcacacaaaacagatatacagttgacccttgaacaacacaggttagagctgcatatgtccacttatatgtggattttttttcaataaatagaattggccccccatatccacaggtttcacacctgcaaccaaatgcagatcaaaaatacagtattcgtgggatgcaaaacctgcagataggtaaggccaactttttgtatacttggattctgcaggttcaagtgtggggcttgagtatgcatggattttggtatctgcaggggtcctgggaaccaatgtttacaaggaattcacaactttttttaaataaaaaatgtgccttat

SEQ ID NO: 1883 - DNA, 1900 bp, Homo sapiens
ctctttcagatctgctacggcatgtatggcttcatggatgtcgtctgcataggcctcatcatccatgaaggctcctctgtctaccgcatcttcaagcgctggcaggcagtgaaccagcagtggaaggtcctaaattatgacaagaccaaggacataggaggagatgcagggggagggacggcagggaagtcaggccccaggaactcacggacgggccccacctctggggccacgagccgccccccagctgcccagcgcatgcggacgctcttgcctcagcgctgcggttatacaatcttgcacctccttgggcagctgcggccaccagatgcccgttccagctcccattctggccgagaggttgtcatgagggtcactacagtctgaactggactccaggagcagggatcttgagtcaatgcatcagtcagagaagaactctcatggctgctggaggtaccagctggacaaggtgtttggggcatgctgcccccgtcaccgaggatctgtgtgggtagcctcaagctggagacattgtctggcctcactgcccactgggtagagacacctggatgacatttcagtacccgctggcagctcctcccactcatccagagacggccggtgggcaggcggggagagcagctttccttccctggagagaaccgtctttacctcagctcctagggcctccagccccccagctccaccacggtgacttggtgaagggggaccaatgccagaagaaaggggctgtagacccctattccccaccccatggccacagggcatctggcaataagactagtatacattgacctcccgttccctgcatgagggcggggagttccccctgctccatcccccattgcatgggggaagggcataaagaatcatttatatgcacgtggagactcctttctcatctggggcttttctggagggttgggagatgtggggaggtttctctgcacaggttgcaaatcccaaatgcagcagtgggttctgagttgtaggtgtgactcccacttgctggtgaataattcatgttggctgctaggtggcagcactccgaggtatctaaagggtagacctggacctgccacctatgagttgtgtgatatagaaaaaaatctcttagctctggttttcctgtctacttcatagggttggaataaggataaatgagggacaggttggatgccgttgcagagaaaatcagcaatgacataaagagatttctagaatagttgatggtccatttatttcaaatagtagctggtgtaacaaattctaaaatgtgtttttcatctggagttgcacagaatcatggaattttgtgttgagtgacataataggtatggaaatatgaggggaaatagacattgcaaatgtgaagcatggtggttatttgttaagaatgagaactcctctgactctaaatatttgggcctgtgggctggggaaggctggagccatctgccttgttctggagatcatctgggttctatcagtccttctcaagtactgtgctcacccagaaaagcagtgtgaagtgaatttggactcatttggagtgagatggagggaatccccccactcagtgttatgagtctccaaccccagtttaagctatttccatggcagtttagggtcacaggtttgatcccggtgtgcccagccagtggtattaatggatggcattatgtttggaggcagcagcatagaggactgttgtttatagagaaaagatttgggaaggactgtttacaatgtgggtcagcctgaagcctgggcactttcttctgtgaccttggggttgtgtattatatgaatgatgctgtttttaagtaaaccattcaacagcaattaaataattccttcattcacggctaaagtc

SEQ ID NO: 1884 - DNA, 2596 bp, Homo sapiens
tttttcttttggtagatgcggtctcagtatgttgcccaggctgggcttgaactcctagccgtaagccatcctcccaccttggcctcccaaagtgctgaggtcacaaggcataagccaccacgcccaaccccatttttcttttgtgggggcttcaatggcacaaggggtagtcagtgatggaccaagcttccacccttttataataggaagggttgcccatctactggaaacctccacaatatttgtatgaaagaaaaacagcatttttctctagcagagaaattggaactcaattggaagatgaagactagtcagttcaagctagcaacaatggcaatggtttggtggggtgggaggatcccatggtgtgatgcaggtctgagccctggccgtgctggatgtggtcatgagcttcgtctagtcatcagtctgtctcctacatgccagggatcccaccaggaggcatgtgagtttggatggggaggcaaatgcagtgttcctgccctcacggagttgactgtctggtgggggaggctggtgtacaatcttgcaggagcatcgcctgggagccctgaaggatgaatagggaggagctggccaagtcgaaaggagcgggtggtgtcaagagaccccagcagaaggaccatcgtgcacaaagagcctgatctgacggggcctagctcctgccagggcagtgggtgcctagtgaggctggagctagaaagcagagccccggaggggtgcagggcacttcccactttgtccaggaggagcctgaggcccagggatcgggaccttgccctgggataacccagcaagtgagcactggagccagagctagagctaagggcgccaggccccaggctcaactgtattctccccatgtgctgagtcgtgttctcagggtgctcttccctacgtggtcacatttgactctcacaatgaccctgtaagggaggaagaattcttctgcccatttctcagaactaggaaactgaggatcatctggttgaccgagtgaatgaatgagctcggttttcatatgctcacccagttcatactaagcagagccaggcagaggcttttggccgcaaagccagggttttatccattgtctccactatctaaagcacgtgcctgctccaggcaggggatcaccgatgcccaggacaaaatcctagttgtcttacttgttaaattagtttaaattattattactgttatgagtaataacggtcttgtgttttaagtttttttttttaacttcttcaaatcactttcacagacctaatctttgtttgcaaacactgaatgagattaggggatattggtgttattttacaaatagagggactgagacccagggaggctgaatgacgtgccagcttgaggccagtcccagtagagaaatcaggtttcttgtgtgagtatggggctttctaaaacaatggtctctgttcttaagatgaggagagtatctgtgttgtctgccccgtgaccgtgaccaggagatacccagcctggccctgagttattacagtgtcatgcatataggtcacactgacctaagctccaaggagactaaagggtttcatctttgtcctcctccttctcacttcctcctcattccctggagtagcctgccggggcttctcttccttgttcccagggccagatgtcagaggccatggaccagccagctgggggtcctggaaacccaaggccaggagagggtgatgatggcagcatggagccaggcacctgccaggagcttctgcaccgactgcgggagctggaggcagagaactcggcacttgcccaggccaacgaaaaccagcgggagacttatgagcgctgtctggacgaggttgccaaccatgtggtacaggcgttgctgaaccagaaggtgagtaacccagacaccctggggagaagccctgggcacagcagatgagacccttcctggagactaagggcttggaggacatgggctgttgccctccagtgattccccgtctttccgccttgggcgggtccattctgttctacctagagacagaggtgggactaggtaaggccaggtctctgagcagtggtcactgatttgagcatgacttcttcccttaccctgtccccagctggcttttccaggttgtgatagcccttaaagcagtgttgatgttgtgagcctaaatggcatctgaatatttactcacctatggtggataacttcttgacattggggccactttaactccaaggccttgctctgtcttatataggcccttttttgatgtgtggtttctaagaggcagagggccaggcgcggtggctcacgcctgcaatcccagcactttgggaggccgaggtgggcagatcacgaggtcaagagatcaagactatcctggccaacatggtgaaaccccgtctctactaaaaataaaaaaattagctgggcatggtggtgcactcctgtagtcccagctactaggaaggctgaggcaggagaatcgcttgaacccaggttgtggaggttgtagtgagccgagattgcaccactgcactccagcctggcgacaaagtgagactccgtctc

SEQ ID NO: 1885 - DNA, 3001 bp, Homo sapiens
attttccacttgctgctcaggaggtattgagatcaatgaacactaacctgaggagcatatttttaccaaattaaagagctacggtgaaatatgtgttccaggttcctggttttaagctaaatatgcatcagttatctctgatcaggggaaacagagggcggagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcagcacctaactttactgacatgcaggctaactgtgtagatatttcaaagaaagacaagcgggtcacaagacgatggagaacaaaaagtgtcagcaaagatacaaaaatacaactgcaggaagggccacccgcgaagggccagttcagcacaactcggcgccggcaaaggctagcggcagcagtggctacaacagttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggcactcaaccagaatgctgaactaaggagtcggttgaacagaatacattcagagtctattatttgtgatcaggttgtcagtgtaaatattattcctagccctgatgaggctggtgagcaaatccatgtcagtctccccttatcacagcaagtagccaatgagagccgcctccccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaatcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggttctcgttgccgcatttgcagtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacacaacatcctcagtgggagaagatggatagaacattatggagaagtaaccatcagaaataccaaaagcagtgtttgcatttgcaaactcacatttgtcaaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcaaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaatt

SEQ ID NO: 1886 - DNA, 2444 bp, Homo sapiens
agatgtccccggcccgcgagagcgggcgccggggttcgctctgagtcgcgtggcaggccgcgctgcgtccaccgctgccgagttcagagccgcgcaccgcccgccgccgcaggtcgggttcccagcgctactcccaagacaccgctcagccatgaagatgcatttctgtatcccggtgtcccagcagcggtccgacgcgctggggggccgctacgtgctgtactccgtgcacctggacgggttcctcttctgcagggtgcgctacagccagctgcacggttggaacgaacagctaaggcgggtctttggaaattgcctgccacccttcccaccaaagtactatctggcaatgaccacagctatggctcatgagaggagggaccaactggaacaatatttgcaaaatgtaaccatggacccaaacgtgttgagaagtgatgtcttcgttgagtttttaaaactggcgcagctgaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctccctgttgtgaaaaaattggctgactttgaactcccttatgttagtcttggaagttctgaggtggaaaactgtaaggttggactccgaaagtggtatatggctccatccctcgactccgtgctgatggactgcagggtggcggtagatttgctctacatgcaggcaatacaggacattgaaaaaggatgggccaaacccacacaggcacagaggcagaaattagaagctttccagaaagaagacagtcaaacaaagtttttggagctggcccgggaggtacggcactatggatacctgcagctggatccttgtacctgtgactacccagaatcaggctctggagctgttctttctgttggcaataatgagatcagctgctgcatcaccctgcctgacagccagacccaggacatcgttttccagatgagcagggtgaagtgctggcaggtcactttccttggaactctgctggatacggatgggccccagagagctctcaaccagaacttagagctcagatttcaatacagtgaggatagttgctggcagtggtttgttatttacaccaaacaggcttttttgctgagtagctgcttgaaaaagatgatctcagaaaagatggtaaagctagctgctgagaatacagaaatgcagattgaagttccggaacaaagcaaaagtaaaaaataccacattcaacaaagccagcagaaagactattctagttttctatcaagaaaaagcaagattaagatagctaaagatgactgcgtttttgggaacataaaggaagaagatctctgaagaaagctctcatattttaaaatatccttggaggctatctcaagacagtgaaagaacttggggattcaggtgggctacctaccatcagtggaggaaatttgacctcttcccatttttttggcattaacatggactgtattcatcaaggtattataccacagcactctatggaaatctcaagattagaaaaaaaaaaagaaccaagttatagagttagtttttattttatttttgcacttcgtcatgacagtatagagtttgtttttaatgtctcataaatgacaagtggcaaattcaaatcaactcatataaaactcattctattttttctctaaaatagatctttatatggcttcatgaagtcttttatgtgttttgaatttacataaatgaaagtctcataaaatatcataaagatattttggatcgatttctaaagatgtgactcttcaacggaggagaatagggctctgagaaatggaatcactgaaaaagaaacctgggttctctgatctatccacacagaactagagcaaggaggtgatgaaatactgatctctttcctcacataagtctgagcctaccaatatggatgtactcaaagtgaaacgctgccctgttctctgcttgaccattgttataattttattctgtccttagagtactgaaggcagttcaataatcaacatgctatttggaatgttttaatttggaaagcaataaggctctgcacctgatatcagataccttataattctcttagctttaaaaatatgtatactttctcacaaggtttttccttatctagcttcatttctctcatggtaattaatgtaattatgtatagaattaagaccacaataagggagatgatcagaggaatctgtatagtgtaattagaaaaagtacaatattctaatgttctaactgggttgtatacctaattatataataaatacaaaataattcc

SEQ ID NO: 1887 - DNA, 1970 bp, Homo sapiens
agcttccaaactgcactgaggaactgggaggacttgggggcctctgagcacttagggtggtaggctcggggctccttccagctctttcacgtattggagttcagaataggattttggctacgaaagcatttcactgcagcttttagaaagaaaaggctgctgtagaagagagttcagtgctggctctcacactcagtggtatatgagaatcactctgggagctttgaaaacttccgacactctctcaacgccccgggccaattccctcacactctctcaggaagagacccaggcatctgcatttttaaagccatccaggagccctctgagaacagcagaggttctcaaagtggggtccctgggccagcagcgtcagcgtcacccaggaacttgtcaggagggcaaattcttgtacttcacccccacccacggactcagaaacctaggagtggggccagggaaggccctgccgatgacctgctgcctggtcaaggctgggagccgtgctcctggaagatctagcaagttcggggccaatggatgccaacggtgactgtcccatcaggcgtctcgacggcaagggtggccccgccccagcccagcagccctggactcacgcaagacacagtagaggccgagctgttcatagccctcacagcagtcagtcacgttcctggactcggggacctccactaccaggtactgtgtccggtaaaccatcttagggcaccgcctccaggggatccagccgccgcaggacacataggacgtgtaggacgtctgcacggcctccaccttctgtacagtgtgggtcacacggtggctgcatagctggtagcccaacagggagaggcctttttctgaaagaggccaagcaagaaggcgactgagaacaccaggatcagatccgtgcgagcggttatccgcaaggcgtccctctgcaatagcaagtgagagcacacctcccgcactcgcgcaggcctctcagaagctgcccaccagccctctccactggcctttgcctgctagtgcaccaggaaggctgttgcatgagtgagcacagaagaataaagcataaacgtagcctggcctgctaagaaagccgctgtgaccgaggaggaggtgccacctgggccccacgcatgcttcctgaagcacagggttctcacggtccatatacgaaggagagagcacagcgctggaatcaatgcttagagatcacgtccctttgttctgctccatgtgagctgattccacaggccgtagaatctcgtgcacatctatctcttagtccccctgagcctcaaggttgccacatgggaagtgaatgtgcagcagttccctccacagtgcaaactgaaggcctgctgtggccaggacatgacaatgacggctttcttttcaatgaggtggaagataagtaagcaggtacttaaagcacctgtggagtgcggtcgctctgtggcaagtgtgtgagaagttcgttgatgataaaagaccagctcaggccgggcgtggtggctcacacctgtaatcccagcactttgggaggccgaggcaggtggatcactcaagctcaggagttcgagaccagcccggccaacatggtgaaaccccccccccatctccagcaaaaatactttttaaaaattagccgggtgtgggctgggcgcggtggctcatgcctgtaatcaatcccagcactttgggaggccaaggtgggcggatcacgaggtcaggagatcgagaccaccctggctaacatggtgaaagcccctctctactaaaaatacaaaaaattagccgggagtggcggtgggcgcctgtagtcccagctacttgggaggctgaggcagaatggcgtgaacccaggaggcggaggttgcagtgagccaagattgcgccactgcactccaccctgggtgacagagtgaagactccctctgaaaaaaaaaacaaaaataaaaaat

SEQ ID NO: 1888 - DNA, 2512 bp, Homo sapiens
atcagatctgcagggcaggcatcaccccgccggcctgggtgagactcctgggtctgggcctggccaaagtctgccaggttgggaaagctgcgcttggaagaggtctgttattttcctcactgcttaaatcttgaggtccctccaccaggccacccctgctttgtgccacagtcatgcgctggcacctggactcacctggtcctgcagcccctggcaatttgatgtgcccctcccggctttctggagccacccttccctccctccaagacagcctgccctttgggaaatttatgttgtctttgcagctggcaccgtgctgtctggcacgtatatcagtgctgttccattgatctgtccagctgagtccagagcaaaagagctagctttggcgggcagtgaggtgagagcaagggtgtgcgacctagccaggccacttaccccagccttccctgtcccttcactaccttgacctctgttttctccttcaggactaaaggccaacttcttatgctctacagctccaaccagaggtaccagctgacccatataatctggaaacaagtttgaattcattgctgttagaaagaattgcagtaatactgagtgaatcaaacaaggcacatgtgctctcgtttgcattgcatatacattgattatcccagaaagaaaacaaaagaaactggtgatggtggttacctattgcctattcaaaaataacggtttaaaaaacaccccaaaactaatagggatggatcgtgagtggttacggaaaaagtaaaataatgttttgcccctagtttggatttgacaggaagaactggtaatattgggcctgaatccatccagcatggccctaaccagccagggccagtctgggctgctccccttgggttgggcctgcaccccatccctgtcactcagatggcttttgtggcctgtgtcccagcttggtcttcaggtcttgcctggctgagattgttggttttcatggtaaaagcagggtcagactccctgccgtcacctgctgcgtaagacacagaaagtgctgcctgctgactgactgtctctcctcagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttccccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccttcgtcttctgaacgtggcctatggcccaggacagcctggcaggtggcctcgctgcccccagttcccctctctgcccccacactcgtcttagttgcttcacactggtcactggccctgcacactgggctattgctttatccctatcctgagagcagcccctccccaccatccctccacatgctgcaaggacagactgaagggctgtgagcaggtgtaagggctcccacatccgtgagcctgtgtccgcagctgctgccactctgggctgctccagcctgcaacttagtggaaggaattacttcctcctgaggctacaggcgagaaaggtagggatgggccagcctcccgtctcagctgttgggagacagtaggcaggctgagtggcccagagcactcctggaagtgggactcccctgccttgcaaatgtgcctctccagactgctcctgcacttaccccctccccgcagcaccttctctgcccgttcttgtccacacatctattaaatgcttctgttttcatttgc

SEQ ID NO: 1889 - DNA, 2112 bp, Homo sapiens
aaaaaaaaaaaaaatagtacctacgaagcttgaaggatggctggagcttagggtttgtgagacagaacatcaggaagtgagcccagaaagctgaaggtctggtgatagctgggtgcaggaatattgtgcaggagggctatgtgtcctggaccatgaagaaggatgacttctgactgctcctccacacactgctctcctgagtcctgtggcacggcttccggttgtgcacctgcctcaagctgctccgtggaaacagcttgtctccccggtgcctgtgctacatcccgatgtcagactccaagcttcctatccaggtctcgcgggctgactggttgcctcctgccatgctactttactgggagttgtaatagtccctgcttggtggggaactgtgcctggtgtgaggatggggtgttcactagcaatgagaaggagacgatgcagttcctgaatgacagactcgccaactatctggagaaggtgcgcagcctggaggagaccaacgcagagctggaatccaggatccaagaacaatgtgaacaggatatcccaatggtgtgcccggattatcagcgttacttcaacaccattgaagatctccaacaaaagatcttatgcatgaaagcagagaattctagacttgctgtacagcttgacaactgcaaactggccactgatgactttaagtcaaagtatgagagtgaactgtcccttcgccagctgttagaggctgacatcagcagcctgcatgggatcctggaggaactgaccctgtgcaaatctgatctggaggcccatgtggagtctctgaaggaagatctcctttgccttaagaaaaaccatgaagagacgaagaaactgaggcccttctacgtggtgaaaagagattcagcccaggcaatctgaatcaaaatctcacacttttacccactgctccaaaaaacagaagtagaatgccattggatgtcaaatggatttttccccaccattctgtgacattctttacaccatcccactttcaggaagtcaacttgcttcatgaacagcttggcgaccgcctcagtgtggagctggacactgcccccacccttgacctcaacagggtcctggatgagatgcgctgtcagtatgaaacggtgcttgccaacaatcgcagagaagctgaagaatggttggctgttcagacagaagacctgaatcagcagcaactgtccagcgcggagcagctgcagggctgccagacggagatcttggaactgaaacgcacagccagtgctctggaaattgagctccaagcacagcaaagcctgacagaatctctggaatgcaccgtggcagaaaccgaggcccagtacagctcccagctggcccagattcagtgcctgatcgataacctggagaaccagctggccgagatccgctgcgatctggagcgacagaaccaggagtaccaggtgctcctggacgtgaaggcccggctggagggtgagatcaacatgtaccggggcctgctggacagcgaggacagcaggctttcctgtagcccatgttcaaccacatgcacctcgagcaacacttgtgagccatgctcagcctatgtcatctgcactgttgaaaactgctgtttgtgaatgttaaggacagcaggtagaggaatcaaagccagcagcatcctagaaaggagatggggcttcaaccagggacatccaaaccggaagcacaaatccaggaggctctcatatcctggaattgccctccaggtatcctcagtctttctgctttactatttcctctccttccggcttatttgtggtatactggaagcccataaagcattcttgctcatctccaaataaaacgtgttttattcctttagcatggtaaatatagctctatggctgattactgttgatagaatattcattttatggcaaggaaatcatctaaacccataaccatagtttaaatgtacataaacccaagctgaaaatattttttaactcctcaaatacaaataaattaatgaacccatgagaaatgtcatatatcttagaaaatagttgtgtgtatctttctgaggaaaaatattaggaataaaatatgataaaatgt

SEQ ID NO: 1890 - DNA, 1956 bp, Homo sapiens
aaaggcagagtcatcccaggctctcacagtggaattaataataagctcacttgccacctcagtttcaagtcatctaaacctgtgtcattttttaccaatcttcttttctgtgatgacagaaaaaactggttttcacttccagttactgcaacagcagaaaactgcattcttactatttacccatatatggcaattcatctggataagcaaaacattattttaaagaatgataaggatgaatatcttaagaagactagagatggtgttttgcctccctaccaggatgctaaaccaccctctcctgcttcaattaaaaagacatacaccactagcaaattcaatgatgctgaacctgcaaagggaaacttatttattggagtggaagtactgcctgaaaatttgcacttggatgaaagtgaaacatcagaggaagatcatgggtctctggaaaaggaaaaatatgaacaattcctttctcttgaggaaggaacaaaggcacactacttttttgagaaggttgtaaatgcagcacagacctggttcagtctctttggctggcctgaaggaccccattctttttctattccagagactataagaagggatgtatataaaatgcaattctactcatcaacctcgccaccccaaaagttttccagacagaatgacttttccaaatataataagaccatttatgatgtgctgctccatttgagtggaaaaatgccacctggaattaattcaagtcaatctttacctgtagataaccatgaaaaaagggtaattcaactccatttgcaacattcctcacttctggactttctcaatgctcaaggaggatgtatttcacatgtcctgccagaatttttgcttgaaccagaagattataagaggtggattgaaattatgtcttccactaatacgatgcctgtgagttcctgtacacctaagaaaaaatgttctattgttatagaaatgtctaaatttgaagcctggagcaaacgggcatggacagatgtatttctacagatatacaaggttttggttctatcccgtgtagtgccatactgcagcaataatatgccccccatatgtgtgcaaaatacaccaaaagtcaatccttgttttgcatccagcaacatatattctgattctgaaagaattttgcttagttggatgaacataaattatgagaatactcgacatgtgatatggaaaaactgtcacaaagatgttatcccttctgagagatggatagtaaattttgacaaagacctttcagatggtcttgtttttgcaacacagttgggagcctattgcccattcttgattgagtctcattttataaatatgtacacacgaccaaaaagtcctgaagagtatctgcacaattgcctgattattgtaaatactctttatgaaattgactttgacgtggaaatacaggtgtgtctgagggtgtttccaaaggagatggatgcaggagtcagtggcctgagaaaggaagatatgccctcagtgtgggttgttaccatccgattggctgtggcagtggccagaacaaagagacagaagaagggggatattcagtttgcttgtttttttgtttgtttgttcttttttatttttgtcgtgatctctttctccctttggagcaggatgcatttttttctccttctgcccttggacatctgattccaggtttttcagcctttggactctaggacttgcaccagcagcctcctttgggctttcagccttcggcctcagaatggggcctgcactgtagcttccctggtttgggggatttgggacttggcctgagccatgcttctggcttccctgggagcccctattggcttctgtcattctgcagtttgtagccagcctactgtgggacttcgcctttgtgattgttcagccaattcttcctaataaattcccgtttatatatat

SEQ ID NO: 1891 - DNA, 2330 bp, Homo sapiens
aagaaccaagtgagagcactgcagtgcccgcggtccttacctcctgccggagcagcgctgcagaggcacaaacactcctggcggggtggctgcctggggaggggtgagcttcccgacagaggccccagccatcctggaggagggtgctgggcagacaccggcccctctaaccgtagctcagccacactgcccatcaccttcaagtgcctgctggagaacaaccacatcgaccggcgcatcgctcgcttcgtgctgcccgtgggtgccaccatcaacatggacggcactgcgctctacgaggctgtggccgccatcttcatcgcccaggtcaacaactacgagctggactttggccagatcatcaccatcaggtgcaccctgacactgcacctgggtggatggggcgggggctgggggccttggggattcccaggctcccagacttgaggggtatctgaagcgagcgagcctgggctcggagcacagcaggcagagggccagggctgggagctccgagcctggaggacagcccgggagggagggcattgctggtggccacagggcgagcggaggccagggacaggactcaggaccttggagaggccgcccgtgtggcaggagccaacgaaggggtgctgggatgcggctgaggctgacggaggcctcacagcccagccaagcacacaggtctgaccctggaggccaggccccagaggcaggcaggcagagccatgtggtggtcagtcagagtccctgggcagccccatagcaatatagcttcctggaacccacagaggcacagctccagacacaggtgtttgcacagttcccagggattctcctgaggccaggaatgggggtccatggggctgcaggactgtgaggagggacttgaccccgagagctccctggtgtggcattcctacccaccccccgcaccaaatggctgtcccagaggccctgacactcaacctcttccttggagccagaccctgacaatgcaccctgcccctcctgctgctcctcttccccttcccaccccctgcagtatcacagccactgcagccagcattggggcagctggcatcccccaggccggcctcgtcaccatggtcatcgtgctcacctccgtgggactgcccaccgatgacatcaccctcatcattgccgttgactgggctctggaccgtttccgcaccatgattaacgtgctgggtgatgcgctggcagcggggatcatggcccatatatgtcggaaggattttgcccgggacacaggcaccgagaaactgctgccctgcgagaccaagccagtgagcctccaggagatcgtggcagcccagcagaatggctgtgtgaagagtgtagccgaggcctccgagctcaccctgggccccacctgcccccaccacgtccccgttcaagtggagcgggatgaggagctgcccgctgcgagtctgaaccactgcaccatccagatcagcgagctggagaccaatgtctgagcctgcggagctgcaggggcaggcgaggcctccaggggcagggtcctgaggcaggaactcgactctccaaccctcctgagcagccggcaggggccaggatcacacattcttctcacccttgagaggctggaattaaccccgcttgacggaaaatgtatctcagagaagggaaaggctgcatgggggagccccatccagggagtgatgggcccggcattgcctgaggccccgctgtgacagtttccccggtgtgagcccggtgagggcggcaggcaggggttatccggccccactttctggatgacagacttgaggctctgagagctgaaaacacttgtccaaggtctcacgttaaggtcaagacactaactcaaatctttcaagccccgcctctcctcttggaggacagggcagcctgcagctgtgtccaggcccaggccccaccccataacaggtggcctcagccacacagttctccccaaggggagcagcccagggccaagccccgctgccttccccaggccacagtgcgtccagtctcctgtcctgccacgtgtcttttgcaaagctccttggatgtggagacagatgtctttactagagctgaaaggcccccttgacacatccaggccaacctcccatggaataggtaggcaagccaggactccgggaaggaggtgcagccaggatgctctggtggagctgccgatggggccctggtgtcagaactccccaaaggcctgtgcgtccaagtggagtcaggttttctattcctttctgtgtttgcaaattcagtgttaactaaataaaggtattttgtttttc

SEQ ID NO: 1892 - DNA, 1943 bp, Homo sapiens
acactcactcggccacctccgcggcatgctggccgcagagagcaccgtctggacctccgggccctctctgctcctgccgctggagaggatccggctggtcagaaacaagggacggggccaccccaggggctcatgcacccggcagaccacggtaaccgccagtggtgtttccacaccgtgcccgtgaggaggccacgccaggcccctgcgtccgagctgggggtggggaagctgtgtctcaacaagcctctctatgggattctggcgcctgctcagcttgagaacgcgctcatcgtggagcccggcagacaggcggcctgacccggagaaaaggcaggacggcgggtggcctgccagggagagccgccgcggctgcgtctacaggaggcagaagagtaaacatggctgggcagtggatgtgcagctcacgtcagagaattggtgtttctggcgaggagggaccaagcctcaccacggagaaggacgccgtcaccggcgtgcaggctgccaacctgccactctgggaggccccacgcggcccctgcacctctcaggagggcgctggcgctgggatggtggccggccaggcaggggtggcaggagaaaacccatccgagtcctgcaggtcagcgccctgggcatccagtggggccgggaggggtgtctgagcgcagccaccttctatccccggcctcatgtggccccatcagcccaactggagcggctggaaatgaccatcaccaggcctggccaaggtgtggccctggaagccaggacagttgacttccggccatgactcccggagagtgccggagctggcgtgctcagcagagctgccggggacgatgtcccggggctgagtgggcggcttcagcctagacttgggcctagatcttgctggaggccaagtggtcagtgtcccatcagagtgaccatccctcacacgccactgctgggggacacacccccactgagcggccaagtccacaggacacgtgtccctgtgtccacctgtcagccacaccgcccctcgctcccctacagcctctgccctcagaccagtccacggcgcgccgttttacccttgggctttgctgtgtcccttcctttggctcctgtgccccgtctgtgtggccactgcaaccctcaagtccccctctccagaccatagctggacccccactcccggggctggctccagcagccatcagctgccttctcactctggcagagcccacccagtgccttctgaagcccccgagggtcactcagtctgagactttccggcttctgcccatcctgggaaccagcccctccctccagaagctttctctaaggttgtcagaaggtgctaagatctgaaccgaggtcatcttgtcccggggtttccaggcagcgtcccttgtttgggggccctctgagatgccttcagacccccgcctgtggcggaagagctttgtcctggcctgatctgccctgtccgtgacgcttctgctcagtagctgagcacgccctgtggtgtggacaggccagcccggctgcaggacagtgggggctcagtccagaagcctctggtggcttctgcgtgtgggcaggggagcagggctgcagggtgggctggcacctggcagcgtgaggggcctcagggctgttaaaatcccaacgaccggccgggcgcggtggctcacgcctgtggtcccagcactttgggaggccgagacgggcggatcacctgagatcagttcaagaccagcctgaccaacatggtgaggccctgtctctactgaaaatacaaaaattagccaggtgtggtgacgcctgtaatcccagctactcaggtgactgaggcgggagagtcgcttgaacccgggaggcagatgttgcagtgagccgagatcatgccactgcactccagcctgggcgacagagcgagacaccgtctc

SEQ ID NO: 1893 - DNA, 2255 bp, Homo sapiens
tggaataggccctggagcctgctggaggctcgttggatctgacgtgaaatggaagaatattgagaagcctttccctgcctgatgccagttagggtccttagagcggaagggcgctgcactgtggccacatctcatcctggctgctgcgtggcgccaggaggctgtgcacactgtgtgaactccacaccagcacagtagggcccttctaagttccaccgaagttggctctaagcaatacatggtgtgagctcaacaaaacgggaaatgttgataaatgaagctgcattttcatgcactacccttgttatgcaaccagtagtgataaggtggttttgcttttggtgtaagtctcatgtttgaaacttgatttttagtctgaccaatgatgtatttggatgtaggagaaactgattcaagacaattgactaatggtggaggttcacctttgagcaccttattgatcactttaaagattaaacaccaaagttttaatatatttctactaaggtttcttttccctttgtatgagatgtaaaatgatacccagattcctgtatccaataacattatgctgctggttcgatcagccttgtagaaaatttaaggaaaacaaattcatcggtttacaaaaatcttttcctgtgtgcctgctcctcggtgtgagaacagccagggcagagctgtggtgccaggttcccagctgtgtccagggtacaccctggctgaccagcttcctatcctattccttgttttgtgtgactttcaatttcctggcatgcttttaaaatgcgctgcacacaagcaaatggctcctcaggcaagcgaggcccagcaggcagcgtggctggactttctgctcctcttaggcttggtcagtgagtcacttgatgggactggtgtcttgggcagcctgctgtcatgttttgtaaacctaaaaatgtttttctgtgtttctccagtttgaagaaggtgaagaaggagaagaggaggaattagaaggtgacgaggagggagaagacgaggatgatgcggaaattaaccccaagaaggaacccagccagccggcggaatgcaatcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctgtacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttcatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgttcggcctaaccttagaacacatttgtaactgaatacagtgttttcaatttgtacagaatagttagaatattctattaaagtggtgaaacattg

SEQ ID NO: 1894 - DNA, 2579 bp, Homo sapiens
ttaaagaaaataaaatctgtagagatggggtttcgccacattgcccaggttggtctcaaactcctgggttcaagcagtcctcccgcattggcctccaaaagttctgggattataggtgcgagccactgtgccagactcactttccaaattttcaatgtcttccctgatagccacttactttcctatcctaaattctaacttggcccattcccactactgtgaagaaacatgaacataactcaatccagttttgaccagtctgacttggtgcagcccatgctctctctcatgctaagctttctggggaggcagctagataccaaaccattctatggtcatcctttgcttcatattccctacctggccccctccacctccctagccaaaggaggccaggacagctatgagaagattgcatttagagagaatgaccacacattcctcctctgtcttccctgcagtgtcactgttaaagcaacagtcactgtcataagaataaacgtgtactggggaccagcacagtggctcacactgtaatccccactggagcccaggaattcaagaccagtctgagcaatagagtgagaccttttaaaagtgtgttgggggacgtaaatgaaaaatatattccttcagacttctgaacttttgcatttgccgtgtcctgtgctggaaatgccctttttacctcttgactgggggtgggggaggtcttgttcatttaagttctagttcatttaaataaccagttaaaatcttaccttctgtgtggaaactgcctccagcctcccttcaggaggtcgctgcatccccctcagcatccgtgctgcgaggccttctcagaccatctccactgtggttgtgcctgtgcccctcgttaggccgttctttcactgctataaagaaatatctgagactgggtactttataaagaaaagaggtttagttggctcatgcttctgcaagctttacaggaagcattgcgctggcatctgcttggcttctagggaggcctcaggaagcttacagtcatggtggaaggtgaacagggagcaggcacggcacatggcaacagcaggagcaagtgagagagagtcaggggtggggcgaggtgtcacacactttttttttttttttttttgagacggagtctcgctctctcacccaggctggagtgcagtggcgcgatctcggctcactgcaagccccacctcccaggttcatgccattctcctgcctcagtctcctgagtaagtgggactacaggcacctgccaccatgcccggctaattttttgtattttttagtagagacggggtttcaccgtgttagccaggatggtctcagtctcctgacctcgtggtctgcccacctcggcctcccaaattgctgggattacaggcgtgagccactgcgcccagccaggtgtcacacacttttaaacgaccagatcttgtgtgaactcagagcaagagcccacttatcaccaagaggatggccccagccattcatcagtaatctgcccccatgatctcatcacctcctgccaggccccacctccaacactggggatgacatttcaacatgagatttgtgggggacaaatatccaagcttggagactgggagtgctgcctaaatcacctctggctccccagagcctgccccagttcacccaatatcttaggcctcaatgactgtttatcatgcaggtggaaggggacagagaaagcaatagccattgccagtggggtgggcagtgcagtggggtggagtaagaaagagtaacttaacccctcagtgcctcagttttcttatctgtgaaataggtatgacagtggtaatacctgtgtcctggtagtggttgtgagaattagataagtaataaacacttaaattgatgcctggaattggcacctaatcagtgctcagtgagcgataactcccattatcttagagatatagataaggtacttaaatgagccaactttgattacttaaaataatgaggcatgcagtaagatggttatctttaaaatctaaggcccacgtaaccagtcgtttcaaatatttgttttttcaagctatcctgtgccctcacttcccactttcctttcctccaatggtgaaatgatcaaaagtggtatagagggggctggggcttgagggtaaaggtaaaaatgagatttggaatagtgtaaaaacagcctggtcagcccctaagttgtagagagtgcacaggacacagaacaaggtgctcgaggcacaggttagagggcccctttacaccccagctctacacaaatgtgcactgtgcttagacaagtcatttccttccttttaacttcaatgtactcatctgtgacatggggatgaggaggccacaatggcttctatcatctcataaatcctgaaataaatcttatgattctcattctaaatgtaattctccacatgtagtcattctatgctggagaaataatgaaggttttatttatttttaccaccagccttggaggtgaacaagctagtaacaaacaaaagccaatgtgtgtatgtgtatgtttgtatacttttttt

SEQ ID NO: 1895 - DNA, 2373 bp, Homo sapiens
acagcgatgctcagctggctgcggccgagtcatcgcctagcgctggcagggccgctgaccgaccgacggaggcgccgattggccgattgtccactgcgcagaaggagcagctgctccgcgccccgccgcgccgcgctgaggccgaggtccgcagggccgcggggaagccgagggctgccggagaaccctgcaggtgtcactcgggacgcggaagtgcgcttgccgaggtttgccttacaatacgcttgagactccccgacaagcgtaatttggtcgagttcgacgggaaagtactctccccaccccagcgccggccgcgtagtccgaggttactgtccccggcgcgtcctctgttgccccagtccagaggctgcccttgaacccgggcgcgcacgagcgcagggcatccgaggcgacagcccctggcacggcccgacctgtacccagcctggcaggaagactgtaatcgtggggtgagttaaaaataaggccctttcgattgggagctgctttttaaaacgccccctccctgtccgtttttaatacgcagcaaaataacaataacaattgtgcaactgtcgcttcccaaaaggaacctcattgttgaacttacgaaaaatcagttggcaatatacagtgtgggaactgtactgtgatcattggctaaccaagatgggtgacagtttatgatttcaaagactcaaaggcggcttgagtcctacaatgtcctactcataaaaatggaaagcatggcagcctcaggttgttacagagtactctactccaaagtaaaagttattctctgagaaagtgcttactgccttttctgttctctagtttgcttgtttaaacatttactccacaaaattgctcaaacttacccatctttgaatatctagcctctgggatgagacagatgatctttctccgttttcactttttatagaatacagctacctacccaggcaatatgaagattttatttgtagaacctgccattttccttagtgcatttgctatgactttgaccggtccactgacaacgcaatatgtttatcggagaatatgggaagaaactggcaactacactttttcatctgatagcaatatttctgagtgtgaaaaaaacaaaagcagcccaatttttgcattccaggaggaagttcagaaaaaagtgtcacgttttaatctgcagatggacataagtggattaattcctggtctagtgtctacattcatacttttgtctattagtgatcactacggacgaaaattccctatgattttgtcttccgttggtgctcttgcaaccagcgtttggctctgtttgctttgctattttgcctttccattccagcttttgattgcatctaccttcattggtgcattttgtggcaattataccacattttggggagcttgctttgcctatatagttgatcagtgtaaagaacacaaacaaaaaacaattcgaatagctatcattgactttctacttggacttgttactggactaacaggactgtcatctggctattttattagagagctaggttttgagtggtcgtttctaattattgctgtgtctcttgctgttaatttgatctatattttactttttctcggagatccagtgaaagagtgttcatctcagaatgttactatgtcatgtagtgaaggcttcaaaaacctattttaccgaacttacatgctttttaagaatgcttctggtaagagacgatttttgctctgtttgttactttttacagtaatcacttatttttttgtggtaattggcattgccccaatttttatcctttatgaattggattcaccactctgctggaatgaagtttttataggttatggatcagctttgggtagtgcctcttttttgactagtttcctaggaatatggtttttttcttattgtatggaagatattcatatggccttcattgggatttttaccacgatgacaggaatggctatgaccgcgtttgccagtacaacactgatgatgtttttagccagggtgccgttccttttcactattgtgccattctctgttctacggtccatgttgtcaaaagtggttcgttcgactgaacaaggtaccctgtttgcttgtattgctttcttagaaacacttggaggagtcactgcagtttctacttttaatggaatttactcagccactgttgcttggtaccctggcttcactttcctgctgtctgctggtctgttactacttccagccatcagtctatgtgttgtcaagtgtaccagctggaatgagggaagctatgaacttcttatacaagaagaatccagtgaagatgcttcagacaggtgactgtgatttaaacaaac

SEQ ID NO: 1896 - DNA, 2108 bp, Homo sapiens
atgaggggcccgtccctggccccgttccaaaccgaggcatttctggctcaggccattccctcacgtctgtacaatgtctgtcccccaccacagccagtagtgctacagtagatttttgctgcacaaaaactgtgagccttctgcctggggaactcccacaaaaagttccaacaggggtctgtggacccttgctagcggggacgataagattacttttaggaaggtctagtttaaatttaaaaggggtacaaatacaaacaggagtcattgattcagattacaatggggaaattcaaattgttatatctacttctgttccctgtaaagcagagccaggagagcgtatagcacagctcctgattgtgccgtatatggaaacggggaaaagtgaaattaaactaacaggaggatttggaagcacaactaaacaaggcaaagcagcttactgggtgaatcaaattactgataaacatcctacctgtgaaataactattcagggaaagaaatttaaaggttttgtagatacaggagcagacatttcaattatttctctacagcactggccatccacttggccagttcaacccactcaatttaacatagttggagttggtaaagcccctgaagtatatccaagtagttatattttgccttgtgaagggcctgatgaacaacctgggactattcaaccaattataacttctatacctataaatttatagggaagtgatttattgcaatgctcagttatgatttcatacagtcgaacaactgatgacaaaaacaaaaaagagggagaaacagggattacaggacagcccatatgtaattgaatctaacattattatctttaaactttttttttttttttttttttttttactcatccatgtttctgtttatatacaggataacaaattcaggaacaatgggaaagtaatatatgaaaccttaataggaaatacaatagagattacaaaacactaccatttgattttttatgcaaatacttcaatcttccaatatttttactcacttgctaaataaagcacatgactcgaaatcctaaataattctgttagtctaaatcttttaaagaataaaatgttggtgaaaaaccaaaattgtttagtaaggtatgtatgaccttgtttattatctatcatagacatgaagatgatcatagttaataccaatttaagctttacagaatactgttttaggcccaatattgatatgttaaatgaaggtatcagagaatcttgtatttatggcatcaggttataaagatctattcaaaaccatttttgtcaaagtttaaacactggagcaaaagtcaaattgtttctaaatgagacacaaaatgattcttgctaataatacaaattttgtcccatgggtaatactattgtctttttcttttttaaaaaaatttttgatttttattttagattcagggaacacatgggcaggtctgttagctgggtatactgtgtgatgttgaggtttggggtatggatgatcctgtcacccaggtagtgagcagagtccccagtaggtagtttttcagctcttgctcccgctccccaacctacctccccagtgtctattattcccatgggtcctcaggtattactattttcaaatttttttctttacatgaaactactgaaagcaaaagtatgtcatgcttataggtcactctgtacatttatcattctattaataaacatcttaaataattatgtagtatattaaggccataaaccaaatcattatctcctatcaaaggactactgttattcaatcatctagaaaattcattttaggcaggactcagtggctcacgtctgtagtctcagcactttgggaggctgaggtgggtggatcatgatgtcaggagttcgagaccatcctgaccagcatggtgaaaccccgcctctactaaaaatacaaaaattagctgggcgtggtggtgtgtgcctgtaatcccagctactcaggaggctgaggcaggagaatcgcttgaacccgggaggcagaggttgcagtgagctgaaattgcgccattgcactccagcctgggcgacggagagagactctgtctt

SEQ ID NO: 1897 - DNA, 2242 bp, Homo sapiens
agtgtggaaacgcccactgaggggcacacagtgaggcggccactggctctgtgtccttggggaagccccttctgcggtcccctccattgtctgcgtgacaaagtggacgtaggactcccccatttcctgcccagggcgggtgaggaccctgcacacacacggtgtgtttgtgagctgtgcagagtggggtctccctggcaatggccacagcctccaggggcgctgacacctcccgtctaactggtagacagtttctgcctcttcttgtttggggattggagagggaagtgcgtctggatgactactaagatgaggaggctgaggcctagtgctcctagcgggcttggtcaagagcaggaggcggaggtggtggaaggctgtttccctgcggtgacagaaactccatttgcaccagcttacattaaaaaaagaggagggagaatatggtcgagtgaccccaggagtgatggggagcactgacggagtttctccctgctctggagagcagatccgctggctcccagcttatgatccatgaagagaacgtcttccccttgggcctcaatttgaagaatcctgaagacgaccctgatggcctttcgcggtccacgtgccccttcttgcactaccgtgatggtcctatccacggacgccttctcttgggttctgtggttggatgcggaggaatcatcgatcctctgtagtggaagggaagggaggacacaccaagaccatgtggccccaagagccgtgagaggagcagaagcctgactggtgcctcttacatgtcactgcagcctcggggggggccaccaggaaaacacctgacatcctgttctctagtaatggtgtggctggaatcattcctgtaccaaataattcacccatttaaagtgtgcaatccaacaatgattggtatactcagagttctgcaactctcaccacaatcaattttggaacatttctatcatccctagcaataaatactatatcttttttttgtgtgtgtgagacagagtctcgctttgtcacccaggctggagtgcaatggcgtgatctctgctccctgcaacctccacctcccgggttcaggcaattctcctgcctcagcctcccaagtagctagctgggactacaggcacgcaccaccacacctggctaatttttgtatttttagtagagacagggtttcatcatgttggccaggatggttttgatctcctgacttcatgatccactcgcctcagcctcccaaagtgctgggactacaggcgtgagccaccacgcccggccagcaaataccgtatctgactagcactttccatttccctccaaccccctaatggtttcttttcccacgataatctaaatgtttaaggaactggtttgctaactcatttcttaatgacaagaattaagccagcacagcctctggtttctgacattctttccctacaaagtcattcatcatttatccttttttaagggacttccttcatctctgtgccttaggctcacttcctgactgtggggatcagctcctctcaccaatggtgagtagggagtacctgccgttaaacctatgtcaccacaggagagagatgccatggatggatgattttctctctgattcttggcattagttcattgggcaaaaattcagcttccagttaagcaccggcccatggaccgggcttggtcctgtttcccctggaagcactgctgggaaaccaagcccagccctgcagggcttcctcctgctgccgcccacgccaggatcagcctcctcttgccgctgcagccccgtcgctgcaccggtttcatcggtctgaagtccagctgctcctccttggcctctgcacctcagcacaggctactgcctctgaggggccgcccagccgtcgtcctcctcacaacctcccatgatcgtggccctgaggtcacttttccattggcgatgaacaatcccattgtcactccccatgggtgtgcccaccggaagctgctcatgggcaggaggggaactgttcaagctggtttttccagcccctaccacagcgctgggtgtgtaggtggacaagaaagtcattacgtatgtaaatgaggaagcgcatgaacacctgagcgtgtgagaattcggtggggtgaatgccactccaaatgtgtgtcaaatatgatgggactgaatgcaaatgaaagtgggtcaaggagatattcagaataaaatgagcaacttttcctc

SEQ ID NO: 1898 - DNA, 2264 bp, Homo sapiens
agtgcgggaggtggggcatccgggtctcttggtggctgcttctacccccggagctcagctgatcttcccttccagactaggaggtgaggtcgccgaagcatgcatgttgacacgcacggactcctgtccgacgtacattttcagacgggtggggaggacatttgagttcgtaatgaacattttcccttttctggctccgtgcttagttccgagctgccgcctcgtgctattgacagcctgcggaaccccacggaggcttgcggcggcctcttggtgtttccccgggtccgccgcttgcggttcttggagtagccaggtgaagccagaccccgagcgcgcgaggcttctcgggtgcattccggaccgcctggtgttgtcactgacgcttcggccgccgggcctggccgccccacccatccgcgtaggaagagtcttggagacctgcagttcgggatgtctgtgctgggtgttttgacctcagtccctctggccaggtgcagcgcgggagggtaaaggtgctatgtaccgaaccctggacgagaaaaagaggaggatggttgtcaagcccggctggggtgtttgatcttagtgcttcagttttctcatttatagaacgggtaaatgacatatgtgttgctggacgtatttcttctggaataatgccttttttggcaataatttcttttaattttcttttcactccatgagtcactcttccttaccaagtagttttcttctgtttttgtttgtatttttgtcatttaaaagtatgttctcaggttttgcctcaaagaagttgagtttttccccaaatgaaatgagtagtcctacttttcttagtgaatatattccattaagcttgacttttaacattaaaaaatacttacaagtattttttactctgttaaatttaaggtgtgaatttcaaacttccgtaatggagttagcccacagtttattgctaaatgaagaagctttggctcaaatcaccgaagcaaaaagaccagttttcatctttgaatggttgcgatttcttgataaagtcttggttgctgccaacaaggtatggtattgctcttttttcccagttgcattaacgtgaagagattatgtggtcatgattcttaagaaaacacatgttatgttttggaaggtttatgggtcacttatggaacttgagagtattacacgaatgggaaatttagtggcaaaactcaaacctcgtttaaatccagctcattgcctatcttctttatgtttgtacctgggcagctcattgtaactggagaaaaacatggctatatgactggtgtcactttaaatttatcatcgtcacccgttgcaagtgatctctctatgctgcctaacaatcccagtgtcttcacttatctctttgaggagtcaataataggctctttttttttttaatctgttttttcttcctgcatagccttgatttgccgagaccagctcgtttggggagaccctaacctagcggcgctagaggaattaaagacacacacagaaatatagaggtgtaaagtgggaaatcaggggtctcacaggcttcagagctgagaccccggaacagagatttactcaagtgtctattaacagcaagccagccattaacattgtttctacagatattcgattagctaaaagtatcccttatgggaaacgaaggggtatgctgaaacaaaggggtgggtctggctagttctgtgcagcaggaacatgcccttaaggcgcagatcgctcatggtattgtttgtggtttaagagcgcctttaagcggttttcaggccaggtgttccttgccctcattcgggtttcgttatggccatcatgaacatgtcacagtgctgcagagattttatttatggccagttttggagccagttcccaacattgattcaacttactttttattgtctgtgtattttatattctgtctttaaaagtagatatggcccggcatggtggttcacgcctgtaatcccagcacgttgggaagctgaggtgggtggatcacctgaggtcaggagttccagactagcctggccaacatggtgaaaccccgtttctactaaacactgctaaaagtacgaaaattagccaggcgtggtcgtgggcgcctgtaatcccagctactggggaggctgaggcaggagaatcgcttgagccggaaaggcagaggttgcaaggagccgagatcgcactaatgcactccagcccgggggacaagagtgaaactccatctg

SEQ ID NO: 1899 - DNA, 2363 bp, Homo sapiens
ttttacagtatctgccagctgtgagtaacagcaggctgtcatgatgggatatagcagaagcagcagcagcaactcctgatttaggggcaatcgatgaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagaccacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagctcaccaagaacgcatcccccgctggagacgaggactcctcagacagccctgactctgaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattggggaaattagggccctaacagctagaatcaaagatgataccgcagggccctgtagcaagaaatgggaagcagggggaggggcaggggctcagaacaatattctagaccaactttgactacttcctgtcttagtaatagaccaatacatggctctatttagcaaagtttttatactgaaacttgattattgctgccctttataatttcctcttcaatgatatttcagcagtttccctcttggtcctagttttgtgcacatttttttgaatgtggttcagattaattatatttctctcactttcttagctggtcctattttttcacattctggcatgtggctatcaagttagattgctgtaggcatcatattgtcatggtaactactgaacctaatgatgcagatggatggcacatcagtataataaatgatggaaaacggttcctaaaaattcatccctttcataagaggggaagaatgagtgcctgatattgttaatacctccctttctacctcaggcctttgcaaattgatgttcagagggtcactggagtgagagggaggaggggggcgtcttggaaatttccatttctcttttcaaacccaaaataggaatgactcttgctgtttgtcagatttgctgaaaattgctcctcacaaagaacatttttttttgtacatgtaattgtaaatacaggtttagtacgttaatgttctatagttctgatattgataataattaaacccagataattttatagc

SEQ ID NO: 1900 - DNA, 1977 bp, Homo sapiens
agattggcgcaggacagagtgtcgtcgcgtcttgctgctgtcaggtggtcccttttatggtgggttcctgtggtcgctgcgcagcggctggccgacttccgcagcgggtctcgggccaccgagcgccgtcttcacccagcgccatggctgtggccgctgtcggccgcccgagagctgtgcgctgcccgctgttgctcctgctgtcactcctgctggtagccggccctgcgctgggctggaacgaccctgacagaatactcttgcgggatgtgaaagctcttaccctctactccgaccgctacaccacctcccggaggctggaccctatcccacagttgaagtgtgttggaggcaccgccggttgtgaggcctatacccccagggtgatacagtgccagaacaaaggctgggatggctacgatgtacagtgggaatgtaagaccgacttggatattgcatacaaatttggcaaaactgtggtgagctgtgaaggctacgagtcctctgaagaccagtatgtcctcaggggttcctgcggcttggagtacaacttagattacacagagctgggcctgaagaaactgaaggagtctggaaagcaccagggcttctctgattattatcacaagctgtactcctcagattcctgtggctttattaccattgcagtactgtttgttctcgcctttgcggtttacaagctgttcctcagcgatggccaggggtcgcctccgccgtattctgagcacccgccatactcagagcactctcagaggtttgccagtgccgcaggggcgcctcctccgggctttaagtcggagttcacaggaccacagaatactggctatggtgcaagctctggcttcgggagtgcttttggaggccaaggctatggcagttcagggccggggttctggtctggcctgggagctggaggactgcttgggtatttgtttggcagcaacagagcggcgacgcctttctcagactcgtggtaccatccagcctaccctccttcccactctggggcctggaacagtcgggcctactcacccctgggtggaggcgcagggagctattgtgcatcctctaatgcagactcgagaaccagaacagcatcaggatatggtggcaccagaagacggtaaaataggaaattgaaggcaaacactggatgcaaagtttctgatttgtcatcaccatctctttaacacctggctaatgggaataaccaaaagttgtgtggtgtttggtccttgtgtagcttttcgtgtcccgttgtttgtggccaagagttgatatgtgacaaaatgctatggtttgtatgataatgtaacatgcagttcaaagcgatggccactgtggaatgctgacattgttgtgcttgtgtctcaagcctttcataccagagggggcattaggaatggagcaccctcctgctgagactgagcacagaccgcttgagctaggtggctttggaccatgagtcattccctcgtagaaacaacgatcctctattggatattaaaacacttggtgtttgctgttcttcaaacatttaagcccagtgccgactactaattatgctgatttgtgggttgcaatcgcttgatcagtagagcttggacccttctgtggtggtcagcgcctggggattctgacctttcacaggaagggtagaaagcaaacgacatgcacagaaggcttggaaccgggggattctgacctttcacaggaagggtagaaagcaaacgacatgcacagaaggcttggaaccgggggattctgacctttcacaggaagggtagaaagcaaacgacatgcacagaaggcttggaaccgctagacatcagttttcaggcggtagcattcagacgcaaaagcatggagttctctgtggagtcttaaactgtcagatgttgttgtgacattttgttttagccttacattaatatgacaataaattaaaaagacagg

SEQ ID NO: 1901 - DNA, 1708 bp, Homo sapiens
atactttctgagagtcctggacctcctgtgcaagaacatgaagcatctgtggttcttcctcctcctggtggcaactcccagatgggtcctgtcccaggtgcagctgcgacagtcgggcccacggctggtgaagccttcacagaccctcttcctcacctgcactgtctctggggcctccgtcaccaatggtcctttttttttgggcctggatccggcagcccgccggaaagactctggagtggattgggaacatttataccagtgcaaccccctcctacagcccgtccttcatgggacgagtcaccttatccatggacgcacccaagcggacactgttcctgagactggactctgtgtccgccgcagacacggccatctacttttgtgcgaggagtcaaggggacacttccattgacgcggtccagggattcgacatctggggccaggggacagcggtcgtcgtgtctgcagcacccaccaaggctccggatgtgttccccatcatatcagggtgcagacacccaaaggataacagccctgtggtcctggcatgcttgataactgggtaccacccaacgtccgtgactgtcacctggtacatggggacacagagccagccccagagaaccttccctgagatacaaagacgggacagctactacatgacaagcagccagctctccacccccctccagcagtggcgccaaggcgagtacaaatgcgtggtccagcacaccgccagcaagagtaagaaggagatcttccgctggccagagtctccaaaggcacaggcctcctcagtgcccactgcacaaccccaagcagagggcagcctcgccaaggcaaccacagccccagccaccacccgtaacacaggaagaggaggagaagagaagaagaaggagaaggagaaagaggaacaagaagagagagagacaaagacaccagagtgtccgagccacacccagcctcttggcgtctacctgctaacccctgcagtgcaggacctgtggctccgggacaaagccaccttcacctgcttcgtggtgggcagtgacctgaaggatgctcacctgacctgggaggtggccgggaaggtccccacagggggcgtggaggaagggctgctggagcggcacagcaacggctcccagagccagcacagccgtctgaccctgcccaggtccttgtggaacgcggggacctccgtcacctgcacactgaaccatcccagcctcccaccccagaggttgatggcgctgagagaacccgctgcgcaggcacccgtcaagctttccctgaacctgctggcctcgtctgaccctcccgaggcggcctcgtggctcctgtgtgaggtgtctggcttctcgccccccaacatcctcctgatgtggctggaggaccagcgtgaggtgaacacttctgggtttgcccccgcacgcccccctccacagcccgggagcaccacgttctgggcctggagtgtgctgcgtgtcccagccccgcccagccctcagccagccacctacacgtgtgtggtcagccacgaggactcccggactctgctcaacgccagccggagcctagaagtcagctatgtaacagaccatggccccatgaaatgatcccggaccagatccgtccacacccgccactcagcagctctggccgagctcacagtacaaccacaataaactcttgttgaatg

SEQ ID NO: 1902 - DNA, 2387 bp, Homo sapiens
gtttaccgtggccaaaaagaacaccctccagttcactgggctggagtttttcactggggtgggttattttagggacacagtgatgtactatggcttttacaccaattccaccatccagcacgggaacagcggggcatcctacaacatgcagctggcctacatcttcacaatcggagcatgcttgaccacctgcttcttcagtttgctgttcagcatggccaagtatttccggaacaacttcattaatccccacatttactccggagggatcaccaagctgatcttttgctgggacttcactgtcactcatgaaaaagctgtgaagctaaaacagaagaatcttagcactgagataagggagaacctgtcagagctccgtcaggagaattccaagttgacgttcaatcagctgctgacccgcttctctgcctacatggtagcctgggttgtctctacaggagtggccatagcctgctgtgcagccgtttattacctggctgagtacaacttagagttcctgaagacacacagtaaccctggggcggtgctgttactgcctttcgttgtgtcctgcattaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcgcagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgataggaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaagtgtgtgcaggaatgattggttcttagaaatctctcctgccagacttcccagacctggcaaaggtttagaaactgttgctaagaaaagtggtccatcctgaataaacatgtaatactccagcagggatatgaagcctctgaattgtagaacctgcatttatttgtgactttgaactaaagacatcccccatgtcccaaaggtggaatacaaccagaggtctcatctctgaactttcttgcgtactgattacatgagtctttggagtcggggatggaggaggttctgcccctgtgaggtgttatacatgaccatcaaagtcctacgtcaagctagctttgcagtggcagtaccgtagccaatgagatttatccgagacgcgattattgctaattggaaattttcccaataccccaccgtgatgacttgaaatataatcagcgctggcaatttttgacagtctctacggagactgaataag

SEQ ID NO: 1903 - DNA, 2939 bp, Homo sapiens
acttcctgggagctgcgggcgatcggctcacagaccttctggccggaaacccgcgcgctcccgctaccagggccgtcgtcgtcagcgccgccatggccaagtggggccagggggacccgcgctggatcgtggaggagcgggaggacgggaccaacgtgaacaactggcactggacagagcgggatgccaccatttggtccaaggggaagctccgagggctcctggttggcattgctatggagaatgaggctggccgatgtgagatcagtgagttgaaacaggtggaaggtgaggcttcatgtaacagccgcaaagggaagcttattttcttctatgagtggaacatcaagctggcctggaaaggtacagttaaagaatctggtgcaaaacacaagggacttattgaaatacccagcctttctgaagaaaacgaaatcaatgacactgaggtgaacgtgagtaaaaagaaaggagatggggaaatactgaaggatctcatgagaacgacaggcaccgccaaggtcagggaggcccttggagagtacctgaaggcactcaagacggaatttacaacaggaatgatcttaccaacaaaagctgtagcaacccaggaactgactcttcagaggaaactgaatgaaaacaagctgcaggcttctccagtggcactgggtgtgaggattcccacagtagctttgcacttgacagagctgtttgacacgacagtagaacagctgtacagtatcttcactgtaaaagaattggtgcaaaaattctccaaatctcctgctgtattagaagctgaaaggggagggaaattccagatgtttgacgggaacatcagtggagaatatgtggaactggtaacaaataggaaaatcatcatgaaatggagatgtaggaactggccagaagaacactatgcaacagttgaactgaattttgtgcctgctccagggcaaacggaattacaattggactgcaagggagttcctgtctgtaaagaggaaaatatgaaattctgttggcagaagcagcacttcgaagaaataaaaggtttacttgagcttaccgcccagaatgcttgaattagttaggtttttataaggacatcctttttaaaatagaaacctgtcctgtttactcacctctttttttcttccttaaaaagtcctttccctcaaggcccttaatttattttgtattggatgaaattcatgaaacaacacaatttaaaagcattgtttgaaatattctagatgctgcattgagtgaaatcgggtgtcatatctcaccttccatgggtgttcctctgagataagtaggtaggctgagctaaggctggtcataggctgctacttgattgctacaattgatttaagcttaagacaaataaatggcatgctatactattcctttattctaagccagtttccaaggtgtttccagagtgttgctgtgagggctaggtggctgcattctgttacacttctctggctctccttgatgtcttccaaatagccacacacttcgggattggagggatgagacatctgtatggtaaattaactgttttggatgcaagaggacttctcaaatagcagaaaggccacgtggttccctttcagtctccttactgctgtcatttgaagaaacaaacgacttatgtaacaaaggaaaagtgatcacagtcagtttataagtacacagaacagcagtcatgtcaataaaaataaaaccattatttttacatcaagtgtgctttatttcctccacaggtattctgttaaataaagcaccatttatatactgccaggccacagctaaagaggattctttacagaatcaaatttcttgtggttgttccgtatacaagtaaacttaattttgataataagaaccacagcgatcagaggcaatctgcctctcttattttaaggtacaaaactggcacagaggacaccatattatacacagtaaaaatgctgtaagtttaaattacatcatacagggtcagagccctgcttctcccagaaagccatattaaatgaaagccactacagtgaactcttaattacataaaacatatccattatctgattgccctttagaaagtatacagaagatgcacattttttttttcatctggaattctgcctgaccaagaattgaagcctataaatctatcttgccattcaagcagagagcactggacaaactgaagcacaaaacaaaggagcaaacttgacaaacagcataggggagggcacgtgagaatagacatgccacgtctaatgtcaagaagcagcttggtttcctttgccagatatccttgtgaccacatggattgttgattcaatggtcctacacagggtatctaaaatgtcgtgttgctgcatatgactaatgaggcctctggaatggccacaactgagggacacagcagcttcagggtcctgggaggacaaagcttgaccatcacagcttctcagatcagctaagtcagacagaactgcggagatggacgttgaagggaattcggattcatcttcagctagtgtagtatccttggaacagtggtctttaaactctttacagtcgtcaaacctgccattgttagactgttcctctgcatgctgtgaccggatatgtgaaccatcttctgaaaatgaagatgggccttccattcgatactctttgacagagctgttttcaggaggcggaagatcttgctctgtccctgggtcaataatcgatgagtctcttgtctcattgtctgaggtgctagtgggggtcaggacctccctggtctctgtttttatgtcaccaatgcaactgtctacagtgtgctcctcatcactgctcactcgccgtcttttaacaggagttgctccttcgtcatctgtggggggaaaatacaataaaataacctgaaacag

SEQ ID NO: 1904 - DNA, 2274 bp, Homo sapiens
gttggttatttgcctttacttttatttatttgttttgatatgtagatacatttacattttttatgtaatatatctttttaaaaatggtttctgcttttcctgaacatgttttcagaatttaaaattgtatatggaaaacaaattacatgaaagatttgagcatttcaaaattttaaacataaaagcataaacgtagataaaatgaaggtgtactatgatatcttcagttttatcagaaatgatgtaaaaattacaacctctttaaaaagtagtgttaatcattaagttagaaaatatatagctgggcatggtggcagatgcctgtaatcccagctacatgggaaggtgaggtgggagaatcgcttgaacccaggcagtggaggatgcagtgagccaagatcatgccactgcaccccagcctgggtgacagaacaagactccatctcaagaaaaaaaaaaaaaaagaaaaatatatatatgaacttcagaatctgaggtcatatatagacaggtctttcccccgtttcctctactttttcttgtagcttggaattagtcagtttcatcatgctataataagcttatctgaaaggcagtaaagtgatattttgtacaacttcattggctttttgagaagaacatttttaggttcttagtcctagaattctgctgtttgcttggaaaaagaaagtaatacattttcttctatgaaggatttcctcagcacaccattgcttctttatctgaccaggatgcaaaaccctctttcagcatggcgtaagtaaagaccttgaaaatatcagtaataatgtttttacatttttaattccttcttttaagttataaattcaaaagataggcaatgaagactatctctatatacttgtatggagtgatcttcaggataaattactaagtaaaacagtagtttgagagaattttgtagtatgctgctaatcacctaagaagaaagtagagatgtaagtggatgtatatacttgtttatgttaataataaaaacaatagtatggaaataataaaaacttaaaaggggtggagggggaaattttttttttttaatgtttacctcagtgagtgtgtagggaaaagcaaagggttagaccctagacttttctgaatgcatcacttaatgatagggacacattctgagaaatgcgtcattaggtgataccatcattgtgcaaacatcacagagtgcacttacacaaacctagatagtgtagcctactaacatcgcagttatatagtatagcctattgctcctaggccgcacacctgtacagcatattgtgtactgaataatgtaggcagttgtaatgtaacacctagtgtttgtttaactaaacacagaaaaggtacaactaaaatgtattattttatgggaccactgtcatatatgtggttcatcactgaccaaaatgttatatagaatattactgtaccttgttttaacttcagagctttgtattttacataattataaaacaaaattaaatttaagagagtaattcttaaaaatcacaaacaagatttctgcctccagccaaaaagctgtaacagggactagatttaccctcctgtcaaaaaaagcagacaaaatatataaaacagtggttttcagacgttggacagcaagccttgctgataatgatccctgaaagaaaggaaacaaatgagatgggccctaagagcactccaccttactgcctggatggaatttccaggctgcacacagaggctggagatgttgttgagttgaagaaacaaagttcatctttcaaggaggctgagatggcgataattttgcaggtcagagtactggagaggaaagatctgcacagagagaactctctggggagctgcatagacttgctcatgagtcagcagctgagcgttgatcagcccttttgtgtgaggagactactggaagtcagggaaaaaatcactggaaagcagcagacagaacagtttccagagctcacacagagaacattcatgttctcaccagtctgtatggaaatacctcttaacatgacaggcattgaatagagtccacagtaatgggatcaaattaattctatcacaagaactggaaccagaggcaaaaagaaaagaaaagaaaagaaaaatctagactaacagctgttctagaccagcctaccaaagtttaaaagcaaattttgaagagattaaactatttccaagttaatgaagtatatttcagaacaaacccttaaatatttgagggaatac

SEQ ID NO: 1905 - DNA, 3076 bp, Homo sapiens
aaaacctcagcaatggggaacttcggagggccctcaggcatccactctacccgggggccgccagccgcacgcagcctcggattcgccctgcacatctgccgcccagcaggtttgaagtgggtggcgttggatggagtgactgagaaaagctgcgacatcacagagagacaaaatagagaaagttttcccctggccacccctccttggcctccaggtcttaagtcagcctacagctccccacaactgcctcgcccgagagctgcagagatccctctcataccggagcccagccaagccagtgcgtcaggaccgacacagcctctgggttccgggatctgaaaggctgcgatggattctacttggaaggggttgcatcagaaaggccttcagtggtcagcgcagctccctccggcttggagaagccaggctgctatgtagccagagaacagtcttttccccagcgctgccctgcagctgcccggctccaggaagtagctccagcacactgctaagggaagagcactggaactgaactcagaaaaacgagttcaagccagcactccaatcggtcccttcagcctgagtgcctttatgcctaaagtttttgttgttgtttcgttttttgtttttttttttttccgttgctgttgaaacggcatctcgttctgtggcccaggctgtagtacagtggcgcgatcagggctcactgcaacctctaactcctgggatcaagggatcatcccgtccaggcctctcaaagtgctcgaattacatgcggatgccattgcatgcgtggcctacgcctacggttcttgacccttctgaacttcaaatttacccttgttaaattgagggataataatagtgatacctacctctaggatagctgtgagggttaggtgaggaaaacaaacagctctatccagctgattgaacagaactttccaaagggcagctaagtcaggtccagatgatccagtcaatatttgttgatgccttttacatgacaggcagaaaaagcatttgtgatgcacacaaatttgtttaagaaagctcgaaaatctgtccaactggggacttagaatagggtacatcagctgggccaagggccttgatttattacaattgctacccttaaatcttatctggtggtggaattcaccatgtataatgacttatataccctttattcagaattggagaatattccaagcagtgcgacactctgatccttatgcaccagtgtcctacataggaggactgtgctcctcgaaaactgagggtcattgtcccctttcatccatcctccaaacagcatttctgagtcctcaactctcaagcctaagaatatatgttgtgagtctagagagagcctgaagccagaggattagtggaatcaatttcccttcttcctataactccaaaagagagcttcctccataaatcttcatgccttttcaatctacttagctctctcaagcagtgaggttggtaattttaagattctttatttgggaagaagaggtgattaattcatactttctacacccacagctgtttcaaatatggacctcaggaaagtgatggtccaggatgattcatacaacttattattcctaaaattatgagcctgggatcgtatactgtgagataagaacaaacttttaaagttaatggatgcttctgagttccctacttagaattgagaattgacactggggacctaatagcagaaacaccctccactgagttagccaagtcagaacctcagtgtcatcgtggacttttttctctcattcacctgacccacacatagcataaaccaccaagtgatctctatgccacccaagtaataacggtcttgaatctgattacttctgtccactatttgtctccattatcttcgtgtagagtgtaaaccacagtcaccctagattattgcaatagtggtctaactcaaggtctcttgctttcagccttgcctcttattcctttctctccaatcagtgtctccatttttccacaagcctttatgaaaagctaaatcaagtcatgcttctccgtgaaaactcattaatgatttcctgattgtcctccaggtaatactgaaactccttaatgtggcacacaaggctttcctgatctggccgccttgtttacctctccgatctcatttcttgccactcctctcttttgtagatactccctcccctccctaacctgtccctttggtccctgccactcttcccttacatacaaatggatactgctcaaactgtagcactttcagttctcggaggtggaggttttgtattctctttttcgtcgagactgctgcacctgcctctgtttagaacatttcttgcactacatccacctatcctcctcaactcttaaagatacattgtttcattttagacagcttcttccaggaaacctcccctgatgattccaggacacttatttttacccccaagagagctgttatgatctcctcagaattccccatttacttgtttgttttcaccaaagcttgtaggcagtgcctagtacaattcctgttatacagttgacactcaatacataactgtcaaatgaattaatgcctgaatgagtgaattctataaccccataaggggcccatcagtgcaagataaagaacatagatacaacttgttttgaaaatgattcagataaagctgcctccacaatgtatttgtatctgatgattgggtgtgtgcctaaaaaatccaacatgtgttcagtgacagcttttactgcagaagtgcaggcactgagaggctgtgcagtagccttgctgtcgccatagcaacctagcagagggaaaggctgatgatttagtgttcagatgcctcttagctctgtacttttggaacccaagcctgtttttccactgttctaaaaggcaagttttaccgatgataatatctatgccgccttaatttcattcaagtgtttctcatgtcattagaagaaatgtcttgtaacatttggattataccatcaaagagatataatctaatacagcataatatggtcttctttcccctgcttt

SEQ ID NO: 1906 - DNA, 2006 bp, Homo sapiens
actcactctgccgggagagtccagcataggttgcgttcaaacaccggcagctcatcacgccggtgacagccagtggccaggcggtacaggtaggtccgggacgtggctgcgtgacgagcgtggaagtcgctgggcactcggaaggcccgcaggaccctatggcggcagggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagaggatgtgcggaagttcaaggagacaaagaagcagtttgacaaggtgcgggaggacctggagctgtccctggtgaggaacgcccaggccccgaggcaccggccccacgaggtggaggaagccaccggggccctcaccctcaccaggaagtgcttccgccacctggcactggactatgtgctccagatcaatgttctgcaggccaagaagaagtttgagatcctggactctatgctgtccttcatgcacgcccagtccagcttcttccagcagggctacagcctcctgcaccagctggacccctacatgaagaagctggcagccgagctggaccagctggtgatcgactctgcggtggaaaagcgtgagatggagcgaaagcacgccgccatccagcagcgggtgaggccgcgcagccggctccctgcacaccaggcgcctgggaggcccctgcgtcctcaccccatgcccggcacaccctccccgccccttcctcctgcctgtctcccacctgccctgcccacaccctctctaggggaccaaggctgctccctttgatgtgtgcagtggaggggcacgtgtgggtggggccgctgctgggatctccttttgaggcggtggtcacctctgtggcctcagtcactggctccttgcggggcctttgcttgcctgtgggacagcagccccggccaccatcccgggcagaggttggctgcaggcaggagtggctattttgggataggggagagccccccaggagttggggacgggtccaccagtcaccaggagttggggacgggtccaccagtcaccaggagttggcagccgtcactcactggctttctccccctaccccctcctgctccggccctccagacgctgctgcaggtaagtgagcacgggccctgggcgggctgtgggtcgggggagaccagatggggcggtgcctttccctcctctaccccaagggcacttcagcaccaaggacacctcccaccagtctcggctcctgctgctgatgcggctgtgaggggctggctccggccagacctccacattccccgtggggttggcggcagctgtcccttcccatcccatgtggcctggggagcaggtggccgcccctcccctctgcttccctggcctgccagatggcgggacacacagggccctcagtgactcccaggcctcctgaatggggctctgtccgcccagctggccacatgaatggggcactcaggatgcggagggtgggggcgcagcttccttcctgatcgcagcctgctggtccctgcagggctggggtggggccggcactctcgggcccccagctgtgaacgtgaggggtctgccccacgggttgcagggctgggggccttgctcaggtcaagaagtggctgtggtgaacagagggtctctcgtctgagcgtgtggtccgtgggccgtgtggcagcctcagacaaggacctcacccccacctgtgctccggaggcaccttctcctggtactcggcccagagcctgcgcataaagccactttgccactttgc

SEQ ID NO: 1907 - DNA, 2233 bp, Homo sapiens
aatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggacacagatctggtgcccagcgacattgcggcgggcctcgccctgcttcatcagcaacaggacaatatcaggaacaaccaagagcctgcccaggtggtctgccatgccccagggagctcccaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggaggggcggccgccctgctggccaccatggtcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacgaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgctcaggtgataggacgactcctgagacccagcgaccgtggagacagcctcgggaagccctggcccgtggatggatcccctggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcacgat

SEQ ID NO: 1908 - DNA, 2613 bp, Homo sapiens
taacacagtccacaaggccagagatagcctgacccttgctgatctgtccagcctctgctatatgtccccttattttctctgttccaaccacattggactttgttcctcttactagtcatgctccccacctatttggttccctagttaacttctcttcatccttcgatttcaacttgtgtcacttcctccagaaagcctaccctttctttcttaaccaggccgataggctgtcaaaaccaggaatctcttcttcgtagcactacagtcatactcattgatacgtgtgattattaatgtgggttttttaaaaaattagaatgaaactcaagagcagggaccacatctattacttgtgattaatatattcctagtggttagcacagtgtctagacaaatatatgttgaatgaataaatagaaaagggagaggaaaaagggaaggattgaccctctgtgaggcagtcttgcaaacagcagaaatgcaaagcaaagctgaagaactaactattcaacacacacctagaggagcgttgtaatgtcttgtgcctgtctcaaatgggtgcattcttatgggtaagttttactagtccagctttcactgtaatagttcacattcctctcctagtgtcagtctccaacaaatccctcagtaattcgtaatcagtaatctcatgccaaggatgagagaggggcattatccaaaaagttgggtgtgtccatttttttttgagtcttgctctgttgcccaggctggagtccagtggcatggtcttggcttactgcaacctccgcctcccaggttcaagtaattctgcctcagcctcctgagtagctgggattacaggcgcctgctacctcgcccggcttttttgttgttgttatttttagtagagacggtgtttcaccatgttggtcaggctggtcatgaacttgtgaccttgtgatccgcccgccttggccttccaaagtgctgggattacaggcgtgagccactgtgcccggctgttcatctgtttttcaatacctttaagttcagtttcccttacaaagcccacttttttcttagtgggaatctcttgtaccacttaacacctacattccttaatttttaaagttaaaacacttatatactataaaatggacacatcttaagcatacagcttgatgaagatttacaaagtaaacatgccagttgaaacaccactctgatcaggatgtggaacataaccagcactccagaaatctctctgccatcattaccaccactggttatcctagccactcttctgacttgtatcaccatagataggttttacttgttttgaagccatctataaatggaatcatggaagtttgggcttccctgagagcagatcttcagagaaaaaaaacttgagtgcagtagtttatttggcgtttggctccaggatgcaggagtgggaaagatggtagagagacagaagaaaaatcaatagaaaggtattacggaggttggatatataatgcttcccagaattgtctgactgaacaggaggctgaaatatttatccgctggctcctgtttccaattgattgagggatgcccccaaggaagttaacttcactgcaattctgagctgtaattgactttaataagctccaacagcactgaaagacgtttggattattttcagtttgggataatactactatgaacattcctgtacatgtcttttgagaacacgcatgtgtacatttgtgatgggtatgtaatggggtggaattactggttcatagaatatgtgcatattcacctttagatatagaggctgccaaccatttttctaaagtgattatactaatttatattctcactatctgtaaatgaacatttcagttgctccacatccttgctggcacttggtattgattgatttctcttttaattttaggctttttaatacgtgtgtagtgatatctcacttgctgtttgtttgctttttggtaaattttttattgaagtataatttacatacagaaaatcacacaaattgtgtacaggtgtgatttttcacaccgtgaatacatgcaaaaactagtatgaaattaagagttggaacatcaccagtactccagaagccccatgcatgttctcttccagttactataccactatcccaaggatggtctattaattcaacagcatagatttattttgcctgtttttcaacttcaaataaatgaaataatatgcactcttgtgtctggcttctttgactcaacagtatgtctatacaactcatctgtattgttgcatgttgtagttcgttcattcatactgttgtatacagtattgaattgtataaattactcattctgttactatgcatttgggctgtttccagttttggctattatgaataaagctgctatgaacattctagaattgtcttgttgaacatatgtatttctgctgggtataaagcttaaaaaggaaattactggaaaataagagtattgcctcatgttacctacctgctattttcactgtaatttcatctattctggttgatgtgtaatagtgtcatattagcattttttctttgcttttataaaataaatgtttttatgttgg

SEQ ID NO: 1909 - DNA, 1862 bp, Homo sapiens
ctgaaatcggaagagcttaatgtggagccgggtttgggccgggctttgcccccagaagtgaaagtagaagggcccaaggaagagttggaagttgcgggggagagagggtttgtgccagaaaccaccaaggccgagccagaagtccctccacaggagggcgtgccagcccggctgcccgcggttgttatggacaccgcagggcaggcgggcggccatgcggcttccagccctgagatctcccagccgcagaagggccggaagccccgggacctagagcttccactcagcccgagcctgctaggtgggccgggacccgaacggaccccatccctgcttcctacgcatacattgaccccggtgctgctgacacccagctcgctgcctcctagcattcacttctggagcaccctgagtcccattgcgccccgtagcccggccaagctctccttccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtctaggaagaatttgtaccatttaatgggttgggagtcttggccaaggaagaatcacacccttggaatagaaatttccacctccccaacctttctctcagacagcttatccttttcaaccaactttttggccagggaggaatgtcccttttgttcttccccctgagaagccattcctttgtctgccaacctccctggggtcctgcctgtttcctcccaatggagggtttttttggggggtggtccccgtctggggggcccctccagccagtactccaggtctccctgtctctcccccgctgccattttgatagtataatctatttttaaatggggcttttcaataggggagagggagtcatctcttcctatatttggtggggtgggtgggaaggaagggatttgggggggaatcttcctgtcgcctcccccactccaagtgtttatttttgataccaaacatgaattttcagttccctccctcccagccccccaatttcctgcgggcgggtacaaaggaccctttcaatgtccctggagttgggagggaggaatgggggacataaagcctgtcctgtctctattctaggcaagagagagtgggttcaaaagactcctgggctcacctgttagcgctggcccagcccaggccttgggacctgggggttggtgatttgggggacagtgctacactcgtctccactgtttgttttacttccccaaaatggacctttttttttctaaagagtcccagagaatggggaattgttcctgtaaatatatatttttcaaagtg

SEQ ID NO: 1910 - DNA, 2578 bp, Homo sapiens
tctgtgacctgctgatgggtcataacctgcagggtttttgttttattttgttttgtttttgttgacagagtctcgcactgtcacccaggctggagtgcagtagcgcgatcttggctcactgcagcctccacctccagggttcaagtaattctcctgcctcagcctcctgagtagctgagattacaggcacccgccaccacgcctggctgattttttttttttgtatttttagtagagacagggtttcaccatgttggtcaggctgatcttaaactcctgacctcgtgatccacctgcttcagcctcccaaagtgctgggattacaggtgtgagccaccatgcctggccataacctgcagttttaaacatatcgggctgaatatagttgagggcgcttaaatgctatgatgctgtgattcagctgggccaggaatatagagaacagtggcaccctactctgtgttgggccagagattgctgaaatgtctagcatattagatcaaccagatttttagttctaaaggtgaaaccagaagcatttttttttcctctcaaaaacacacatagactcagaggtatggatacaatacctgaagggctatagttctttttccaggattgtccctctcagcaggaatggaggatccctagctagagaggagagctgggggtgacaccttcttgcccagtggaggacagctggtggtgtggcctcaacaggttcttaggaaggtgagttccttagcctttctactagtgaggtgtttgggttaaggtgcagcaccattgactgggcccgtgtggggaggatattcaaagcatttcacaattacacagctgcctgggcaccgacagagtcctagagaagtgtcgactgtgccaggtccaacccttcagtcgctggatcatggggaggcatggagtcccattgtagaggctgggtggtggtagtaggcatgcaggaattcagggaagctgctacttaccaccatgtaaaaaggatttcaatattttcaccctggtagggatgcaccagtgtgtgcttctcagcctcagtcctggacgtatgccccattgccctaaggttgtcccaaagaggccaccattagacctcaccttttatggacaggtgggagatgtctgaacgcaaccacatgttgcccagtgacaggggctgggctgaccaggacacggagagtgacttgccttctggggctgagccagtcactcatactcccagcgtagccctggagcttcactgcaactgctatgttacaggaagttgtaccagcagctctacactaaggtgtatagtcagtgaccactttaaagaaagactcattagaaagaggcattgtttggggaggccaacaggctaactgttggggaccatgccagaggtactgtgtcaaggtacctggcttgatgcttacttcccattgtctgtttcttgagtttattttgcgccatctgccttcttccacctgatttggaattccaggactgctgtgtaggcttctcttcagatgagatgcagcagtgttctcaactggcaggggcagctttcttgggggcagggactgggcatctgtgttatctatcctgggcccatctgtttctttccccttgacacccaccacaggggtctgtgtacaagagggttggttgataccagttttaatgagggaacctatcttcttggaaccatccagaagctgtggtctttttccctggaacaccccacccccgacatcccagtgctggattcaagctggtgaaccacaggtcaaaattttcagttgctgtcttccagggccttggttgttccattgtcccctctccctgtaccaggatcatcgtgatccaatggatttgatggagttgctacacccagcttggcgtgcaggggtgtttggcacatccctgcctgtggaattctacgctctaagggagatgctgccagggtattacctgattcacgaggcatgtcctaccatctgtgttatattttttttaagatcagaattatgaatatttcaggagtcatctgggatctgaagaagcaagaacccactttctgagtcttttccttaaccattcatagggggtaagaaatgtcacaggtttgttgtgaaggtcaaatgaaagagaacttgagaaaatttgcaaatccttcagttcaaggtgaaagaaggtaatttattattaattcatattgttattatgtagcatttcttagaatatgtataccaaatgccttttttgactggtgcaatctttctataattccattctgggatgttagcttatttgcttagagaatggtgtaaagaggggagcccgaggccggcagatcacctgaggtcaggagttcaagactagcctggctaacatggtgaagccctgtctctgctgaaaatacaaaaattagccaggtatggtggcgggcgcctgtgatcctggctactagggaggctgaggcagaattgcttgaacccaggaggcggaggttgcattgagctgagatcatgccattgcattccactctagcctgggtgacaagaacgaaattccatgc

SEQ ID NO: 1911 - DNA, 3046 bp, Homo sapiens
ctggcccaagccgccatctcccgcctcatacaccagcaacctgggaagacgagacgctgcgactgttcctgcagcagagcggcccggacgcctcattccccctctgggccctgggctccatgagcaagaggctgcaggctgcttctgagatccagcctgggaactgtccaggctcctctgtcctgcctgggatggaggggccactcatcaaaccctctactccccggctgccacccacactggacagagaccaccactacctgggtcttgacgcaggtggcaccacttcttgcccaaatgccgtggcctggccccaggccccccaagcactgggtccccggcatgtggacaaggccactcaccacatctgtggctggctggaggctgccctgggcccttcctgtgaccctcagccttggaggtcagggtgccctcacacctggggatctgtgctcagccacccgatgcccgctgctccttgcttttggaggtcatccccctcccccccagtctctgcaatgtccccctgccaccctgtccaggctatgcccttcttgggctcctcctgccccatgcctgaggcacgtcccttttcgtggtttacatgacaggccagtaacaggaagggcctggggagagtttctgggctgagccacatgtgattttcctgatgggcagcactgggccacagctggggctctggttggctgtgacctcccccagggcctggctgcatcttgggtccctgtggacagagctgtgtaggctgcagatgagagttctgttctttttgggaaggagcgtgtctggccaggttctgcctttagtttgtggtgtgacctttagcagttcactcagcctgtctgggctcttggtggaaacaggtctctgaggttccttttcggccatgcttatggctccaggtcatccagcgccacagggcaggggtcctcactgagggggcgtgagccaacagccgacggctgagggcgggccgggtggagctgagttctgctgccttgcagtcgctgcgggtggagagttgcctccccactctgagcccgtgtcctcagtagtaaaatgggcagcataaggccctcctcacaggattctggcatcaagtgagatcttcagtgtaaatgaccatgtataaactgtaaagtgcaatagaaaactgtgtgtgtgaggaaagtaaggcctagagggggtgatgtgtggcacatgacaggggagatcccacagctgcagcacggggacaggccgcttccccacatccgctcatgccactgtaagcagccctagctcttgggtccaggacctcaccaggtcctcgtcagactcctgtgctcttccaggggctgctcagccccacctgaagagcccagagaggctgtcttcctacccagcaggtctcatgcaggcccagggctggggatgcaggcaagaggagggagatggccgccctgtccctctccctagctggcggctctattctgagcagttcttgctgcccgtttgctctcaggggaaaggctcacgccccccatcttagccccaggggggtaagtgggtgctggtgatgggatggtgtggcgctcctgccgtgggtgttgccaggaggctctttgggaaggagtgtcgcccggtcaggtggtgcgctcccggtcactaggggtgtacacgtgaagttgggtgaacacctgctgctcatggtacccagtgattcttgcccgagtgggcagctgagcagaggcccctctgggtcttgcagtccaaagaaccgcagagtagcccaagggctgtgggtccattttgagtggcagccaagtctgggagcccgtgtgcatcatgtttgggtcaggttggcgtggccaccactgaaataagcaataagtacgggctcctggtacctgcggatctcctgcaaacaggcccagagaacagccttgaagccacctttcccctcaaggggactgaccctgtctttaatgctgcagtggcatccagggatcagtggaacattgctttgagaaccctcctgctgttacggaggcagcacaaagctggtgacccctgagccaacacggcactgggatggctttctaggacagaaccctgtcggcgactgtcacatctcaaactaatagctgattttaaaagccagcagcagcgacgccatgtacctgagtacaggtggcagttgcagagccgtgggctgtagaaggtcagatggggcttcccacaggggaaatctgggcgtgctgtagctcagggtgactcccagctccgtcactagcagggcgacccccttccttctggagccttagctctgaaagcccccagtgggggtgccctttcagatgccccctttccatttcaaaggctctgactcttgatcttgaagccggacgcggcactggcactcggcttcagtttccactgtgacagatggaggtctcctttcgccccagcccaggtggccaagcccatcctggcctcagaacatgctgagcacattttgtagggtggcacctttttatccaagttactagctacacatcagtgtttaaagagaaaaaagtgacctttcattttttttttcttgaaacttgaggaaacaagatacatactactgattttttttttttcttaaaactaaatgcatgactgcagagcggtagaggtgtatatttttcatactgtggggcaaagtatttgtgctgctttttggagatggactggaacgtctggtttctgtccccgggcccggcagctacgtctattttctgtagaaggtgccacagtgagacctggagccaccccttcctgccctggcgccgtttagagctgggagcccgtggactcccggcctgtttctaccttctattcaaccactctgacgtggggagacaagaagaaatagaactttttgatagtgtggtaaaaacattgatttgaactattttagtaaaaggagtaacaaacaagattgtgatagtgtctactttgagctagataaataaaggcctctttgtgagcctcctgg

SEQ ID NO: 1912 - DNA, 2803 bp, Homo sapiens
gctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctcccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctggtcccctgaagtcatgggttgctggctcctgctcagagtgacagcaccctgtggagtctgctggtactgacctaaccaccacagagccccactggagcatggagccagcctagagagggtcagattctccttcttctgtggttaacaaacagctcggatccatgtcacttgacgagcaacagggtgcgtgcaacaggagatgcgctatgcccatccatccatagctttattgcaatgcatatactaagctctctcacacctttcgtagcatttcattttgattatggtcttatagtcagtattttgtggaccaaattacaataggtggtattgtacataaaaggtctttttggcctatacagattattttctatgtaagctcatttctcactttggcccttgatgccaactttgaactctctccctataacaaaattataatggatacaaactatatccattttttaaattctaggtatctgtcataaaattgtgtagaactgtgggtgtgaggttaatactacctcgttgcttatgtaggataagttatttaaacacagtgatattctatattactagattgctttagtaatgatacttggttttatgtctcacttatctggtagccaaattcctggtagctttaactaaagactatagttacgaacccagaggtaagctcaaaagctgtcagtcagaagctcccacttccacttgtacttttcaatgtgggaaaggtatagaatcaatctccaagccttgaatagagcctgatgaaatgaacgcgttacttatttatcaggctttattactagcgatcaaatatagcacagagaaggattagtagaggaagacattctgacatgaagggacatctgaaaaggctggagataggaagactaaaaactaaaaaggctatttagtgttagcgcaaatgttttactatctcacctcagaatttaatgaagtattttaaatatattgtgacaaagtgtgataagtaatcttagttaagtctttaagaatgatttaacacgatatccactttctctatttaaaaaggcagatagctggacgtggtggcacacgcctgtaatcccagctacttgggaggctggggcgggaggatcacttgaacccagaaatttgagaccagcctggtcaatatagcgagaccccgtctctt

SEQ ID NO: 1913 - DNA, 2179 bp, Homo sapiens
aaagaggatgaaggcagccgcgtgatagataggcgcgagattaaatgggatctttatgacttctgcagccatcagttctgactgtgtgataagacgcgtcgactagggccctgatttgctctttattggagccaatattagcatgctctcaccagtgcacgggccgatcaaacccacttaaggtggactcaccgcataggcccagctgcagatgctgctgggatggccaggagggaggctgcagcccacagccgggcaggtggggggtgtggaattctcacactgccctggggccacttcaccccgggtggcttgcagggggtcccgggggtgaggtgcccctggtgaccccaggctcagtggactgtcctgtatgcccgggtctcagggtggccctctcccttcccaccccttatcaggcctccaagaatgatggctctcccaacccatgctggggacccagcagcctcctcattctgcccccagctcctgctctctggcaaggagggagattggcttgtttaggaccccaggggtgccaggccatttcctgggtgggggcagtgtccagcaccttcctctgccactcagtatcatggagacccctccctccccctgctggacagccgccacctgtactcagcttcgggcaaggcgctccccgtcctgcctctctgtcttcctgccataccttcagcaacccccttgacagcccccctcccaggccacccctctgtcaggggcactgcctgtgcctgtcactgcctttctttcccctggtgtggcccctgccagaccgcagccatctcccctgtcaaagtctcctaaaactcagactggatgatctgcatccagtctgcaccttggatgatgccaagtggagattggatgatgccaactcgggcacagggtgggatggggtaaggttgggggccagagagacttggggtgtggtggagccctggacctgagtccacacagcatcccatcctgtggctgcgctttctcctgaaggggctgccagccctcctcagggactgcaagcacagctgggtatgtcccatgcagtcagccctgccgggtggcccccagctgcctcttcccccagcagggcatgggcaggcagtgggcactcagggggtagctggcttgctgcaccctgtcctcttggtgggcggatggggccccttcactgcgtggggactggactgctgtcacgtgcctttagatgtgcaggttgcttctgtggccaccttctgtgaaggaggcctgtcactcatccacctggcacatttttaacctcaatgtcatgtgttgacaccgagggaggcagagaccatgaaagcttgccatagccgaggggttcgggcagccggtccgtccggggaggcccagcagcctggcacacagggcgtgggccctcctgccagagacaagctgagcctgccgcccgctgaccacctgccgtccagccagccccacccaccggctccaggcccacctcctgcacctgtccaggcctcgcctgtctcaggggtgcccgtgtctgcaaggccccacaggaggggctgggacagagtggggctgggggtcccttgaaatgatcccttggctgagggccacagaggaagagaggcgtgggggcaccagagaccatctgtgttttaaaagaatgtcttccaatcttcctcacagaggaatctgaagaaacgtgctggatgtccccagagaaggagctgaaccatttgagtgggggcttcactgactctccccacacacagggcaccgggggagagcagtcacatgaccggcaggcgggggttttgaccctggtgggaggggatgaggagggcaccagtccggccctgagacaacccccaagaccagccctgactgggacactctgcaggatgtcaagcagtgcccccaaaagctgtcaaggccgtcctagaccagcggggcctcaggagatggtgcagagtcctggaccagacaaacggcactgggaaagcaggagcccaaaggaaggctggaattcagggaagagccacgtgccaggctgtgacgaaggcgacaagatgaaacagtaggggggcgggggaggcatccaaactctatgtgctgtctttgcactactctgtaaatctaacattattcggaagtgaaagttaaaaatcac

SEQ ID NO: 1914 - DNA, 2247 bp, Homo sapiens
cttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgccggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtactgggcctggctgcatgcgtctgtgttgcctgcacagacattttgcagggtgccctagtgattccagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgtgagctcattgacagcggttatgggatggggagcggagggtcagaaaacctcaccccacccagctcagccgatcagccttacggagccctgccctaggccacgagcctccagaggccactcagcccagtgtggagtcaccgagtctgtgtcctgggagagggaatatgttgtcaccagcattggatgcggaggatgagggggcagctgattccttagcacgaccaatctttttctaggttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggtaagccctttgaggtacctgatgtattgcagggagcagggaaaggaaaaaggattttttttcagaaatccctgtaaagtgaatggagactagacaccgtccagcttcaagaaggctcaggactttcaacaaagggagcatacctgacctgagagctgtccccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttctatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaat

SEQ ID NO: 1915 - DNA, 2874 bp, Homo sapiens
actgagggcggcgagcgggggaagatggcggagctggggaagaagtactgcgtgtactgcctggccgaggtgagcccgctgcgcttccgctgcaccgagtgccaggacatcgagctgtgccccgagtgcttctcggccggcgccgagatcggccaccaccgccgctaccacggctaccagctggtggacggcgggcgcttcacgctctgggggcccgaggccgagggcggctggaccagtcgcgaggagcagctgctgctggacgccatcgagcagttcggcttcggaaactgggaagatatggctgcccacgttggtgcttcccggactccccaagaggtgatggagcattacgtgagcatgtacatccacgggaacctggggaaggcctgcatccccgacaccatccccaaccgcgtgacagaccacacctgtcccagcggaggccccctctcacccagcctcaccaccccgctgcccccgctggacatctctgtggctgagcagcagcagctgggctacatgccgctgcgggatgattacgagatcgagtatgaccaggatgccgagacgctcatcagcgggctctctgtcaactatgatgacgacgacgtggagatcgagctgaagcgcgcccacgtggacatgtacgtgcggaagctgaaagagagacagcggcggaagaacatcgcccgtgactacaatctggtgccagccttcctggggaaggacaagaaggagaaggaaaaggcgctgaagcgcaagatcaccaaggaggagaaggagctgcgcctgaagctgaggccgctgtaccagttcatgtcatgcaaggagtttgatgacctttttgaaaacatgcacaaagaaaaaatgctccgggccaagatccgagaactgcagcggtaccggcgaaacgggatcaccaagatggaagagtcggcagagtacgaggcagcgcggcataaacgggagaagaggaaggagaacaaaaacctagccggctccaaacggggaaaggaggacggcaaagacagcgagttcgccgccattgagaaccttccaggcttcgagctcctgtcagatcgcgagaaggtgctctgcagctctttaaacttgagtccagcccgctacgtgactgtgaagactattataattaaagaccacctccagaagcggcaaggaatcccctccaaaagccgccttcctagctacctggacaaagtcctaaagaaaaggattttgaatttcctcacagaaagcggctggatctccagggacgcgtcttgaagctgagacgctttgaaagccagggtgatgctcagacagtgtgccagccaaaatgacttgggggaggggagccgcttccccactgttgctcttttttaaacaaattgagttcctttttttaagatagaaattcttttcatggtcctctgaaagaagcaatagtaacaatcttatattggatcatgggggaagcaaatgtgtgtattttaagtgagttcctgcgagtcatacactgcgatgatgctccgcctttacccgttcagttgggagcttattgtgagattggatcatttccttttgagtgttcttctctttggtacaaaacctattgtgggtgacaggagcagtgttttcctgctggacccgcaagccaccagctatttcctggtgacacaagctcttctcaggcggggctgcctgcaggctcccgttttctgagcccacgctgcccacagctgaccccagcgcagccccgggcacgcggcactttacatgggggcagcttgggcccagactcctccgctgtgtagcagatgaggaaaatcaggccagaggacaacaggctggcgttttgttgggaactgaagaggaatctgttgaacacagcgaccagatgaccttccatttcaccggcggcagcagtttcagcgtgcagttcccaaaccccaaagctgaccctgcgccccatttgaatacggccagagcctgctggttcactttgggtagagccgtgcctcttgggcaggctcccatagtgaccacgtccccacgaatgggaaagcacgttagtgggagggacgtaggacacgtgtggaccgccaggccctctcagtccattttccggggctgctcggtgctgctgttaagacgtgagtgcatttcacttggaagaacccattgtacaaagttcaaggctaagagttctgaattctggcgtcagcttcctcaggattttcttcagttgcaagtacctttccactgaaaatatgagcatgcccgcctggctagtaggcatctgtaagagtgtcgccaggcccgcgccagctgaggcctcagactagccaggcgagagccgtctgaccagttggctggcggtggttctggtggagcacgagggagcccgggtggtgccctgagcctcgagctgctctctgtcactgtcttgaatcagactcagaaatggcttcttcccagccctgcctacaagtttttctctggggtcctctttcaaggatgtccacggtaccttcctcctgaaacttgaggaagtcttttgtcttccagctgctcagggttctctggtccaagaccctgctttaaagagagtctttggcgtgctcagactccagcgctccgttcttcaaggaggttgacttgcctctcgggccccgtaggtaccaagagactgtttacctcccagaatgtttgggcttgaagttacattaaagtgaagttatttgaaagaaagaaaacctcatcatttctaaggatgacttaattactgtgccttttcctttctttttacacatcctactgtcccttagggtaaaattttcagcattaaataaaacatttcaaatatattgt

SEQ ID NO: 1916 - DNA, 2261 bp, Homo sapiens
aggatctcatttgttaaacgtggtaccaattgggtgtcttaacacaggagcagaacttcctagagcagaatgatgatggtagatctgaaagtggctgcgtacttggaccctcagatcagggctttgtgggagaccaaggggcctgcaagagagagctccggtcagagtaaaaaatctcctcaaatggactgtctcgatcctaagagctcttgctggcacttccggaatttcacctatgatgaagcaggtggaccccgtgaggctgtcagcaaacttcaagaattatgtcatctatggctgaagccagagatccactcaaaagagcagatactggaactgctggtgctggagcagttcctgactattctgcccagggagacacagacccagatgcagaagcaccatccacagagcattgaggaggctgtggctctggtagaacacttgcagagggaatctggtcaaacatggaatggggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagagggctgtgcctactcaacagattctagcttttcctgagcaaacaaacaccaaagactggacagtgacacctgagcacgtcttgcctgagtcccagcattgtttgtgctccccaaacctaaagtgatctcctgtctagagcaaggggaagagccatgggttcaagtatccccggagtttaaggatagtgccggaaaatctcctacagggttaaagctcaaaaacgacactgaaaatcatcagcctgtgtctctttctgacttagaaatacaagcatcagcaggcgtcatatcaaaaaaggccaaagtaaaagttccccagaaaacagcaggcaaagaaaatcattttgatatgcgcagagtgggaaaatggcaccaagattttccagtgaagaaaagaaagaaactttcaacctggaaacaagagctgctcaaacttatggatcgtcacaagaaagattgtgcaagagagaagccttttaaatgtcaggaatgtgggaaaaccttcagagttagctctgaccttattaagcaccaaagaattcacactgaagagaaaccctataaatgtcaacagtgtgataagaggtttagatggagttcagatcttaataagcacttaacaacacaccaaggaataaaaccatataaatgttcatggtgtgggaaaagcttcagtcaaaatacaaatttacatacacaccaaagaactcatacaggagaaaagcccttcacatgtcatgaatgtggaaaaaaattcagtcagaactcccaccttattaaacaccggagaacccacacaggtgagcagccatatacttgtagcatatgcaggagaaacttcagcaggcggtcaagccttcttagacaccagaaactccacctgtgaagagaagcttgtccagtgtcctcattctgaagacattcaccaaatggagcttggcactaaaatttatgtaaaagaaaaatcacaaaccttgaaaaattttacatcagaaaatgggataaacatacatttcacagaaaataatcaagacttgctctgcagccactcagtagtcttctgtggtcacagaagtaaacattgttggctttgtattgatctctccagtcatttttgaacacatccaatagaaacattggcagcatggtcttccaaaacaaaaagcagtaacatgcatgtttaattgcataccattctcttcacagtagcaggcttaccaatttccatagtctcatgaggccgaaatgaattacaatgtaaagtgttccaggaaccaaattggattttctttcttttgtcattggacacggtttgcaaagttggacatcacttgagttccttcttaaacttttcggcaacttctcttggatcctgttatcacagttttttactgtgatgaaatcttgttaaccaccactagggaatctccagatggactattaatgcactgtcttatgcctctcattggtgatgtttggaaaatagaagacatctctaatggaatcatgggggaaacgggttggaatttgtagccatggaatatatattagatgtaaagaattttctgcaataaaagaaactagacttgtt

SEQ ID NO: 1917 - DNA, 2219 bp, Homo sapiens
catggacatcaatttgaagttgtaagatcatgctcctatggcttcttcatcctgacatcctcaggattctgttcatcttcccagaatctcccctatccagctacaaccgtcagatcttggtgtgtgtgagtgcgtgaatgcatgagtgtgtctgtgtgcatgtacatgcgtgcacacatgtggctataccgttctcatcttggccctttgctctgcagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtgaggcagtcatcttcttaatggctatatcccacccaatcttgcttcttttatacatcttctgttagttttactaacatcataattatacaaaccagtccttgcagttctcagttcccaaatccagttccattggatgcctccccaaggagtagagatagaagacgaggcaaagacacctagaatcagttaaaagagactatctacaaactacagactgaatttctttctttctttccttttttttttttaagacagtgtctcactcagttgcccaggctggagcgcagtggcacaatcttggctcactgcagcttcaacctgctgggctcaagcgattctcccctcagcctcccgagtagctgggactacaggtgtacaccactatgcctggttgacttttatatttttagtagagatgggtttcaccatgttgcccaggctggccttgaattcctgagctcaggtaatctgcccccctcagcctcccaaagggctggggttataggtgtgagccactgcgcccagtcctatagactgaatttctaaagcgaaacataaggaaaagaccatcctcataatatcgtttatttaaaaaaattattttttgtacagacagcgtcccgctatgttgcccaggctggccttgaactcctgggcccaagtgatcctccctccttgacctcccaaagtgctaggattataggcatgagccaccgggcccagcccatcctaatcatattaatattaattaagctagtctgtttacatgcactgtcactcatttattcattaggaatccttctgagctaggcatttatcatcattctacagatgacaaaatggaggttaaaagaggttgaataagctgctcatatagaggtcatatagcttttgagtggcgcagccttgacccaaattcaggtctgcctgacttgaatgctcatctctttactactaagttatatttccttaaaatcgaatataaaaatgccaagtccatgggtagagaagaggactattcaatagtctttattcttctgtcacgtgtttcaccctagggttctcatttttatcctacttttgcacccttcatgtaaaacagtccttaatgaaacaaagggtttgcggagaagtactcagaatgggaaacgttggtgtccttggggttgttagcagagccagcagtgatcctgtgaggtcagtcccagccctggaaacacaggtgtctccctgggctgagggtagtccccggctctgacggtccgatgtctttcctcaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtaggcagctgcctccaggatgagttacttgaaatttgccttgagtgtgttacctcctttccaagctcctcgtgataatgcagacttcctggagtacaaacacaggatttgtaattccttactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgtactgtg

SEQ ID NO: 1918 - DNA, 1921 bp, Homo sapiens
ctactccagcctccgccgcctcagcttcccgagcgagccctgcggccgccggagcagctcccgcggcggagcaggagccggatggtcagaggagcccggcagccccagcagccgcggagtcgcctggcccccagactgactggcacagtggagaaaccgcctcgaaaacggagaagcaggactgaatttactcttaaagaaatcatgtcctctggaggtgctgaagatgatatcccacagggagagaggaaaacagttacagatttttgttatcttctggataaatctaagcaactgttcaatgggttaagagatttgccacaatatggacagaagcagtggcagtcctattttggaagaacttttgatgtttacaccaaactctggaagttccagcagcagcatcgacaagtcttggataatcggtatggcttgaagcgctggcaaataggagaaattgcttccaagattgggcagctatactatcattattacttacgcacatcggaaaccagctatctgaatgaggctttttccttctattctgcaatcagacagagatcatattattctcaagtcaataaagaggacagacctgaattggtagttaagaagttacgatattatgcaagatttatagtagtttgtcttcttctcaacaaaatggatgttgtaaaggatctggtaaaggaattgtcagatgaaattgaagattatactcaccgatttaatactgaagatcaagtggaatggaacttggtgcttcaagaagtagcagctttcattgaggcggatcctgtaatggtattaaatgatgataataccattgttatcacatcgaatcgccttgctgaaacaggagccccattgctggaacagggcatgattgtgggacagttgtctctggctgacgcactcattattggtaattgtaataatcaggttaagttcagtgaactaactgttgacatgttccggatgttacaagctctggaaagggagccaatgaatttagcttcccagatgaataaaccaggaatgcaggaatcagctgacaagcctactagacgagaaaacccccacaagtatctgctctacaaaccaaccttcagccagctatataccttcttagcagcgtcttttaaggagctgcctgccaatagcgtgcttctgatttacctgtcggccactggcgttttccccacaggtcgttctgatagtgaaggtccttatgattttggaggtgtacttactaatagtaaccgggatattattaatggagatgccatccacaaacgaaatcagtcccacaaggaaatgcactgccttcatcccggggatctctatcctttcaccaggaagccactgttcatcattgtggattcgtctaatagtgttgcgtataagaatttcacaaacttgtttggacagccactagtctgcttgctttctcctacagcatatccaaaagctttacaagatcaatctcagcgaggtagcctcttcactctctttttgaacaatcctctaatggccttcctatttgtctctggattgtcaagcatgcgcagaggcctatgggaaaagtgtcaagaatatcttcgaaaaatcaaccgtgatattgcccagctactgactcattcacgttcaatagatcaggcatttctccagttttttggagatgaatttcttcgcttgctcctcacaagatttatcttttgttcagccaccatgaggatgcacaagatttttcgggaaacacgaaattatccagaatcatatccacaactgccaagggatgaaacagtggagaatcctcatctccagaagcacattttggaattagcatccattctggatgttcgaaacgtgttctttgagaataccattgatgactattaaaacaaaaaccctgttgtcg

SEQ ID NO: 1919 - DNA, 2131 bp, Homo sapiens
gtcgacgctgggctttcgggtcccgcgcccagagatgggctccaaggcaaagaagcgcgtgctgctgcccacccgcccagcgccccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctacgtggctgccaaccagcggctgcagcaggcgggcaacgtgccgaggctgcctcctcaggctgacctctcggggcctgcaggcttgggcagcgcacaaggtggcctgcacccaggctttccctgggggtccgtcggccccagactggcattcacggggtcccagcccacgtgggtgttgacacaggcgcccctcctgatgctggggctgcggttcatccgtcgtctcattcatgccgagttggtgggacccacccagctggctccgtcctgcgtgacctgagggccccactggggttctggaagaggatagggacattattgctgtactgtgattctgtcgtcagctcacagtggccgtgctctgcagtggggcccctgggagcaggtgccacctccttcctctcccggggcaggcactcgcctgtccacttctgagtccaggtgttgggatcgaggtgttaactgtgattccatccagcgagtgcccacccaatgtcagagcagcccgagggccagcctgagcccctgaccccacttccttctgggccccgggctcctcccacaagccacgttgatcttcacaacgaccctgggccgctggggtcacccaagagaagcagccctgagacccagccaggctgggcctagctccacggcacgggtgtctcccagccactgcccttgctggaggaccgctgtgagtcactggccaggagcccagggtgtcctgagtctcatagccaccctgccagctgcagcaggtcctgggcctgcttccctgcgggttctggccctgggggagggggcgttagtgcggcggagggtcttgccaaaggcttttcatcctaaatagcaacttgagtggaaacctgggcaaggcggcccagaggctgggccctgcacataaagctttcgtgtgtgtctggccgtctgaatggtgcctctgtgagcggctccgtcccggggccccggaagctggggagggatgggtaccggcgaccccgggaaccctgctcagtcctgccgggcactgcatgcagggaccgtccgcctgacccagagacctggggctgcctcaccctctctccagacccacagccagctttgtttcttgaatgtggaagatgtttcttattccctgaagaaagggggcctgccacacacagcctgggaggcgcctcatccagaaactgggacttggctagcccggcctgggccctagggacttctcactggtcatgcttctgaagctgctcacctggccgagggaggtcccggcagtgtcccagggtggaaggtggggagggggccggctcctgccatcccttcccaccctgcacttctgtgctgcttgcagtcatagctttccttgtccccccagctgggccagggctgtgctccctgaagtggctttgacgtggggccgtcccagctcccgcagcccctgtccaccattgactctccccggtagtggctgctgtggctgccccatcccagctgttgcaccagccacagctcctagtggctcatgggtgcctcctgccccacactggggcctgccataataactggcccaggtaccaatgcccaggttggaccccctgtctggggtgctgtgcaccccctggagcctgccctcccttgggaccagggggagactcctggcctcagccagtgcctccccggcccatctgggtggggtgcccacaaaccctgtgcccccagtttctgctttctggctctgcttccagggatctaacctggggggtctcagcaattctgtggcagcacatagacagcgatgaacctacccgcccacagcccattttgaggaagaggtgatggcggcaggcaatgcaagagctcagtttattaaatgtgtgcgagtcgg

SEQ ID NO: 1920 - DNA, 2038 bp, Homo sapiens
gatttccacagtccttcatatgatcttgaaatatgatgcctacatctttgtttacctgcccagatattgatcagtatggtaactctgctccagtggttgcttgtgtgtttcaatcacgcatgattcttattggccacattggggcaggaggcggcacattagagggaagaaaaggagcacccaaaggctgatcagaagaagccaaaccagcctagttggtggggaagttagtaaaggtggcaacaagttatatatgggcataaaaaaaaaaagacaataagcccttgagatactgtgtaagcctaaatgatgcaaattatggagcacgatggaaggaaaaatacaagtgggaagattatcaagaagcctcaaaatgagtcaaatcagattcatggctgaaccactctaaaaatatttacttgacgttgaaatttagtactgacagctgaagttgaaaaatctttgttatatttctgttttgtgttaaaatgaagatgacacccaagctatcactttgttcccttggaatcctagggtacacatgccttgtcacgtcagaatgattgatttttcctttggctttctcactacaggaaataccagaaatagcccaccaccctacgggtttcatctctcaccagaagaaatgaggagacagcggcttcacagattcgatagccagtgaggtggcatcttgggaagacatggcctattcgtgtaattattgcccatttggctcattccccaagcccctaattcattttaattcattttaaacaaaagcagagtacaccggtattgctccagatcgctcacatcacctgggacagtcccatggcccctatgagtcaactcacagcttgcggggagtgggccttctcctggccttgttcttgctcataaacaggtcacttcctccatgaagagaccagtttccacgctcccatctctcactgctgactcagcgatgcctctgcctcggtctgcttttgaagactgtgaccttcaccaggaggttttacttacaccagtcgggaagattagtccctcattctgcctggagtgccccgtgtttgacttggcagcgggtgtggagccatccccgcgtcctcctggcgcattgccactgtggctgtccaggaacaggatgtggctgccttggccgaatgttgtcctactctccccaaccccggcgcctcagctcctcagctcctcgggcccctgcgtctggctggtgtttgcagggctttcgctctgctctggtattgctctgcctttatagaaagtcttattgaagaagtgtaagaaagacctaaggtggggaagactcctacacacaccattaatatcagtgacaccagcaatgtaggttcccagccccttcccagtggcagcttgtgtgtccaggagataggacatcatttaacgcatcagcaaagtagcagcagatgccacatacagagtagagcgaaggcatttggtggatcggtcactagagatctatcttgcagaaagtatgtttttcctcataaaagtgtctcttaattggccattgtaccagccacttgtcctagccaaatgtccaaaacacgcccttgggccccgccacgttacaatccacagattgtctgtctgagtcgtttaaggcatttcctggtgcttgtgttccatgaataaaaggacaaagtcagaagatcactgatgtcttactgtcaacagagatattttaaaagagagaagcaggaaaagatcttccttttttgatctacaacttatatagttttctgattatgcacataatagatatgccttccagatgcataaggcaaacatctggaaagaaatatacccaaatcttagcaggggttatctttgggagtggagtacatgggattttgctttcttcatttttataattttatattactgtcttggaagatgtgtttatgtgtgtgtgttacttttacaatcaggaaaacatatttaataacatatagtcaagaaaacagacttaaaaataaatactatgtgtccattg

SEQ ID NO: 1921 - DNA, 2422 bp, Homo sapiens
gctacgatctagccactgggaacccagccgtggacaggggagaggatgcccagctcccaggcagcttatggtcttgtgaagagccaacattttagttgaatcctgctacttcctgctactctgcatcaagaaccaaacagaagtacagagtcctctccgttcacaaaaaaagccaatttctttttataaaattaacagaaagttaccaaatacagttctgtacactgaaagttaccacatgtaaagcaagcatacatattgcctcgcattccagccagcagggcagtctcagtgtggaacccccctgctgaatggcacctctggaaggtatgcagcaggcagtactgccaaccagaaatggccggggctttcaggagacatcactgctttggagtttcttgcagaaaactttcacattcatctcacacacaaggattgcaaactgcttccttttgtgtgtgtgtgtgtgtgtgtgtgtgtgtgtatgttctctgatcaaaggaaagtgggatactctgtaatactctgtaatcaatgatatgaaatggaattacaccctgagtacactgtaatgggcattgtggatttaggttaggggagaaaagttggcctcccaaaatttctgtatttggagggaccagtagacttgtgttttttgatgacttggatgtgtgatggtgtgggaggacagtctcatcaaatataatttactcagtatttattgagtgcctactatgtaccaatcctctggttatataaaaacaaataatacagcatttcttcttcatggatagagtggctaagtcggggacctgcacataaaccaagcacactacagtgggtaagtgttctaagggtctgtgcacagcacattacactatgacatgttaaggcatgcagtaatctcttagtgcctatggtggggatgaaagattttctcctcatctctgaatggctgggtggaaccccagcatggagcctcggctggaaactagaggattctggacaaagacgaggacaggctctaatgtcaggccttggaaccatccgaggtcaccacctgttaagcacgcttaacctctgtggacccaaggtggtgtgtgacaagcatccccagggcttgctggacaaccattactttttattacgtttcttactgtcaggtgctccgaaatccacatggactgctcttatgatttcaggttatcccaaaagagaaactcaagaatcagtgatgagcacagccgggagtgagccggctgcctatctcaaaagggcacatcaccataatcacagatataccatgagcatatgcagaaagaatgtaccgagggagtgtgtgtcaggagcggccaagaggatacataaaccaggtgcccctcccagcatccctctcccccaccaaagcagtgcctttaaaatatgtgataggtgcccacattgtctctctggccccgcagaatgcccctcccccaacagccacctttgctgctcttcgtctaaatccacccggggtctcccctgggctggctgttgccttcatatttcatgcggaatgcgcagcttcccaggagccggacgcatgccctgcattctgatgcatcggccggctctgacaccagccagctccagagcatgcctaatgaggaggctgacaccgaggcagaagagccaggccgggctgtggacggcccgctgcaaacagggagtggggtgacaggaaggcaccaagggtgaacccgggggaaagatggcagttgcctttttaagacacgactctagcatcagatactacaaacatgggccaatttaaaccacaccaggaatgaatcacagcctcgaataaagagcaatttggatcaaggaacttccttggggaaagcataaaactaaaagaggaaggagaagcggcaaacactaagagaaggcagaagctttgaaatcactcatatttcagtaggcagagtggttgcccattttagtttttcttccagtgtagagctccttcaagtttccttagagaccacttcattatctaaaagatgctgctgaacagaagtttttcctttcctgaaagcctcatctaccttaatttcacacattattcctcgttttgactggctctatcaggataaattgacccttgcttcccatggtatttatggcatttatccttggggtagagccagtaccgacaatcaccatcccaaagctacgaggatgcgatggtaacatgctcatcagccatctacttaacactttgcccaagcctagtcccgtttcatcatcccagcaacttgatgagttaggtgcagatgagaaaaccaagaatgacagaagtttatccaaggccatacatcagaccaacggtctcaaacatgggacccgccttcagtactttccaatgagctgggtacccact

SEQ ID NO: 1922 - DNA, 2143 bp, Homo sapiens
atttctgccaagctaacaggtatgcagaacagcttaatgatgcttgttgatacaccagactactcagaaaagtgtgtgcacttggaggcactgaagaacaggctggaggccctagccagtccacagattgtagcggcattcacctctcaggctgtagatcagtccaaagtgtttgtgaaggtgtttactgaaattgaccggatgccccagctcctggcctactactacaagtgtcacaaggtgcagcttttagcagcctggcaagagctgtgtcaaagtgacctatccctggaccggcagcttaccggactctatgatgccttgcttggtgcttggcacacacaaatccagtgggctacacaggttttccagaagccccacgaggtggtaatggtgctgctgattcagaccctgggggccctcatgccctcgctgccctcctgcctcagcaacggcgtggagagggcagggcccgagcaggagctcaccaggctgctggagttctacgacgccaccgcccacttcgccaagggcttggagatggcactgctcccccacctacatgaacacaatctggtaaaagtcacggagctggtggatgctgtgtatgatccatacaaaccctaccagctgaagtatggcgacatggaagagagcaacctcctcatccagatgagtgctgtgcctctggagcatggggaagtgattgactgtgtgcaggagctgagccactccgtgaacaagctgtttggtctggcgtctgcagccgttgacagatgcgtcagattcaccaatggcctggggacctgcggcctgttgtcagccctgaaatccctctttgccaagtatgtgtctgatttcaccagcactctccagtccatacgaaagaagtgcaaactggaccacattcctcccaactccctcttccaggaagattggacggcttttcagaactccattaggataatagccacctgtggagagcttttgcggcattgtggggacttcgagcagcagctagccaacaggattttgtccacagctgggaagtatctatctgattcctgcagcccccggagcctggctggttttcaggagagcatcttgacagacaagaagaactctgccaagaacccatggcaagaatataattacctccagaaagataaccctgctgaatatgccagtttaatggaaatactttatacccttaaggaaaaagggtcaagcaaccacaacctgctggctgcacctcgagcagcgctgactcggcttaaccagcaggcccaccagctggctttcgattccgtgttcctgcgcatcaaacaacagctgttgcttatttcgaagatggacagctggaatatggctggcatcggagaaaccctcacagatgaactgcccgcctttagtctcacccctctcgagtacatcagcaacatcgggcagtacatcatgtccctccccctgaatcttgagccatttgtgactcaggaggactctgccttagagttggcattgcacgctggaaagctgccatttcctcctgagcagggggatgaattgcccgagctggacaacatggctgacaactggctgggctcgatcgccagagccacaatgcagacctactgtgatgcgatcctacagatccccgagctgagcccacactctgccaagcagctggccactgacatcgactatctgatcaacgtgatggatgccctgggcctgcagccgtcccgcaccctccagcacatcgtgacgctactgaagaccaggcctgaggactatagacaggtcagcaaaggcctgccccgtcgcctggccaccaccgtggccaccatgcggagtgtgaattactgaccccaccacacaccggaccaccaagagagccagggctgctgtttcgcgactcaccagcacagatttgctcagaaactctgcccaagattgggcagaagttactttaaaaagacttggttcagctggtcacggtggctcacgcctgtaatcccagcactttgggaggccaagccagatggatcatgaggccaggagttcgagaccagcctgaccaacatggtgaaaccccatctctactaaaaatacaaaaattaacagcagagcgagactctgtctc

SEQ ID NO: 1923 - DNA, 2643 bp, Homo sapiens
ataaaatttgaaaaataaaagtagaaagagaaaaaaacactagccatggtctctttacctggtataatccctttcgactttttaatgtttttttaatggtcccagctgactgttttttctgttctttccagctgtccttctactctagaatatatccaggttgggccagtcctttggatccagtttttcttgatatctagttaatgaagatactggaggggaaatgctgagtgatcttcaaacagtaactttccaaaagccaggagtaataccaagatctccaagacagcagctgggttcagaaggccgggtgcggtggctcacgcctgtcatcccagcactttgggaggcagaggcaggcagatcacaaggtcaggagttcaagaccagcctgaccaacatggtgaaaccctgtttctactaaaaatacaaaaatgagctgggcgtggtggtgcatgcctgtaatcccagctactcaggaggctgaggtaggagaatcgcttgaacccgggaggcagaggttgcagtgagccaagatcgtgccactgcactccagcccaggcaacagagtaagactcagtctcaaaaaaaaaaaaaaaaaaaaaaaaaaagcagctgggttcagtgttctgttgttgacccttgtttggggttcctctggttggctggctaccatgcatgtcgtgtgttgcttatatcagaaggtgagggttctgtgtggtgtagatgctgtcggttagccggccttgcttctcacaaggggcgtttctggggagaacgctggggtctgtgtgggctcaaggaggatcccgtctccccttatgtttctggtacaggatcagatgtggccgcccagcagttgtgcacataggaggagaaggggccaggtgggaaaagggagcaagaggcaggaaagagcacagacttcgacgttcagacctgggttcccgtccagttccattccttgcacagggaatccctgacatcgtcatccgtctcctgtgcctttccgctgggtcagcctcctcccaccaagcttctgacccactgtcatccgcagctgccactctagctgcagagctcgactgggctctggtttctcagaagagctcagaggacctggctcctccctctttgcttctgaactgcatttctttccttattactcagtgtccacacccacggtggctgcctgggtaaaaatctgcccctttctcccgtcacctttcatgccagacaaaagccccagtgagtaatggtgacctacccaggtccagctagcagctctccattcctgagtggcctggggcagaacagggtcctgcgagctcctggatcccaagtctgattccctttccctgtcttcccgcttatctgctaagcttgtttattggggaccactaagcaaagtgaatgattattcctgtctttaacgaggaggggtggagttccctctccatcttcacccacttctgggaggctttcagggactcaacaccccacactgatagcacttccccaggcctggcccagccagccaaagaggaggaccaggccacttctcaacccagctgatgcttggcagctttgtgaccttggatacaccttctcttgggaggtcagaccccatgatcccagctcttccagctatgacatcatgtgaggctgcaattttttttttttttttttttgagacagtatcttgctatgttgcccaggctggccttgaaatcctgggctcaggcgattctcctgtctcagcctcccacgtagctggaacttagggcgtgagccaccgcgcccagcttctggaaaggacatgaatggggaggtggaacttgattggacctgttctgtgagttcaggagaggtcctctgacaactcacttggggtggggaaaggaggtaaagagtcctgtggaaacttttggctgtggggaccccatttcactgatgattgaatgggtccacctctgtcaaaggaattcagagtcccactcatcattcagactgggggaatcaggctcagttgactggcccagccttaaatccactgaattcgtttttatctctacatagaaaaacggaattacagttgcttctcactgtccaatggggattggttcctggagcctccctgaatacctgtccatggatgatgctcaaatcccttacatgtaacctatgcacatcctcaggtatcctttaactcatctctgcgctactcaaatacctcataccatgtaaatgctgtgtaaatagttcttgtgctgtgttggtttttaaatttgtattattttttcttgtatactttccatttttttttcctgaatatttttgatccacggttagttgcctccatgggtgcagacccacggacatggaggctgcaccttctgaaatgagcatggcggcgccctctgggtcctcgtgtcgtcctgtctctggtgctgcatccagcacggtggcgaacagcagaactaatcttttgcaagttatcacagtggagtggagttccgctctgtttgcttttgccccgctctggcttaccagaggtcccctggccttggccacagcatacctagcctagtgcttggcacctcaggcacacaataaatatttatgaaatggatcttctctggt

SEQ ID NO: 1924 - DNA, 2303 bp, Homo sapiens
attaaacaaccggcccgggatcagaggtctgggtcaactggggggcggcagcggcgctaagcggactgtatggcggtggcctaggcccctggcggaattttgggacctttcgcgactctagcgactctcaggctgccttcccttctcggtggcggggcctctttgggcccagcggctgcgggcgcactgtaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggatgttttcaagcctatggaccttaatcgtgtcatcaaactcctcgaagagactgataaagatggcttggaagaaaaacaacttaaatttgtcaagaaactggtacagtgttatcagaatggacttccattaagggatttagcacagatatttaaaattctgaatctgtgttcaggaaaaataaaaaaccagcctcgttttatagaatctgcatatgatatcataaaactgtgtgggtgacttaatgaaaataccaagttctgaattgaggatacaaatttgtaagtgtattgttgatttttatcatgcagaaccaccaaagaagcatattccaggttaccagcaagcgagttcatcatacaagattcaaatggctgaagttggaggattagcaaaaacaatggtccagtcaatgaccttgcttgaaaatcaacttgttgagaaactttgggtacttaaagttctgcagcatctctcaacttctgaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctgaatgtggctttaccaaggatttgatactgtttgccacctttaatgaagttaaaagtcaaaatcttttggtaaaaggacttaagctttctaattcctatgaagattttgagttgaagaaattactattcaacgtaattgtgatcttatgtaaagatttacctactgtacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacgtgtcatgccagggaaatgctcgagtccttgcatttctagaatggtgtgagagtgaagatccgtttttcagtcatggtaacagttttcatggtacaggtggccgaggcaacaagtttgcccagatgcgttacagtttaagactcctgagagccatggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgatacaaaaaaacctctatttactagctttcaagaagagcaaaaaatcatcccactgcctgctaactgcccatctattgcggttatggatgtttctgagaatattagagcaaaaatttatgctatattgggcaaactagattttgaaaatttacctggcctatctgctgaagattttgtcaccctttgtatcatacatagatatcttgattttaaaattgg

SEQ ID NO: 1925 - DNA, 2336 bp, Homo sapiens
cccttgggcccgggccggggaggctttctcgggcgcaggaggttccgcaggcccaggccaggccaggggaggcagccgatccgtcgtcggggttgacagttaccatggcgccgcctctggccccgctccctccccgggacccaaacggggccggacccgagtggagggagccgggggctgtgagcttcgcggacgtggccgtgtacttctgccgggaggagtggggctgcttgcggccagcgcagagggccctgtaccgggacgtgatgcgggagacctacggccacctgagcgctctcggaatcggaggcaacaagccagctctcatctcctgggtggaggaggaggccgaactgtggggtccggctgcccaggatccggaggtggcgaaatgtcagacacaaacggacccagattccagaaacaagaaaaaggaaagacaaagggaagggacgggagccctggagaagcccgaccctgtggccgccgggtctcctgggctgaagtctccccaagccccctcggccgggcccccttatggttgggagcagctgtccaaggcaccgcaccggggacgcccctccctctgtgcccacccccctgtcccccgagctgaccagcgtcatggctgctacgtgtgcgggaagagctttgcctggcgctccacactggtggagcacgtctacagtcacactggcgagaagcccttccactgcactgactgcggcaagggcttcggccacgcttcctccctgagcaaacaccgggccatccatcgtggggagcggccccaccgctgtctggagtgtggccgggccttcacgcagcgctcggcgctgacttcgcacctgcgcgtccacaccggcgagaaaccctatggctgcgccgactgtggccgccgcttcagccagagctctgccctctaccagcaccggcgcgtgcacagcggcgagacccccttcccctgcccggactgtggccgcgccttcgcctacccctcggacctgcggcgccacgtgcgcacccacaccggcgagaagccctacccgtgcccggactgcgggcgctgcttccgccagagctcggagatggcagcccacaggcgcacccacagcggcgagaagccctacccctgcccgcagtgcggccgccgctttggccagaagtcagccgtggccaaacaccagtgggttcatcggcccggggccgggggccacaggggccgggtcgccgggcgtctgtctgcgaccctgacccctggccacggagacctggacccgcccgtgggcttccagctgtacccggagatattccaggagtgtgggtgacggccttaaaagtgactatctagacattacgggaggcccgagatgggctcaggggcccgaacctctgcggcggcctgcagggaggtcccagaatctagggcaagagctggccctggggtgcggtcagtctgatcttgggcccttagcagcctcctctgccagcaccttgctccccactgcccagggctctccaaggccccctctactgaggcagggctgagttgagaacccccagacctacataaggggaaccaaaagctgtttctcagcccagaggtgctaagaggactgaggtagaggagaaccttgttttacccattgtctttttaaattttttatcattatttttattcttgtgaccctcccagaacacaatactcattgtctttttatttatttatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggcaacactacggccagctaatttttaaattttacatagagatgaggttctcactgttgtccaggctggtctcaaactccttggctgaagtgatcctgtcgtctcggcttccgcaagtgctgggattacaggcgtgagctaccaccatgcctggcttccattgtctttgtgtgtgtgtgtgtgtgatggggttttgctcttgttgcccaggctggagtgcaatagcgcaatctcagctcactgcaacctctgcctccagagttcaagcaattctccttcctcagcctcccaagtagctgggactacaggcacccaccacctccattgtctttttactgcccaagttaaaatcctgtgactgtgtactggatctggcctgcggttgtcatatttattgatctgagtccaggcagtgtttttaagtgatatgagttagtagtgaaaattgaaaaggatattttacaacc

SEQ ID NO: 1926 - DNA, 2236 bp, Homo sapiens
gaaatcagtaaatattaaaaagaagatggatgcaagaaggatgaagaaagaagaaggactcacagaaaacacgggacttccccggaagctacttgaaaaacatgacccctggccggcctatgtcacctatacctctcagacagtgaaaagactcattgagaaaagcaaaactagagaactggaatgcatgcgtgccctcgaggaaagaccctgggcatcaaggcagaataaaccttccagcgtcattcagccgaaaaggaggaagtcttccaagtcttctggcaaagctgtgttcagggacacgctgtcagaatccacgttatcaatgtggggcgcttattcggtattggccatggctcctaccatgatcccagaacccacacacttacatgcggattccagagactgtccaactgaaaactataacaagatcatctttgcccgcaagcctatgatgaggatgctccctacagttcgctactgaccaacaaggagaaacatgcaaatgttttagccaggggtccctgcagccattccccaagaacgtacaaaagttaagctccatttaccactcacttgacagtgtcctttaaatctgaacttgctcttgctcatgcggagcttggctaagagaaaccagatcagaatgcaagctgtaggtgggtgggtgagtgtgtcccctcccacactgctctctggtgggtttgggcagtccctggctctagtctctgctgcagattctcaggaccaaaatgtgggtgatttgtctgggtccaggcaggagacagaaatcacacaagctcttttattagagataatataaagaatgattaaccaggtgacagtaaagggcaggaagggaatacaaaggtatccatggaggtagcaccacaggaagcaggcatcacacttgaggcttgggaacaaggggaagatgctggactcattgaaaggtggttgcttggagaagggacatggggctgaatctcagacttctgaggtgggggagtggggatgccactcaatgcagctggtatctctgagctctgaggagagtcctgtggggatggtgccccctcctctgaataggggagatgttttgttggtgtctctgaggggacccccatgaggctgcttttgtgagtgttggaaaaaccaaaaactgcattgaaatgtttctgggaggagttgccactgcctgggtgaagaaaaagcactgctagggttagcaacctgtctggcaagggacaggaagctgatagaaagtgaacaggaagcaaacaggaagtgagcaaggggccacttcctacttcctcctttagcctagcagattccttctagctccccctgggggctgagcctatcagggcacaaagccagaatgtggtttgtagaatcccagccccagcatctccaagcataggatggattttgaagccaagagggaattagctctcggccgggttctgagtgatcccatccagctgctcctggacctggtattgagaggtttttcccttggagggcaaacaaagtggcagtggggaccagggtgtcccctgctgagaaatggagagctcttttcccctgtacttctctggggtttgccttgtggaaccaagtgcttgggggaggagctcctggcaggactccagctgttatttgtcagaggacagctaggattggttcacccttgctctgagttggccccaaagcgagctatgctgaactcttctccatctccaagcagacaacctttgtctttacatgcaagagggatccgattatgacaggctgacccagctggtttcatgtttggggtttatctactgagtaaggctgaccttacctgagtttctgtatgtgtatttgcaagacagttaatactaatccatcatccctcacagagatgtagaggatgagatgtagtaacttatagcagtgtcatttggaaaagttgaatttgccctacaaggcatgttctccattcaagggtcttgtgtaaacgtttgcagacacaggtgcagctttggagaactcacctctggctcttgtgcttttatgttgggacagctgcctaaattaggagctctagacctgttattggttcccaactgttggccagaatgaattcttcgaaaaatataggtggtttccagggaatttgaatgattgtattttgtgtccatggaacgtttatagacatggaggcaggcaataaattcctccaataatt

SEQ ID NO: 1927 - DNA, 2400 bp, Homo sapiens
atttcatgagtgtcatagctggtccttgtaacaatttcaaggactacatagccttcattgaggggaagcatatacacatgaagttgctggaggtgaactggaagcgaaaaggtttccacagcttgccagaaccttctcccacaggagctgtgatacacaagttgggcatcaccttggtgtctctccttttgtttttgacgctaacgaagacctttcctgtcacctgccttgtggatgactggtttgtccataaagcaagctttccggctcgactctgctacttatatgttgtcatgcaagcctcaaagcccaagtattactttgcatggacattagctgatgcagtgaataacgcagctggctttgggttcagcggagtggataagaatgggaatttctgttgggatctgctttcgaacctaaacatctggaaaattgagactgccacaagtttcaaaatgtacttggaaaactggaatattcagacagctacttggctaaagtgtgtgtgctatcagcgggttccatggtaccccacggtgctaaccttcatcctgtctgctttgtggcatggtgtctaccctggatactattttaccttcttaactggaattcttgtcacattagcagctagagcggtcaggaacaactacagacattacttcctttcttcaagagctctcaaggctgtgtatgatgcaggcacctgggccgtcactcagctggctgtctcttacacgatagcaccctttgtgatgttggcagttgaaccgaccatcagcttatacaagtccatgtacttttatttgcacatcataagtctcctgataatactatttctgccaatgaaaccacaagctcatacgcaaaggcggcctcagactctgaactctattaataagagaaaaacagattgatacctccaagagaagcggaacaagcaaaactgcagaacgttcgaaagatgagatgacaaggcttcaagggctcctccggtggcttagaggcgatgtttacatgcatctttatttcgttcttttttaaagtgcagggagtattttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcacccggccgggagtatttttataaagcctttttgtacagattaatcggccatgtccaggttattggttttgatattttataggacatttgagtggtgtggcgatgtgtagagaatgtgccagagctgcagagacagtccattctgggctgctggctttttgcccttcctgcatgatttccagctactgtgacctggatgctgggaacccaggcatcggctccaaaaattagaaggcgagtgctgagaagacttgtcacaggtttctcaaatcagaatatactcagtcatagtggttccctgggaagccccagaccctttgacttgtgacattactggtttgcagacataataactacactcagaggaccatggaggcagagggatcatggtttcagggcactgaaaactctacgagccaagaggactagtgcgtggactgaaagtcaggcatgccctcaaataggctgtattttctttccaggaatgtaacctttcccctttttcttctgacctgagccaagattggaaatcagaaagtctcctgtacatggagctgaagaggggctgctgtttcccgaatgttttccatttcacaggcgccacctgcttgcccggggttggtcttgagaagacacccaaatgttcatgcctcagaaaggcagcagaatgccttttaggaaattttttttaaagtaatttgaagttatatagaagtttggtaagaagaagcagttgtttctctcttttctccctcatttcatggaggtgttaatgatcatggctggccgtgatgtacacatgggctgattttcattttttcagtttcatagctgagaaattcagctttgttttagttgaatcatcatattggaaagcagacattgaaagttttcttttctatctttgttatgaatgtgctatggccccttttggagacttctattgggtaatattctatgtgagagaaggaaacttggtattaaatgttgtggaaaataataatgatgataataataaagtatatgctgcaatggtgtactgcc

SEQ ID NO: 1928 - DNA, 2245 bp, Homo sapiens
ccttctagcttcgttttctgccatatcttgtaggggtctccacatacttggcccagcctgctccctcagccagagactccccttcacaagttgtgcaccactgatagtttagtgatcctgccagtttcaattcattaggattcctacaatcaaaattaatcaccactgattttgtgttctcttggtattatgactcacacctcttttgaggaattattttattttccccaagctacgatttgtcttcttcctgcatattggatgctctttgaggtcaggagccccgaattggccatttgtttctgcctcttatgtaattcctttgcaccaggtagttaccaggtagttcattagatatgaactttctgaattggattgaaattgcaatagccagatggagataaacctctgctcatgcattatggaataagcgatgacagcgttaaaacattaagcattttcatttttgttatagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagttcagttgaaaggcgttttttgtgttcctactgggagctcacggtgatgtggggctctaggggggatgtgagaaatgtctcttctgttcattgctctccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcaggttaggggatctgattaatgtttcctttccttacaacagctagagaaaacatctcatcacaattggagacctctacttcctttgagctttcctactcaatggtaggagataggaatatgttccgcaaagaatgtctactgctcttgtccttggctgtgatccctatacatagtgtgaatttatatccaggtttcccaggatcaatattgacaagacgactttggcatctgaattgttttaatatctttactc

SEQ ID NO: 1929 - DNA, 2090 bp, Homo sapiens
acccttccagctgccgctgtcgtctttgcttcagccgcagtcgccactggctgcctgaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttcttttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggagaaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaag

SEQ ID NO: 1930 - DNA, 2372 bp, Homo sapiens
tttttgtttgtacatttttctcagaagagggttcactacttttatacaattctcaaaagatcccatgacccaaagaagatgataaatagtgttgatgtggcatccaccattaaggttaagtgtggtgtgccctgtgagtctgaatgtctacttaagaaccttaagtagacattaagaaccttaagaaggttttttgtttgtttttgtttttttgttgttgagatggagccttgctccgttgcccaggctggagagcagtggcgcaatctcagctcactgcaacctctgcctcccaggttcaagcaattctcctgcctcagcctcccgagtagctgggactgcaggcgcctgcccccaagcccggctaatttttgtgtttttagtagaaatggggtttcaccttgttggtcaggcttgtctcaaactcctgacctcaggtgatccacccacctcggcctcccaaagtgctgggattacaggcatgagccaccacacatggccgaaggttcttcttaagtggacattcagactcacaaggcacatcgcagttaacatcagaatcacttctgatgataatataagtgaagaatataagacaggaggcgcatatattaataccagcagagcagctcccagtgtgtctcttcagttggaacagttgttgcagtggtctacttgctgtccagaagcctgataagagaaaaagattcccatggagaaatgttcttcgaagtgataaccatgcttactcataaggagttgaaatgtagcttacctgctagttttcctccaataaaaatgtgtttatctttcattctgatttgttgtgaagcttttgcacactctaatttaaatcttggtagcatatatctagttgagtacccacagtgcaccaggctctattccagggcccaggaaatggaagtcagtaagacacgtggttcaagccctccctgagacagatggtagtacagaatggtatgtggtatgatgtgctgtagcacaagttgctggtagagtgaaaaagaaagcttctaccccagcactatcaaaccaacttcagaaacagtgaattacaggaaagattagtacttccttttaatatgatccattgttgagtgtcaaggaattgttattaattaacatccttgaatcttaggccgacatttaactgactgtcattgtaaggacactgtttgaagtacttcacatgtataaaaatttccacttaaaccatacatgcgttgtgagattggctcttagactttgaaaagttcatttttgtttacttcttttacagaattgatatataaggaagttatggacttggaggagagaaccaagaatggagttatacgggggcagccctctcctttaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccattggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtaacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttct

SEQ ID NO: 1931 - DNA, 2081 bp, Homo sapiens
tatttttaatacggtttttagaaccacagactatccctctttttagagcatcctgatcaattgcaagtacttccacttcttccctaaatgcgctttgtgtgttttccacctcagtagccttgcacacatcattacttctgcatccttctttgtgaccaagtgaatacctacctacctcttaggactcagcttcagtgattctgttttcataggctttttaaagcccttttcagtcaaattagatgctcctttgttctggtcctttactcttcccctcccatgttgtcgcactgatcacactgctttgtaattattttctttattgttggtaaactccatattttaaaaatttacctgtatacatagtgcttaatgcatggtaggcccttagtaatgtttttgaattaatgaggcatgattctaaatgccaaactttgcacaaaaagttgttgctattggattccaaactgctatgccctctataccagtggctgacaaggcatatagggatatatgccatcctgagaggagtaaagtgtttagattctgaacctgagaaaagagaactttctcttaagaagttggaaacttcattttaccttcgtgaccctggtagaccacttggtctcactggttggtacaattatgagggtagtactgggtgctttttatacaactttccatcccccacacagttggagaataatttgtagaccatggcagttaaaatgctttttactctggtgtattatagaataatgaacacatttttatatatgttaaagcctgctaaatcattcacttagaatgaagtaacctcaaggtaccaaataccccacataaggaaagtactacactaaattcactcaactattgtatgcctaccatatgccagattttatcctagaccctgaggatatagctttttaaaaccccctcctgtttcagagcttatattctagtggaggaagttagacaagcattttaagtaataaatgtatagagagtgtcaagtgatgagtaccatgaagaagaataaatgagggtaaggggctagtgtgatagggagaggggtgggatgccatcatatttaggggtggttgggaactgtctactgctttagcatttgtgtcttcaaatttctctcctttggttatataccttgcgtattccgcacattgataaagtttctttcttacagaagttctgatattgaattaaggaatgggtcactacttaagactttatcatttcagctacacataaaaggtttctctcccctatggattttgctaatggttgagtgatacctaaaggccttgttgcattttttacacttggggtttctcttcggtttgaattctctcatggttaccaaaactctgttaaaggacttttcacagtcgttaaatgtgtatggctctttcccaatatgaatttttttgatgttaactaggcttttagacttagttaaagacctgtgtgctctgctgcatttatagggttttgggctgctgagaataattgatgctgattaaggtgcaaatcatgactaaagacttttctttcttcttttgcatatagtagagtgaggtgagggtcgtggctaaaaccccacaataactttacattcctagctttacagtcttgctgtgaattctctggtgttcatcaaagtgtgagctgtgttaaaaggcattcttagattcattttaaccacatttttaaaaactcacagttggttaacatgatggtttcagattgcttgcctcttttctctttctaccttacagggctccttttctagcttaaataagggtactccatctgccacagaatccaggattctatagttttttagtttcacttccctatgttctttttttttttttaatttttaacaatgagatgataccatgttacagcggtattacattaagatacatttaatatagccacaattaaagtatgtattatgtatttatgctggtgttctttcatgttatttcttctagtgaaaatttccaagtaaactgttattgagcatatacatttttaaaaaaataaaaccatacacccct

SEQ ID NO: 1932 - DNA, 2093 bp, Homo sapiens
acgcacgcgcactgcgcccagcatgagggtcgcggctctgatcagtggtgggaaggacagctgctataatatgatgcagtgcattgctgctgggcatcagatcgttgctttagcaaatctaagaccagctgaaaaccaagtggggtctgatgaactggatagctacatgtatcagacagtggggcaccatgccattgacttgtatgcagaagcaatggctcttcccctctatcgccgaaccataagaggaaggagcttggatacaagacaagtgtacaccaaatgtgaaggtgatgaggttgaagatctctatgagcttttgaaacttgttaaggaaaaagaagaagtagaggggatatcagtaggtgctatactttctgactatcagcgtattcgagtggaaaatgtgtgtaaaaggcttaatctccagcctttagcttatctttggcagagaaaccaggaagatttgctcagagagatgatatcatctaacattcaagcaatgatcatcaaagtagcagctttgggtttagatcctgataagcatcttgggaaaaccctggatcaaatggagccttatctcatagagctttctaagaagtatggagtacatgtttgtggagaaggtggagagtatgaaactttcactttggattgccctctatttaagaagaaaataattgtggattcatcagaagtagtcatacattcagctgatgcatttgcacctgtggcttatctacgctttttagaattgcacttggaggacaaggtgtcctcagtgcctgacaactacagaacatctaattatatatataatttttgaaaagtgttttggaacattgttcattaaaccaccatttctatacaaaaaaattgcatagtattttctcagttactatgactagtttatttttttctcatgactcttatttttttagagaaacatactttcactagaagaggttagtggaaccatttattaattgggaaaatgtcgacggcatgttcattaatagtgccaactttcttggaattcactctttctctttcgataacacatcttccctatgacctttttttcttttatttcatctataaaccccatttctgtagcatttctttttttatcacactagtttcttttcctccttctctctttcttgctccaatccctaccaataatgtcatgatgcagaggcatttgaaaatgaagatgaaaagatggtcactttatttagccagtcaagcttattctactgggtgtcgccaaagcgatttatcatttttattttaaatatattcatggttgaagtgtttcaacgttattggacaattaggaagaatgtccttaactcttacaagttattttataactgatttttaaaatgctgtttttcagtattaactatgttgaccttagaaaacttttacaaaaaatagactttatgttttagaacagttttaggttcacagcaaaaatggagcagaaaatgcagagatttcccatataccctctacctccacacattcacagcctcccctaccgtcaatgtcttataatagagtggtacatttgttacaactgatgaacctacattgacacattattatcacccaaagtccatagtttacgtgagggttcactcttggtgttgtacataatatgggttttgacaaatgtgtaatgacatttgtcaaccgttatagtattatacagaataatttcactgccttaaaaaatcctctgtgttttacttattcatccctccctctcctttaacccttagcaactgatcttttcactgtgtacatagttttgcttttaccagaatgtaatgtagttgaaatcatacagtatatagcttttcatgcagtatatagcttttcagattggcttctttcatgtattaatatgcatttaggtttctctgtatcttgtcatgtatatgtagctcattttttttttagtgtagaataaaattttattgtctggttctaccacatttcatttgtccatgcacctattgaagaacatctcagttgcttccatgttttggcgattatgaataaagcgactataaacatccatg

SEQ ID NO: 1933 - DNA, 2065 bp, Homo sapiens
atagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtatataaatttacagcaagtacgtacactggaatgaatgaggcaatcacgttacaccaaatcagcagatcaaaagacaaacacatatttctgagacttgaaggtccacatccccccgccccctgccaagatggagtcttgctttgttgctcaggctggagtgcagtggcgcagtctcagctcactacaacctccatcccccgggttcaggtgattctcgtgcctcagcctcccgagtagctgggattacaggcatgcaccaccacggctggctaattttttgtgtttttagtagagacagggtttcaccatgttggccaggctggtctcgaactcctggcctcaaatgatccgcccaccttggcctcccaaggtgctaggatgacaggcatgagccaccgtgcccagcctgattgacaatggcctcttgaaggctgggttttcccagccggacagtgcccgccccacatgctccactcccacgctttcatctgcaggcctgccttcctctcagccacctcactgctgagctctgtggtagagaatttcctttacccatcagggtatggtctggctggtaatactgactccaacccagctccttcattttatagaaggaggcatttctgaatcatgcttgttcaccatggcgagactcactgcagaatttttaaccaccttattttaagtcattcattctaggaacagtcaagcccctaccacaaaggggccagatccgttcaagtgaggaagcacttgcagtttctgaattttgctgtatatttgtcctatgtcacccaacaggccctttgctatagctgggacattaccagaccccaataccttagggtctcacagcctgaaggacacagagcattgaattattaaaagacctgaaaatattataatgtttttcaattgtcacctgttttcaagacttaaatgctatagacttttctgcaggaatgacgtgtatattcctcactggcatttaccaaaaataaatgatggtttccagggaaaaaaaaaaaaaaagcatccctctggctccagagctcagagccacccacagctgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctaaaggacaccaccacccccatccagagcatgatgtgccagtacctggagtcctggtggaggacgatgagatcatgcagggattcatcagggctttcaggcccctgcccaggcacctatggtacttgctggacttgaaacagatggaagagccgtgccgtttctaggtgagctcctgcctggtcctgcctcctggctcacctccgcctccaggaagaccagactcccacccttccacacctccagagcagtgggactttctcctgccctttcaaagaataaccacagctcagaagacgatgacgtggtcacctgtgtcgccatccccttcctgctgcacacctgcaccacggccatggggaggctgttccctgggggcagagtctctggcagaggttattaataaacccttggagcatg

SEQ ID NO: 1934 - DNA, 2580 bp, Homo sapiens
atgtccttaagtcacagttaattcatttaatgcacactttaagtgtctactgtcaggcactgtcctagatgtgggaggttcagtaaaaagaaacccacatagtcacacagcctttgtggagctcacatttgaatgttgcatcaagtcgagttcacctgatgcattgttctttactccaaggtgcttccagctccatcaggaggattgggtgggtgtcctgggtccagaagaatggagactaccaacctctttgctcctattacaaccctcccttgcctgcaccacccactgcccttacttttgcatttgttattcacatcatagaatttaaagcaagtcacacggtttctcacattacctacattttactcagacgttctagttctcatacacattctcttacaaccttttccagggctaactccatggaatgatttttggtctttttgttttgtcttgttttgtttttgagagagagtcttgctctgtcacccaggcagtggcatggtctcagctcactgtaaactccgcctcccaagttcaagtgtttctcctggattcaagctattcaagtgcctcagccacccgagttgctggaattacaggcgtgcgccaccatgcccagctaatttttgtatttttagtagagacagggtttctccatgttgcccaggctggtctcgaactcctggcctcaagtgatccgcccacctcagccccccaaagtgctggggttaccggcgtgagccactgcacctggccgaattttggtcttagtaaaacttattcatttgtccagtaacttttcatttcaaagactgccatttcctagtcttgtccctgctcaatagcaacagcacttcacatacatcaacgtctccagcacctttcaaagctgcgaggtggctctagtattttagggaaggcctctgtccttaggaaaactgcaacccaggagagataaagtgatgcacgcctggaggcaggggacaccagcaagagaaacacagttctgccctggagcacaggcttttgttttgatacagaaaacactcaaacgtggcttgtgattttttcaaattacaaattgtgggattcaactggacctcagtaggaacaggccacagtctagagagaggatgatcaggtctatcagttagctctgctctgacttgctgtggtgtggctcaatgctcctgtctgcaatgggctggggagaaggaagaaggagccacatccatgggggagccacatccatgggggagccacatccatgggggagccaagagatgtcttggtattgcctcccactcctgtgtggaaagggcaggaaggggacctccattgcctcttggcactgatggcacctctatcctctgctcaacaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcag

SEQ ID NO: 1935 - DNA, 2403 bp, Homo sapiens
acacagagccgcctttcagccgcccgagaactgcccgccgcactccgcgactgcggcgcctgctctcgggccggggtctgcgcgcaccacgcggccggcagaaagggtaagagaagggaaccccgctttgcagggctccaacttcggcggacgcgttacggcgagggcgaaatgagtcggccgtgaacggtgtttcctgttccgaatcccgagagccctggaaagttttgaaggaggaggcatggcccggcagccttatcgttttccccaggcaaggattccggagagaggatcaggtgttttcaggttaaccgtcagaaacgcaatggcacatcgtgattctgagatgaaaggagaatgtctaagggaagacctgaagttttacttcatgagcccttgtgaaaaataccgagccagacgccagattccgtgaaaactgggtttgcagattttgaagatagtcatggtcaccacacagcttgttcgttttggtttaagtaaccagctggtggttgctttcaaagaagataacactgttgcttttaagcacttgtttttgaaaggatattctggtacagatgaagatgactacagctgcagtgtatatactcaagaggatgcctatgagagcatcttttttgctattaatcagtatcatcagctaaaggacattaccctggggacccttggttatggagaaaatgaagacaatagaattggcttaaaagtctgtaagcagcattacaagaaagggaccatgtttccttctaatgagacactgaatattgacaacgacgttgagctcgattgtgttcaattagaccttcaggacctctccaagaagcctccggactggaagaactcatcattcttcagactggaattttatcggctcttacaggttgaaatctcctttcatcttaaaggcattgacctacagacaattcattcccgtgagttaccagactgttatgtctttcagaatacgtgatgccaaaattgaagaatgtaaagacttgaacatatttggatctaaatctcacaaactatgatctctgcagcatttttcttggaacctctacgctcttggtttgggttggagtcatcagatacctgggttatttccaggcatataatgtgctgattttaacaatgcaggcctcactgccaaaagttcttcggttttgtgcttgtgctggtatgatttatctgggttacacattctgtggctggattgtcttaggaccataccatgacaagtttgaaaatctgaacacagttgctgagtgtctgttttctctggtcaacggtgatgacatgtttgcaacctttgcccaaatccagcagaagagcatcttggtgtggctgttcagtcgtctgtatttatattccttcatcagcctttttatatatatgattctcagtctttttattgcacttattacagattcttatgacaccattaagaaattccaacagaatgggtttcctgaaacggatttgcaggaattcctgaaggaatgcagtagcaaagaagagtatcagaaagagtcctcagccttcctgtcctgcatctgctgtcggaggaggaaaagaagtgatgatcacttgatacctattagctaaagttctgctaaagatgattaaagttcaggcatccttatccagcggctgagcagaggaaccccaaatgacttggacaagcagttccaaaatgactctcttatttaattgtggagtgggaaagaggactcacagttagccagctgaccatgactgaagttccagctttactttttataaacttgaatgataaagaatagaccatgggctactactgggcattagtgcaatataacagcgataataaaattctctattagtctgttaatttatgacatgatctcggaatggaaaaagatcatttcagagtgtgcgaaataatagtctttaaccatgtaattaaatatgtgtgtttattgtcaaataaggatttgttttaaaggtgattcttgggtttgaagacatttgttaattcatggtctgtacagaaatgaagctggttgcaataccaatctagagagtccaagctggcgaactattaagctgtttaaagatcacccttggcctggcacagtggttcacacctgtaatcccagcactttgggaggcctaggcaggcagactgagctcaggagcttgagaccagcctgggcaacatggcaaaaacccacctctacaaaaagtacaaaaattagtcgggcgtgatggcaggcatctgtagtcccagctacttgggaagctgaagtgggaggatcacctgagctctggaggtggaggctgccatgagccatgatcgtgccactacactccagcctgggtgacagagtgagatcctgtctc

SEQ ID NO: 1936 - DNA, 1935 bp, Homo sapiens
ttagatgttgtgccgatgtcattgctaggagcttttgaaacactttcactgtgcttaccttgcagaccatgcactcagtggcccggtgctgggccttctgggtttatgtcagaaatttctttgactttcactcacagtgagatgggggaagatgagggttaggaggatcccttggggtgtgtatgggcaaggtgggagcagggagccaggtcaggaggccactgtccccatccaggtgggagatggtgggggtctggacctggcagggctgcagaaatctgggcagtagccaggttctgggtatgtttttttttttttttttttttttttttttgagacagaatcttgtgctgtcgcccaggctggagtgcagtggcacgatctccgcttactgcaagctctgcctcccgggttcacgccattctcctgcctcagcctcccaagtagctgggactacaggcgcccgccaccacgcccggctaattttttgtatttttagtagagacgaggtttcatcatgttagccaggatggtcttgatctcctgaccccgtgatccgcccaccttggcctcccaaagtgctgggattacaggtgtgagccaccgcacctggccgattctgggtatgttttaaagatgacctgacagaccttgctagaggactgggcagagtgagaggggagctgaggatgactctgagggctgggagcagagcagctggaggcagagctgccatcatctgagatgagggcggctgtgggtgcagtaggttagtggaggggttgagttcaggacacatcgaagtgtctcctagacacgcaggtggaggtgtcaagaaggtctgagaagtctggagttggggggagaattctgggctgcaggcacactttggaagttgtcagggcatggacagtgcttatagccatcagctgttcggcctcacctggcgctcatggtttttttttttttttttttttttgagatggagtctcaccctgttggccaggctagagtgtagtggggtgatctgggctcactgcaacctccgcctagctggcttcaagctattcttcctcagccacctgagtagctgggattacaggcacatgtcaccatgcctggctaatttttgtatttttagtagagatgaggtttcatcatgttggccaggtcttgaacccctgacctcaagtgatctgcccagctcggcctcccaaagtgctgggattacaggcgtgagccaccatgcctagcctctggcactcatgtttacttggtggtcttgtaatttcagacacaccagctgccctcccaaggctggctcctcttaaggcttacccgtgttggctgccctcacatgatcctggcatgtagtcagtgctcaggacagttgtgtgtgggcagaagctgcgcagcccaaaggaggaccctcaggcccagggggttgagggatttgcctaagatcacgcagagatggcagctggcctgaactgcaacctggtgggggtgagcagcccacatgttacccgccccccgggctctttccaccatttcctgttctgttctgcagaactggccacagtgtcaaaaggctttggagaaattacagaagttcttggggtagacggaacctacatcaaagggaggcagatggggatgagaaaagcattcctgagtcaaggaatggaaagaaagattgctgctgtcctctcaccaaggacactctaaggccaggggccagatcttctgccttggctggcctctgttgagggtgggtaagggaaggaaggaatgctcagcttggtgttctcagcccccttgctgagtctgcggagccagagctacagctgtcttgatgctccctgagcaagtcccgagttgcctggtaccttgcagttcttggtgggagtttaactgcccagcattcccgttctc

SEQ ID NO: 1937 - DNA, 1795 bp, Homo sapiens
ccgggagtccatggcaaatgatgtggataaagagctaatgaagcagatcctctgccttgtcaatgttagtcacaatggtgtgagtgaatcagaactgatggaactctatcctgagatgtcctggactttcttgacctcccttattcacagtttatacaaaatgtgtttgttgacttatggatgtggcttgcttaggtttcaacatctgcaggcttgggaaacagtgagattggagtacctggaaggccccactgttacttcttcatacaggcaaaagctaatcaactatttcaccttgcagctaagtcaggacagagtgacttggagaagtgcagatgaactcccgtggctttttcagcagcagggaagtaaacagaagctgcatgattgccttcttaatctctttgtgtctcaaaacctttataaaaggggacactttgctgagttgctgagttattggcagtttgttggcaaagacaaaagtgcaatggcaacagaatacttcgattcattgaagcagtatgagaaaaactgcgaaggcgaggacaacatgagttgcttagctgatctttatgaaaccttggggcgatttctcaaggatctaggccttctcagtcaggccatagtacctttgcagaggtctttagagattcgagaaacagctttagatcccgatcacccaagagtagcccagtccctccaccaactagcaagtgtatacgtgcagtggaagaagtttggcaatgcagaacaactgtataaacaggcgttggaaatctcagaaaatgcttatggtgcggaccatccatatactgctcgtgaacttgaagcacttgcaactttgtaccagaaacaaaataaatatgaacaagctgaacattttaggaaaaaatcctttaaaattcatcagaaagctataaagaaaaaaggcaacttgtacggatttgcccttttacgtagacgggctttacagttagaagagcttacattaggtaaggacacacctgataatgctcggaccctcaatgaactgggtgttctctactatcttcaaaataacctggaaacagctgaccagtttctgaagcgttccttagaaatgagggagcgagttctaggaccagatcaccctgactgtgctcagtctttgaataatctggcagctctatgcaatgaaaagaaacagtatgataaagcagaagaactttatgaaagagctttagatattcggagacgtgcattagctcctgatcacccttctttggcatatacggtgaagcatcttgccatcttgtataagaaaatggggaaacttgacaaagctgtacctttgtatgaattggctgttgaaattcgacagaaatcttttggcccaaagcaccctagtgtagctactgccttggtgaacttagctgttctttatagccaaatgaaaaaacacgttgaagctttgccattatatgaaagagcattaaagatttatgaagatagcctgggtcggatgcatcctcgagttggagaaacactgaaaaatttagctgtgcttagctatgaaggaggagattttgaaaaagctgctgaattatacaaaagggcaatggaaataaaagaagcagaaacatcactcttgggtggaaaagctccttcacgccattcatcaagtggagacacgtttagcttaaaaacagctcattctcctaatgttttccttcagcaaggacaaaggtaatagcagcagttagaattctttgcaaatgtaccttaagacaaaataattaaacatttggaacatttg

SEQ ID NO: 1938 - DNA, 2039 bp, Homo sapiens
atagattgtttctcccccagacgtttatcttcaccgacggggacgaccctgagctcgagctccagggcggcgaccgtgtcatcaacaccaactgctcggcggtgcgcactcgtcaggccctctgctgcaagatgtccgtggagtatgacaagttcattgagtccgggcgcaagtggttttgccacgtggatgatgacaattatgtgaacgccaggagcctcctgcacctgctctccagcttctcacccagccaggacgtctacctggggcggcccagcctggaccaccccattgaggccaccgagagggtccagggtggcagaactgtgagtgtcggagcagacgccatcggagcagacgccttccttgacaccagcccgggaggcacagcagagggcgtggaaagctggcttgagaagggcatagggttgggggcccaagctgatccacccaggtggtttgcatgtggtgtttcaggagcaggccaggaggccctcaccgtactgggcagagagggggtgtctgggccaggtggggagggtctggaggctacgggtcaatggcctgcagaagcccccggctctttttgctccaagaagcttctgttacctgggtgggatctcctaaggggcagcttaagaaagatgcctggggagtcccatgaagagtcaggggtgagaagccctgtcctgggcagctctgaccaccaccccatcttcaggtgaccacggtcaagttctggtttgctactggtggggccgggttctgcctcagcagaggccttgccctcaagatgagcccatgggccaggtgagtgggggtccagctgcccgggctgggaggcggaggctgagacctgaaaggtgctgaccggcctccccccagcctgggcagcttcatgagcacagctgagcaggtgcggctgccggatgactgcacagttggctacatcgtggaggggctcctgggcgcccgcctgctgcacagccccctcttccactctcacctggagaacctgcagaggctgccgcccgacaccctgctccagcaggttaccttgagccatgggggtcctgagaacccacataacgtggtgaacgtggctggaggcttcagcctgcatcaagaccccacacggtttaagtctatccattgtcttctgtacccagacacggactggtgtcccaggcagaaacagggcgccccgacctctcggtgacaccaaccaccccgacccagggctgcctggctctgtcccaggcgcggggaaccagagccccctatgggctcagtgggctccctcaggtgccacggccacaccagtgagatgcaggcacctggcagaccctctggctagcctgcagccccccctctcccagcccctggtgggctgcggtgatgggtgttttgggagaacgaagacagccaggctgatggccagggccgcagtgcccctccccccgacccagccccaaggttgatcccacgggaacaggcttccaccccagcacttgcgcacctgggagggagctgccatccgggctccattacctgttgctgaaggcgggtgctaggctggctgggtgtcaaggagcaggctccaggccaaggtcctggcccagccacggccattgcaagggctcagcctggcaggctttgtgggggacgccgccctctctgccgcaggctgggtgcacggccgggcaccacagtgggactcaggcccgggaaggtcatgttctcgaccagagctttgctcccagtccaggcgcctcattcggaggcctcttgactgggaccacagagatgttttctccgctctgacttgtggctcaggactactttctgggtcgtgctcctgccccactgtgcctgggcccataaacaacaggagccttttgttccgctgacctgcccatcccagcagacccacctccccgcctggtgccttccatggagggaaatgggacaggggccgtcatctcccctctgcctcctgctttgctgttgccgagcacgagtaaagcttttgttcttac

SEQ ID NO: 1939 - DNA, 2546 bp, Homo sapiens
ctttgcagccactcgacccctggggctgccccgtgtgctggccccacccccggaggaggtccaaaaggccaagaccccgacgccagagccctttgactctgagaccagaaaggtcatccagatgcagtgcaacctggagagaagcgaggacaaggcgcgctggcatgtgagcggggcctgggagggcggcgctgccgtggggaaggcgggagcgtggcggagccctgaacccccagccgaccacgccccgccgcctccccagctcactctgcttctggtgctggaagaccggctgcaccggcagctgacctacgacctgctcccaagtaggctgggcaggggacttgggcggcgggcggtgaccccaggcggcgggtgggcagcggcctcatgcctcgccttacgccattgcctcagcggacagcgcccaggacctcgcctcggagctcgtgcactatggcttcctccacgaggtgcgctgggcggtgcggcgcggcctggcggagggggcgcacggggcaggccgcgcccctccgtcccccatgcctccctccttccgcaggacgaccggatgaagctggccgccttcctggagagcaccttcctcaagtaccgtgggacccaggcctgacccggagccccagccccaggggaccacgccggggtgctgcccgggcaggccatgttggggagactccagcaccgtggggctgccctcctccatgcgcctgggagcacaaaggccccggtagtgaaggaaccccccgtctcctgagagtggggctgaccctgccttgggcgccgaggggttggggggtgggtgtgggggagccgttaggcctcccaggtccttaggatcagggttgcccccagaaccccttcccatatcctccattctccgccctgagttcctacccaggctgcctggctggggccactgcctcctcagcatgcaggaggctgccctgtagggaaccccagctctggggcttgggggtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagagaggtctggagttgaggctgttgtcagcaaagcccctggtcccacacagctctgccctagagccacctctttgaccctttacccaccctgagaccagaacttgcagcccctctgcagatctcctctggccactgcagcccctccaatgggctttttctctcatgcattccctggcctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctctcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagccagataatacatgataatctccctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgcatatcaaataaattaaaggtacaaaatcgtgaatctcagttatcttaaatattccaatactatttacaaaattattcaaattctcacgccttccaactcaaaattagcaatctaaagtaatttccatatcctagatggaaaccctcatgctaaactgtctgattatgcatggttctaaatggtttcagtggcaaatacataacattgtactactgattaaactgaacttaaaagc

SEQ ID NO: 1940 - DNA, 2243 bp, Homo sapiens
cacgagagagacgaggtcactggaggataaacatccgtgactgcacctcatgatccatcacgcacgacggccgcagcatctcctgccagctgccggcacagacaagagcacgggatggacgaccgcggtagcaacgtggggctcatctgcctctctctgagcaggaagcccctcaggctcacacggggagccaccaggctggactgggtgcagcttacggacgtggcgcgtgctgtgggcgtcgggccgcggctcctccatgcagtactcacactgctgtctgcagatcgcacccaatcaggagggaatggtccaggcaggtgggcaaggccacggtttggccagggtggtcctgcgggcagtactgagcccgccctgctgggcaccccacagcccctgtggctctccagctgccactgaggccggacgcctcatgaggaggctcccatctgtgggtggcagaatgacggccccgaagaccccccgcttcctcacccgaagaccccccgcttcctcacccgaagaccccccgcttcctcacccgaagaccccccgcttcctcacccaaagaccccccgcttccttgccccgaagaccccgcttcctcaccctgggacctgtgagttcacacagcagcggggacctgcgactgtggacggcacatcagctccctcaacagggaggctgccctgggtgacccgcgagggcacagggtacctccgtcctgctgagtggaagagggaggccatggcggaggcgggcgtgagggggactggcctgccactactggcttcgtgaggggcccccagccaaggggaggcctcccgaagccggaagaggcggaaaatggattctcccaggagcctccagaaggaaccttggtgttggtggaatgggatgtgagaggacacgcgggtgatgtgtcttgggtcacaccagttcccggtccccgcaccagcccgccctgggcgggaagcctaagaggaatggaggggccatcgtggggctctcccggaaactggccccgggtgcctcggtccctgcgtcagtgcggggtttcggtggccgccctgctggctccgggcactccctccgtcttcctgccacgcggctggtccttcctgggctgggctgagtcaccctccatgcccacccgtcatacccggcaagagctgggggcgtgaagccaggcccaggtgggctgtggcggcatccaggtggaaggacgtggaggactcggaggcggaggggtctccagggcagggcagggccagttgcctggggccatctgctgtgtccaggagcccggcgctgccactggccttgccccaaggcccagctctgcccttcatcccttcagcacctccccgtaccttccttccatgggtcttaagctgtggcaagtccttaagctgggacggccagcgccagccctgtccccaacaggtcactcagcggctcggagcccacgtcctcctcggtgacacaggaaaatggtgcagttgtgcaagggcatgagagggtcccgtggaaggcacattccagaaggttctgtcccatggaaggcacgttccggaaggttccatcccatggaagccacgttccagaagtttccatgctgtggaaggcatgttccggaagtttccgtcccgtggaaggcacgttctggaaggttctgtccggtggaaggtcactctgtgcggtgtgcactgaccccagccagtggatgttccccgtccaagagcaaagctacagtcggctgcaggtgcagtgacttttgcacagtggaagaatttctccagaagatattcctgcaggtggaatcactggatcgtaggcccagatgtcttccacttacttgattttgcctgatgcctcccaaggaggctgtgcacagcaggtgtgagatgccccatctcaccaaccggccaacatcccgatgggagatgttgagttttcaccacgctgctgagtgtgacgtggaatcttcttattttagcttgcatttccctgattacaagtcaggtggaacatctcgaatatgtttctgggccatttgattttcctgcaagtcacctgttccagttctttgcccatttcctgttgggttggtcaatattttttgtgattacacgttggatacgtggctggcctttggcttgcctttgacttcgtttgttctatcgaagcatgtgcagaattgttaaattttaatgtattcaaatgcattaatctcatttctt

SEQ ID NO: 1941 - DNA, 2609 bp, Homo sapiens
catgctcacccacctggagcctactgggcaggaaatcccgtgttcacagctttctgtgcccctctggagccgagaccccgcccaggtcctggccctggccctggccctgcctcgctcttcctggccatgttccagagccgccatgctaaagacctggctctactggacatctccgagagtgtcctaatctacctgggctttgagcgcagtgaactgctttgtaaatcatggtatggactgctgcaccccgaggacctggcccacgcttctgctcaacactaccgcctgttggctgagagtggagatattcaggcagagatggtggtgaggctacaggccaagactggaggctgggcatggatttactgcctgttatactcagaaggtccagagggacccattactgccaataactacccaatcagtgacatggaagcctggagcctccgccagcagttgaactctgaagacacccaggcagcttatgtcctgggcactccgaccatgctgccctcattccctgaaaacattctttcccaggaagagtgctccagcactaacccactcttcaccgcagcactgggggctcccagaagcaccagcttccccagtgctcctgaactgagtgttgtctctgcatcagaagagcttccccgaccctccaaagaactggacttcagttacctgacattcccttctgggcctgagccttctctccaagcagaactaagcaaggatcttgtgtgcactccaccttacacgccccatcagccaggaggctgtgccttcctcttcagcctccatgagcccttccagacccatttgcccaccccatccagcactcttcaagaacagctgactccaagcactgcgaccttctctgatcagttgacgcccagcagtgcaaccttcccaggtccactaactagcccactgcaaggccagttgactgaaacctcggtcagaagctatgaagaccagttgactccctgcacctccaccttcccagaccagctgcttcccagcacagccaccttcccagagcctctgggcagccctgcccatgaacagctgactcctcccagcacagcattccaagcacacctggacagccccagccaaaccttcccagagcaactgagccccaaccctaccaagacttactttgcccaggagggatgcagttttctctatgagaagttgcccccaagtcctagcagccctggtaatggggactgcacgctcttggccctagcccagctccggggccccctctctgtggatgtccccctggtgcccgaaggcctgctcacacctgaggcctctccagtcaagcagagtttcttccactactctgaaaaggagcagaatgagatagatcgtctcatccagcagattagccaattggctcagggcatggacagacccttctcagctgaggctggcactggcggactagagccacttgaaggactggagcccctggactccaacctgtccctgtcaggggcaggccccccctgtgctcagcctggacctgaaaccctggaaatgccaggagctggacttcctggctgaccctgataacatgttcctggaaaagacgcccgtggaagacatcttcatggatctctctaccccagatcccagtgaggaatggggctcaggggatcctgaggcagagggcccaggaggggccccatcgccttgcaacaacctgtccccagaagaccacagcttcctggaggacctggccacatatgaaaccgcctttgagacaggtgtctcagcattcccctatgatgggtttgctgatgagttgcatcaactccagagccaagttcaagacagcttccatgaagatggaagtggaggggaaccaacgttttgaataagtctgtgacttaacgtcgtcaagtatggcatattgtcatcaagacgtggagccgctctccacccccccgggactgttggggggattctgagggccagagggggatatatatgattccccaggccctgcaggattttgggggggggggaggtgggagggcaagggaggggagcttctttttaaaatcaagagacttcgagcgatcccagtttccatttcaatctgtattcactcgtagtgagtttccttgaatgggatttcaagcggagaatgggggagtctcacttccccgccgccttgccccattggcctgggccagttctccactcctaggggccaagccacccctagccttggtgggggaaaggcagggcccacccgggccagcccgtgccctgaggggctcttgacacccacgtagaattctctacacaccagtaacgggatttcaattccgatggactctgccgccctggcggcccttcctgtgacttttgcgccccgcgcctggggtggggggtgcgaagagacgctacgttcctttccgatggaggaaggcagacctgccgtcacacgtgtgcttgcacgagtgcgtgtacctggtgcgggactcacccggccgccagactgcctgggcctgcccagatggccacctcgtggtgctgcggtgactttgtagccaactttataataaagtccagtttgcctttttggt

SEQ ID NO: 1942 - DNA, 2689 bp, Homo sapiens
ctgttcaaagagtttggcatcattctcgtcatagaagggagggtaaccgcagagcctgggcagggagaaactcatcctcatttccactttcgggtgccgttggctccggggtggagcactggggcagtctcaggggtcaggcaggagccatggaaggagttccccctttataaactctaccagccctgcctgctcactcctgttctagctacattatcctttctgttccttgtatgtgccgccatcttgccctcctcagggcctttgcacttgccattgcttctgcctatgccactctttccccacacctccaatgtctggctccctcaccactcggtcatcacctccacagcgagcccttccctgacctccctactgaaatggcatcaccccgtctccctattcctgcttggtttttctccgcagtatttatttttatcacctgacgtcagtttgtagatttatttacttgttgattgtctgtcttccctactagaaagaaagtcagctccctgagggcaggcactttgtctggtttgtgctgtgctaaatttaccccagtgcttgcttggcacagtgcttgaaacatagtatctattgaatgaagtaatactggtaattgattggtggaaggaagggagggagggaaggaagggagggcagagggagagcagaggaaggaagagaggaaagtaggcgagaggacaactctggagccacagcctaccatggccaagccccacttacaagatgtaggcgatgacacctatggaccagcaatccacagccttgctgtagggcttctgggccaggacttcaggggctgtggagggaagaggacgtggtggtgacaaatctctgcccttcaactcctggttccccccaccatcacagccccagcccagggccctccgcacccacgtatcccggagttccacaggcggtggagagcacactgcccgggtcctccatcttggagaggccaaagtcggagatcatgattttggagtcttcatccaggctgtagtacagcagattctctggcttgaagggcaggagggaagagaaggggcaatcagagatggttagaggctggtagaaccttctgccgctccaagcaccttctgagaaataatggatccccaaaagccactgtggcttcatggctgtcataagaaaatcaaggaagctctcaagaaggccaaaaattccaggaaggacaaggctcaggagggtgtgggggggaactgtctctaaacctcaggtgtgcactgtaaagccctaaaggaatgtttgaatgcctattttatgccagaccctggattagtgcttgatttaatgccatcctcactgcttccctgctaggccagtctgtataatctcacctaacagatgaggaaactgatgcctttggaggcaaagtgactcacccaagaacccacagttaggcagtagcagagccagaattcaaaaccaggcatgtcacaccccaagtgcccttctcctagaacggattgagatgtactgctaaatgtgagccccgtcgctatttccgaggagtaggatttcggggatttctggcttttttctttatgttttgctgtcccatccaagttttctacagaaggggaataggattttttgtttttattttattttttttgacatggagtctcgctctgtcgtccaggctcgctctgtcgcccaggctggcgtgcaatggcacaatctcagcttgctgcaacctctgcctcccgggtccaagtgattcgcctgcctcagcctccctagtagctgggattacaggcatctgccaccacgccgggctaatttttgtatttttggtagagacagggttttgccaagctggtctcgaactgacctcaggtgatccacccgtctctgcctcctaaagtgctgagattacaggcgtgagccatcctgtctggccagattttttttttttaatcagaaaaagacaaaatgttgtttggataaaatgccacacaattcactcgtgttcctttgagtatctggactagaatgggaggaggcagtttaaaggttacaagatccactttgtagatggaaatccaaggctcagtgagggggtgaaagttgcccaaggtcagacagtttggggtttgcaaaggccccacccctgggtaccctagctcaccacacccccttgagccccaccttgagatcccggtgtacaatgcccaggtcatgcaggtatttcacagcatccagcacctggaagatgaggcggctggcgtcccgctccgtgtagaagcctttttccacaatacggtcaaagagctccccacccgacaccctgcagcaggggatagggcagtctggcaaagagggttgggacagctgggagaggtgtgggggcagggcagaggttgggccactcacagctgcatgatgaggtagaggtggcccccactctcatagatgtcatccagggctacaatgttggggtgcttgatcctgaaaggagaaatgaggtggtttagccaggcatggcggtgtgcacctgtagtccaagctacttgggaacttgggaggctgaggcaggaggatcacttggccccagcagttcaaagctgcagtctgttatgattgcacctgtgactagccactgcactccagcctgggcaacagagtaagaccctgtctc

SEQ ID NO: 1943 - DNA, 1818 bp, Homo sapiens
tttcagggcgcactcggcggggcggctgcgcggctgccgggactcggcgcgggactgcatggaggccaaggagaagcagcatctgttggacgccaggccggcaatccggtcatacacgggatctctgtggcaggaaggggctggctggattcctctgccccgacctggcctggacttgcaggccattgagctggctgcccagagcaaccatcactgccatgctcagaagggtcctgacagtcactgtgaccccaagaaggggaaggcccagcgccagctgtatgtagcctctgccacctgcctgttgttcatgatcggagaagtcgttggtgggtacctggcacacagcttggctgtcatgactgacgcagcacacctgctcactgactttgccagcatgctcatcagcctcttctccctctggatgtcctcccggccagccaccaagaccatgaactttggctggcagagagctgagatcttgggagccctggtctctgtactgtccatctgggtcgtgacgggggtactggtgtacctggctgtggagcggctgatctctggggactatgaaattgacggggggaccatgctgatcacgtcgggctgcgctgtggctgtgaacatcataatggggttgacccttcaccagtctggccatgggcacagccacggcaccaccaaccagcaggaggagaaccccagcgtccgagctgccttcatccatgtgatcggcgactttatgcagagcatgggtgtcctagtggcagcctatattttatacttcaagccagaatacaagtatgtagaccccactccaggaatggagctcttcccagcctcccatctgactacagccagggtggggactcagcgggtataaagctagtgtgaccctgctcttccggctcctgggccagctctggaagggctgtatttgggcctaatcctcagcaactgttctaccactcgcaggggcaaaggtggtgagccacgggacgtccaaggggaggctggccccagcgcgcccatactgcctgcctcatgccccattctcagcctggctggcctttgcctttatgaatctgagcccctccatctgcctatagcaataggcacgggggtgaggaccctcacactctcatttgagcctccctgaggcagggagccaggaggcacctgaggcctatctgtgccttagtcacttcagctatgagccaaatgttccctttcctggaggggagaggcttcttactaggtaagagacaggtttcctctttccttatttcctcagctgtgccaacacaaaaaacaactttggcacaggtggtgggcagggggtagagagatttcagcttgggttctgcactaacagcctccaagccccctggcacttctgttgccctgagagtgtcccaggggattcagagtctccagaaagatatggctgggccaactctgttgcctacctggcctgacccagtcggagcctgacatggtggagggaaagggagacaagtggggctgcactcgctccagaggccagctaggagggaaaccgcagcttcctggggcttgtgtgtgaagattcctgacttaggggtggcttttgtttacaagatgcaagaggggaaacctgtctccgactcatcgagacaacatgcccagttatcagggagtcctgtgtcacaaggtctgtctctgccattgtaagcaagtgccttgggcgagctggcctctgccccacagtctcatctgtacaccgacagggttgatgcctccctcacagggttgagaacaagagccagttggccaagt

SEQ ID NO: 1944 - DNA, 2784 bp, Homo sapiens
agagcctaacctcatcccccggggagaacaccgactgagacctcaaaccctggctccagtgtcatggaatccgtcacctttgaggatgtggccgtggagttcatccaggagtgggcattgctggacagcgcacggagtagcctgtgcaaatacaggatgcttgaccagtgcaggaccctggcctccaggggaactccaccatgcaaacccagttgtgtctcccagctggggcaaagagcagagccaaaggcaacagaacgagggattctccgtgccacaggtgttgcctgggaatctcaacttaaacccgaagagttgccttctatgcaggatcttttggaagaagcatcctccagggacatgcaaatggtggaccccatgtgaagaaaggagagagggagggagaatgagcaacgagggcccggtgccctctttgtttctgtgggctctctcctttcagtacagggctccagtgccctccacagaactccacacccagcccagcaagcccctccataatgggtgctgagagtggcaggcatggggctcttgttacatcagagccccaggaaacaggcggtcacagactattctgagtgggcagaggaggtccacctatggacacacgtttagagaagctgaggagttcatccctgaagacatccagcccgtgagtagtagaggggccggggctgttcctgaggatgcagctggtgccctccatagaagagagggagacaccattgactcgagaggaccggccagctctccaggagccgccttggtctctgggatgcacgggactgaaggccgctatgcagattcagagggtggtgataccagtgcctacactgggccaccgcaacccatgggtggccagggattctgctgtgcctgcacgtgaccctgcctggcttcaggaggacaaagtggaggaagaagctatggctcctgggctgccaaccgcctgttcacaggaaccagtcacctttgcagatgtggctgtggtgttcaccccagaagaatgggtgtttctggactctactcagaggagcctgtatagagatgtgatgctggagaactacaggaacctggcctctgtggctgatcaactgtgcaaacccaatgcgttgtcttatttggaagaaagaggagagcagtggaccactgacaggggcgtcctctcagacacctgtgcagaacctcagtgtcaaccccaagaggcaattcctagccaagatacttttacagagatcctgtccattgatgtgaaaggggagcaacctcagcctggagaaaaactctataaatataatgaacttgagaaaccttttaacagcattgaaccacttttccagtaccagagaattcatgctggagaggcatcctgtgaatgtcaagagattagaaattccttcttccagagtgcccacctaattgtgcccgagaaaatccgtagtggggataaatcctatgcatgtaacaaatgtgaaaaatccttcagatacagctctgaccttatcaggcatgagaagactcatactgcagagaagtgctttgactgtcaagaatgtgggcaagccttcaaatattcctcgaatctccggcgacacatgagaacccataccggagagaagccatttgaatgtagtcagtgtgggaaaaccttcacgaggaactttaacctgattttgcaccagagaaaccacacaggagagaagccctacgagtgtaaagattgtgggaaagccttcaatcagccatcatccctcaggagccacgtgagaactcacactggagagaagccctttgaatgcagccagtgtgggaaagccttcagggaacactcttcactgaagacacatctgcgaacccataccagagagaaaccatatgaatgcaaccagtgtggcaagcccttccggacgagcactcatctgaacgtgcacaagaggatacacacaggggagaaactgtatgagtgcgcgacttgcggtcaggtcttgagtcgtctttcaaccctgaagagtcacatgcgaactcacactggagagaagccctatgtgtgccaggaatgtgggcgagccttcagtgagccctcatccctcaggaaacatgcaaggactcacagtggcaagaagccctatgcatgccaggaatgcgggcgagcctttggtcagtcttcacatcttattgtacatgtgagaacacacagtgccgggagaccctatcaatgtaatcagtgtgagaaagccttcaggcacagctcctcactcactgtacacaaaagaacccatgtgggaagagagaccattaggaatggcagcctgcctttatccatgtctcatccatactgtgggccccttgctaattaacttccattttgtaaaaatataaacacatggggctatgactttccctcgtaatactcctttagctgcatcctgtgtttcaatgtataatattttcattttggtttaattgtaagtattgtcttaacctccattatcgtttattctttgacccatctattatttggaattagatttttcaaaactaatatgtggatatattttcatagaggtataatgacttatagtgaaatgcatacatctgaagtgtacagttggatgagtttgacagatgcatacatgcatgtaaccaccaccccattccagatatagaatgtttctatctctctggaaggttcctgcatgttatatggctatttcttagttgcctttttgttgttggtttctaatttaattacatggtgagaagagt

SEQ ID NO: 1945 - DNA, 1841 bp, Homo sapiens
ggcagggcgtggtggcgggcacctgtagtcccagctactcgggaggctgaggcgggagaaccgcttgaacccgggaggcggagattgcagtgagctgggatcccgcccttgcactccagcctgggcaacaacagtgaaactccgtctcaaaaaaaaaaaaaaaaaaagcgtgcaaagatgcatatgatgaactgcattttcctcggagcagttggtattcccccctcctctcaccctctttgaacagacgggcattcggggaatggggggaggggacacagcatggcgggggttccttgctcccttagccagggcggttgactcgcaccctgctgcaggacggagaaggcagccgcttggaaaccccgggcttcagtcctcagccgggtctctggatgtagacccccggagtctgtcttctgagaccgacaaggcttgtcaatgggcaacacaggctccgggacttccggaaacagtttctcaagaaacatttctgaaactgcttggttaaggatgactcccgcaagggcggctgtcacctgcctgctgggcccgcaccgggagacttgtctacacataaactgtgcaggttaaagacaggccaggccaaagaaataagcttgcagaggagagagggttttcacctattttcttccctaccccaatccctgaaagttttctcagaacctggagggcccagcatgagcaacttcctgggctggggcttggccagggaggcaggtgcctgccagggcaggcagggaccactccctgtcatcgtaacaaaagataacacagaagcagatgggagagaagtctggggagaaacaacatgagcagaaaaccacagaaatgtaagtttacaacacccctatgttatcagccagggagccatggaggtgctgcagggcagtagcccgccagcaagacgccagatttctccttccaggcgctgagggaggggctggtggttcagccgaggggatgagaaaaccagcagcagctgcagcagttggtaaaacgggcacaccgggcgcggtggctcacgcctgtcatcccaacgctttgggaggccgaggcaggtggatcacaaggtcaggagatcgagactatcctggccaacgtggtgaaacctcgtctctacaaaaaatacaaaaattagctgggcgtggtgacatgtgcctgtaatcccagctactcaggaggctgaggcaggagaatcgcttgaaccagggagtcggaggttgcagtgagccgggcacagtggctcacatcttatcccagcactttgggaggccgaggcgggtggatcacctgaggtcagtaattcgagaccagcctgaccaacatggtagaacccccatctctactaaaagtacaaaattggctgggcgtggtggcacgagcctgtaatcccagctactcgggaggctgaggcaggagaatcccttgaacctgggaggtggaggttgcagtgagccaagatcacgccattgcactcccacctgggctacaagagcaaaacaaacaaacaaaaaaaacaaaagaaaagaaagaggccgggcgcggtggctcatgcctgtaatcccagcactttgggaggccgaggtgggcggatcacgaggtcaggagatcgagaccatcctggctcacacggtgaaaccccatctctactaaaaatacaaaaaattggccgggtgtggttgcgggtgcctgtggtcccagctactggggaggctgaggcaggagagtggcctgaacctgggaggcggagcttgcggtgggccgagatcgcgccactgcaccccagcctgggtgacagagcgagactccatctcaag

SEQ ID NO: 1946 - DNA, 2573 bp, Homo sapiens
tgttcaaacgccattcccagactgggcactcggcatgaggggtgcatgccttcgcgaaccgttcaggtccttccaagtcagtcacccactggtgcgtgtaccggggggccgcatcaggcacagcaggactgcacagctgtgtcccacaggaggagccagacagtgaagctcatcgggaaagccttccaagagaaataacacggggcggggatctgagagggcgatcgcagctgtaactaggacagccaaggacggcctcgtggggtaacatgggatctaagacaggaggaggtttcaagaaactgcgcagatctgaagcagcagcaccccaggccgcacaagcagcacacaccggggccctctgtcagctgctgtgtttaatgaacgaggaggaggtggtgtggcttggtgggggacaccaggaggaaatgagatcgaagggttggagcatgggtctgtggaccatgggaaccctggaagcactcggaaggatggggcctggtggaggaggactgggaaagccgggaagctgggtcaaggtgtggggtgtagaggcgccctcagatgtccacacggtccattggcctccggggtcctctgttcctgttctccctcaagccatgggagcttggcaagtgagctgggcctccacttccttatctatgacatagggagggtgcaggccccctgaggaggtgggactccgggctggcggagggggaatgtagggcagatggtcccaacaggccagaggccactggtgtcaggcatcagcagcttcctcctcagagtccaggtctgccgctgccttcgtgcccacggtcttcactccctgcgccgggaccaacaatgccctggctcctgagggctgcttttgacctgtgcggggagcagccccaacttggggtggggtcttacaggcttctggacctgccttttcctgacaattcaggtcagagtctcaagtcccctgggaggggccccaagcagctgtgaggcctgggtgctcggagcccactgaccgctagccttgtgcttgtccccagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctctcccagtcacatctggccagagggctgtctggacctgggccctgctcaatgccacctgtctgcctgggctccaagtgggcaggaccaggacagaaccacgggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcgagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagccgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacagggg

SEQ ID NO: 1947 - DNA, 2324 bp, Homo sapiens
gggcgcctgccaacatgccctgctaatttttctagttttagtagagatggggtttcaccatatcagccaggctggtctccgactcctggcctcaggtgatccgcccacctcggcctcccaaatgctgggattacagttgtgagccacggtgcctggccattttatgaggattaaataagcagatgtacataaacatggttagaagagtgcctcacacatgatgggtgctcagttgatgtcattcctctctgccttcctccttgaaagttttagaaaaagactcagtggaggagagagttcacgtgaaattattaggaccacagtgatcaggttacagaatggtgaagctggagatgactctagggtgcctagaggggggttcttaaattccacctttcccaggcatcacctaaaaatatactgacatagaaaatcttggaatgggcccctggaattgttagtttaacaaaaaaagttccagtagcctttgatgcctttttttttttttttttttaaattactgatctggtccaaaccctcattttatttttcctcaaaaacgttttttaaaacttttattccactttcaagagtacatgtgcatgttggttgtatagataaattactgtgtcgtaggagtttggtgtatatatgatgtcatcacccaggtaataagcatagtacccagtaggtagtttttcaatcccctccctcctcctgcctcccaccctgaagcaggccctggtgcctgtttttcccttctttgtgtccatgtgtatgtactcaatgccaaaccctcatttgagagatgagccccagaggggtgaagtgacagccctaagccatgcagaagtttcaatcaatgattcgttcatcattcaatatatgttttctgaacaccttctgtgttcaaggcaccatgctggcttctagggggactcagtggtgaaaagcctgaccccagtacctgttcttacagaactcatagcctagtgggagcctagatatcagacacggatcaggtagacagtatggacaatcatacatggtcataaatgctttccatcctgtacaaagtaaaggctgcagcatcagaggtcgcagggggacctgacttagattggggaaccagagaaggctcctcttaggaagtgacctttcagatgagacctgaagggtttgcagaaaagaaccaggtggagagtgggcaaagccagggaaagagcatggcacagttgaggcaccgagggggtgccagtttgactgacggaggcaagggagcgcccaggtggggctgcagggccgccatgcaggccttttctcactggtgttccccggttctgtccatagcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaagattgttggtgaattttcaaggccttcagtttatttccactattttcaaagaaaatagattaggtttgcgggggtctgagtctatgttcaaagactgtgaacagcttgctgtcacttcttcacctcttccactccttctctcactgtgttactgctttgcaaagacccgggagctggcggggaaccctgggagtagctagtttgctttttgcgtacacagagaaggctatgtaaacaaaccacagcaggatcgaagggtttttagagaatgtgtttcaaaaccatgcctggtattttcaaccataaaagaagtttcagttgtccttaaatttgtataacggtttaattctgtcttgttcattttgagtatttttaaaaaatatgtcgtagaattccttcgaaaggccttcagacacatgctatgttctgtcttcccaaacccagtctcctctccattttagcccagtgttttctttgaggaccccttaatcttgctttctttagaatttttacccaattggattggaatgcagaggtctccaaactgattaaatatttgaagag

SEQ ID NO: 1948 - DNA, 2350 bp, Homo sapiens
gcttttgctctgtcaggctggtggcgttttggtgtcttcgtttgttatggccgctgctgtcgctatggagacaggtgagtagctctctgatcttggagtcttcgcagatggaactctccttgacccagacctcttccccgtggcctccttccaggccttactcttggcagggttaatatttggacagagaggagagaaggctcttgtagcgtctagaaagactaaggtactctttgcagttttcctgatttggtttgttcgcacatctttgctattcagacaccaccccaccagctccctggcgtgggtgagactaagggagaggacttgtgtgttaaaccgtgtcctccttgattggttttctgcttctcacatgagcttgcctaagtttgagatatcgtcgccagacttgtgtatcattctgctactggtgcttcttttttttttttttttgagacagcgtctggctctgtcgcccaggctggggtgcagtggcgcgatctcggctcactgcaagctccgcctcctgggttcacgccattctcctgcctcagcctctcaagtagctgggactacaggagcccgccaccgctcccggctaattttttttgtatttttagtagagacggggtttcactgtgttagccaggatggtctcgatctcctgaccctggtgcttcttatatgcatgcgctgcatgatcttttaggctctccgcagtctcttgcatcctaagtttttctttactgattcagcccctagcgtttgcgaaacttaatcactgttaacagttgttacaacgcattattaaaataggggaagccacagttattgcagcctaccttagtgatcactgttaaaattcctacatagtggcccacgagtggtaggaattctccgtttgtgttgctgttttctttgatgatttctctttaactttagagaaacttctaacttactccttttaatcagggctccgcttttcttagatttcgaaggaaggtttatctcctcccactcctagtttaggaagaccatctcaacattagtcaggtttctttattgctctttccttactacaaatcagtattatatacagtgacctttgttttccatgatttttgctgtcttgtctcctagatgatgctggaaatcgacttcggtttcagttggagttggaatttgtgcaatgtttagccaacccaaattaccttaattgtaagttgttaagcacctcattaaattgagtagctattaatgatttctgacagaagagttgcagttcaaaatagtatctacttttacacattctcagttgaatgacattacacttatgctggtatatagatataattgcgtactgggacttgtgttttgaatccaatgtgtgttggtggtgggggtgttatgtaaatagatcctttatattaggggtaacaaatcacagtttaaggattggtttgacctacagatttttttttttaatgcttttcagttcttgcccaaagaggttacttcaaagacaaagcttttgttaattatcttaaatacttgctttactggaaagacccagaatatgccaagtatctaaagtaagtttaatttttataatcctaagcatgtgtatactttattatataatagatttcttagtttcacattggcaaaaatgtatttggaatctctccacttctttttgttatcaccgtcttaatacaagacaccctcatctctaacttgtaacactgcagtaatctactccctggttatctgtgcttccacttttaccttcctgcccccatctccaccccaacccaaaccaagcaaaacagctttctacacagaaaccagcttaatcttttaaaaatataaatcagaacactttactttcttgcttagaacctttcaatggctttccattccatgcagaataaaatccagtcttttttcttggactaaagccttatacgatctggccctgccttttctgaccttgtcttttaccacccttcccatctcaccaggtttctggtccctaagaactcacaatctgtaaatgtagtagcataagccatgggctgaaattaaaagagggtatctgtaaggaaggtgtttctggggttatttgaaggaggtgatcttacctgagtcttagagttgctgtcttttatttaaggcctcttatttgccaggaacagtgctaaatgcttcatatgcattaactcatttatatatatatatttaccattcaggtcgttcagcagacactttcatgttaaggcttactaagttgcaagaaacatattataaccacaaagcaattcccttttaatggttaaaaaaaaaaaac

SEQ ID NO: 1949 - DNA, 1891 bp, Homo sapiens
aagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaactacttccagaaagcatttgaggaagcaccagtacagggataagagatgaagagacaggccaggtcaggctcaccaagcaggcagccctttctgccccatcctgcacagtaagagagacttctcagggatccctctgagaagtgcagagccccagcttgacccctggtcccttctctgcagacacccagcacacgcgcgttctggtctggttcaaggtggaaacacaagactaaagctgccaggaggccaaggtgaacggcaatcatgtgattaacacacacacacataaaaagctttttgacagcgcccgctcggcctcagaaccgcccggagaggagccgccctggatggacagagggacgagggacgagcatctgccgtcgtgtcccggctgccctgcagtcgcctccaacacccgctgctgcccgcccgctgcctgcctgcctggcatctctctctcccggtcccggatttactcagaagatgggccccagagaggaggagaggaaaggaatacctgtcagtcaaacgtgaagcccactgatgacactgcctggcagagctgcctccggtcagcagtgacccttcaccccccagctcccaagtcctcttcctgagggagctggtccggctttatggaaggctccgcctgtgttcccccacctgggtccctggtccctcacctgtcacgtggggcgatggtcaccctccctccctgcctgccctgaaggatacactgagatgaaggtcaggaaatctgctggctgcagaaccaggggccatgcaggagtgagggatggtctggtcaagttgaggctctgccccagcctcagtttccccacacaggcatgagactgtcttcctgactttcagaggacagggctgagatgggatgagggaacacagggaaagcgtttagcacctctgagtgctgtgtggatgcgacctggggggtcctggcctccactctttaattctatctggactgtgtgccctcctacctccagtttccctgcgggggcctttcacagggcctggcttgcggatacggggtttggcgtagggcagtgcttctcaaatgggaaggcgcactgggattcttcaggttggggtggggcctgaggttctgcatttctaatcagttgcctaggactggctctaattcttgttgaatttacaatcacttgtggagttaagaaaaacatactgggccttggttgggtgtggtggctcacacctgtaatcccagcactttgggaggccaaggtgggcagatcgtgaggtcgagagattgagaccatcctggccaacatggtgaaaccttatctctactgaaaaaaaaaaaagaaaaaattagctgggcatggtggcgggcgcctgtgatcccagctacttgggaggctgaggcgggagaatcgcttgaacccgggaggtggaggttgcagtgagctgagattgcaccattgcactccagcctgggcgaaaagagcgaaactctgtctcaaaag

SEQ ID NO: 1950 - DNA, 2815 bp, Homo sapiens
gagcagagaagagggatgcatgtggacagccaagaagaagctggctgactgcgagaaggtggctgtggagttcgggaaccagctggaggtgcctgtgactcctgaagacacggtcgggtatttctcagagcagcagggtggcggcctggaggactcatagaaggagttctgcaaatgtgttgtgaaggggagctgcgacaccctgagcttcctgggtgagaggctggcctctgggggcctccacaccttggttttactcctttattcaatcacatgagactcctgaatctcagagcaggaagcatgtggagatcatttcttcagccctctgtcttcaggcaggtagaaggtatctgtcattctcattttgaagttttatgtaatgaaatgcagaggttatgtgacttgttccagatttcttggagtaaataaactggaatctgctcctcgctgtcctgcccttcgcgtggtgccagaggcagctcctgcgtgcacacctgtggctcaccagcctatctgctcctggggagctggggcctcccctggtttacatctgcatctctaggactcccacgctgcactctgcacactgagttctcaggagattcctgctgagcaaagaaggatgaattgtaggcctgcttttttttttttttttttttgagacggagttttgctcttgtttcccaggctggagtgcaatggcgtgatctcagtcaccacaccctccgcctcccgggttcaagtgattctcctgcctcagtttcctgagtagctgggactacaggcatgggccaccacacccggctcattttatatttttagtagagacggggtttctctatgttggtcaggctggccgcgaactcccaacctcaggcgatcctcccgtctcggtctcctaaagtgctgggattacaggagtgagccaccaggcttggccaggcctgcttttaaggatgccccaggtccagaaaatcagggccaggcctgggaagttcgctccttcaggcaggtgtgcgtcttcgtgtgagacttgatcagacctgggtttttgtagctaccccactccgaagctctcctgcgtgaacctggaattctcactgctttgggcagaggttcctccttcagaaaagggtcccagtgtgctgtgggaggcagggtgaggaggctgtccggcctcaggcgaggaaggagaagcacgtggaaggaagggcagcaggaagcctgagcctgactgccatggatggccagacccactcttgggcctcagtttcctcatctgtctggactgggccaggccaccaccaagccagatctggcaccagtggagaaaggagacaggcaggcaactgcagcctgcccagtgcggagaggggccagagcccgggcactgggccctggttaatggtggagccagcctggtgtgtggcagccaggtcgggctggtgtcttcagagtggctgtgtcagaagggcctcgtgtatgacagaaacgcaggccagctggaacgtccccaggcgttctgtcctggatcaagcaagaggaaggggcaagtgggaggagccagcagggcccacaggagaccactgtggcacacctgtgctcaggcagcatggtgctgggcgctgcaggggctcattaatgcatgagacacagattccactcaggagagagaagacgaacacagacacagtacacggtgggaaggggcacttccatgtctgcagccagagagccctttcagaatctgacccaaaagatggccagtattctaagaaaaagcacatatgcttacgatgtgcaaacagctgaaggtgttctttcaactatagtaaaaggggtgtctcggtggccacaggcggcccagatgaagagacctgtctgggccgcagagaggagtctggaggccccccgagccaggctgagccagccgctaggggcacggagcagtgcccaccttgcgcccagtgtggccagagcttcggccggaaggagctcagtgcgccgcaccagcgcgtgcatcgtggcccccggcctttcgctggtgctcagtgtcccaagagcttcacgcagcggaccacccccgccagccaccgtcgggcgcacgtggccgagtgcacctacacccgcgcccaatgcggcaagaccttcctccagcagtcgacgctcacacccactactgcgcgcacatcagggagaagccctacgagtgcgccaagctctttggccgcctgtccacgctgctggagcaccggcacatgcacacgggtgagcggcccttccagtgcacgcaatgtggctgctgcttcagccgcctgtccacgctgctggagcaccggcacacacacatcagcgagaagcccttccagtgtgcgcagtgcgacaagcgtttcacgcgtctggccaacctgaccgtgcaccagagagtgcacttgggcgagcgctccttccagtgcgcccagtacagcaggagattcatgcagaagcccggcttcctgcgtcatctgtgtggccactcgcaggagaagcactatccttgcagcccttgtggttcccatgatcagtggtgaaatatagtgattttcacctgtgcttccattctgaagttctggaaagaagtactggatggactgaagtccaggacaacgttccaaagaaaggcagagtccaggtaggcttggaggaccaagccctggatgagcactggagggcagaggcctcagtgtccagcactgtgccctgcacatggaaagcccctacgtttgtggaatgaatgaataataaaaatgttttcataagtgatgccattctc

SEQ ID NO: 1951 - DNA, 2543 bp, Homo sapiens
aattgctaggcggagacagtgcagggaagagagaccttagaaaggatcaggactggcgggaggtatttaactgaaaggaatatctgcttcactgttgcaaccaaaccagatgccttcttccacttcaccagaccgaggagatgacctggagaactgcattttaagattttctgacctggatttaaaagatatgagtcttattaatcccagcagcagtcttaaagcagaattagatggcagtacaaaaaagaaatactcgtttgcaaagaaaaaggtagaattcttatgaatgtttcatgatcatgtatgtgtggttaacgcagatacatttggaagtcggttatcaaggttgctctccagctcaaggcctttgccctttttgtcaaaaccaaagaagttccaacaaaaaggagttttgaatgtaaagaaaaattgtggaaatgctgtcggcagctattcacagaccaaaccagcatccatagacatgtggcaacacaacatgctgatgaaatttatcaccagacagcttctattttaaagcaactggctgtgacattgagcacctcaaagagtctttcgtctgcagatgaaaagaaccctttaaaagagtgccttccacatagccatgacgtgtctgcttggctccctgatataagctgctttaaccctgatgagctgataagtggccagggcagtgaagaaggggaggtgctcctttattactgctaccatgacctggaggatccccaatggatctgtgcctggcagacagctctgtgtcagcacctgcacctcacaggcaagattcgaattgctgcagaaggaatcaatgggacagttggtggaagcaaattggctaccagactttatgtggaagtcatgctttccttcccattgtttaaggatgacctgtgtaaagatgattttaagaccagcaaaggaggagctcactgttttccagaattgcgtgttggtgtatttgaagaaatcgtgcccatggggatcagccccaaaaagatctcctacaagaagcctggaatccatttatccccaggtgaatttcataaagaagtagaaaagtttttatctcaggcaaatcaagaacaaagtgatactatccttcttgattgcagaaacttctatgaaagcaaaataggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcagagtgttcatactgtggagcccgctgggaccagtataaactctgctctactcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctggtgtcttacctcacataagccatttgcccactgtgcaatatagaaaggtgttttcaaaagtatttggccgtagattttcacatccatcataaggttggcattcaataaggaaaaagttctaactccagtattaaattgtacataaatctcaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttgtaataaagtgttttataatacttcaaaagc

SEQ ID NO: 1952 - DNA, 2146 bp, Homo sapiens
tatttctccagtgctgctacagaatgggactttttgcttgaccttgtggaaactcatgggttctccaagttgtaaagagttaagaaaagggatggaatgtctggggaatgttgcagggaaggctgcagctctctgctcttagctttctcaccctggaggggatcccaacactcggtggtgcttctgggtctgaggtcttccctaagttctgtttgatctgccaaagagccagcctcagtccactgagaaacagggatgtgccgttatctgcacactgaggtttatttttaccttgtccctggtgagtccccagagacaaggagaaaacactttgggagggagttaagagccttttgcttatccttgaaggaaagcagtctctgaggattagtgagggtggtggtgagggtaggtagtgggaggagagtcagaggaatcagagttatttggactgcattttttccttgcctgattaaatcttactgacattggcactttgtgtcactaaaagaacacagccctggatgtggggccagggaccagagggttggcggcagagtctggggctggcatggctgctgggctgcttggctctgaggacccaccgtggagttggaacctgacttgtcgggcgctgaggacctgccaagtgaggaacattcgagttctgcagctgctgctaaaaccatggtgcatctccagggccgtctatcagatgacggagggccgccgatgtcaagtacatcttcttgatgacaggaagctggaactcctagtacagcccaagctgttggccaaggagcttcttgaccttgtggcttctcacttcaatctgaaggaaaaggagtactttggaatagcattcacagatgaaacgggacacttaaactggcttcagctagatcgaagagtattggaacatgacttccctaaaaagtcaggacccgtggttttatacttttgtgtcaggttctatatagaaagcatttcatacctgaaggataatgctaccattgagcttttctttctgaacgcgaagtcctgcatctacaaggagcttattgacgttgacagcgaagtggtgtttgaattagcttcctatattttacaggaggcaaagggagatttttctagcaatgaagttgtgaggagtgacttgaagaagctgccagcccttcccacccaagccctgaaggagcacccttccctggcctactgtgaagacagagtcattgagcactacaagaaactgaacggtcagacaagaggtcaagcaatcgtaaactacatgagcatcgtggagtctctcccaacctacggggttcactattatgcagtgaaggacaagcagggcataccatggtggctgggcctgagctacaaagggatcttccagtatgactaccatgataaagtgaagccaagaaagatattccaatggagacagttggaaaacctgtacttcagagaaaagaagttttccgtggaagttcatgacccacgcagggcttcagtgacaaggaggacgtttgggcacagcggcattgcagtgcacacgtggtatgcatgtccggcattgatcaagtccatctgggctatggccataagccaacaccagttctatctggacagaaagcagagtaagtccaaaatccatgcagcacgcagcctgagtgagatcgccatcgacctgaccgagacggggacgctgaagacctcgaagctggccaacatgggtagcaaggggaagatcatcagcggcagcagcggcagcctgctgtcttcaggttctcaggaatcagatagctcgcagtcggccaagaaggacatgctggctgccttgaagtccaggcaggaagctctggaggaaaccctgcgtcagaggctggaggaactgaagaagctgtgtctccgagaagctgagctcacgggcaagctgccagtagaatatcccctggatccaggggaggaaccacccattgttcggagaagaataggaacagccttcaaactggatgaacagaaaatcctgcccaaaggagaggaagctgagctggaacgcctggaacgagagtttgccattcagtcccagattacggaggccgcccgccgcctagccagtgaccccaacgtcagcaaaaaactg

SEQ ID NO: 1953 - DNA, 1871 bp, Homo sapiens
ctagcctggtggggcagacgatgcagcatgagcccagcgggcagcccagagctcaacccaccagggtgatcatggactccgtgatcacccccatctccacaccccgtcctggcctctgggggacctggcagggcaggctcgggcctggcgttcccaagcggggtgtgggtggcaatagttaccggatgaggtccaacagggcatcggctgagctcatgatgggcttcccactctgctccgtggtctccttctgggccgcgctgcctgggtggatgatggagaccatgaagatgcccacgatgacagccatgaaggtggttcacaggtagtacgccacggtgaggacgcccaggcggctagaggtcttggcatccagggaggcaagtccggacatcaagctgggagggcgagggggtcaggggctgtggtggggaggccagggcctggctggcactcagcgctcactcagcccctcctggccatgtccagctgcctcacagtgctccagggaaccccattcttccaacaatccagtcctgtgctccttccagcctctctttctgctctgccctctcccccacgccccggggcgcaggccacacacatctgtgccttgagacctctgcactgctaggcagagagcccaggccagggtggctgtgggatggtggggacactgttgggggagtgagagattaattaaggaaatgcgtgtgctttactttgttgcctcaagtttcccatgcttggtgtcctctcagaagcttccttcactctcctgacccctgcccagccaggcaggaccaagcttggtctacctctgagatctacctgcctctcccccagagtgaggagcccattctaggacccccacagcccctggctgctccatcaggacgctgcctgtctgtttgtgagaggagggatgagtctgacttccctgtgggtcccgagaggacggcactgcaggcggttcctgcgggctcctggacgagctaatgaggagtgagtgagagcgctgggctgggggctggtgacccaggtcctagtcccagctctgccaactggctgtgtggcctcaggcaggcaagtcacttccccatctttgggcctcaggatctccatctgtaaaatggggacatcttgggtttgtgcctgggcccaggctccttgtcacagggggctgtgttgagagggctgtgggtctctctcctctcggctcctccccacccctagccaccctggcctgggctttctgcctaccagtgcaggtcagccccagagtactggcgtcctggagccctggagccctggagccctagagcaacgcttcttgcagccgttgtggggggtgtgggacggtggggggtgtggggtgaagtgagattaattaaggaaatgcttgtgctttgctttgttgacgaaaggatttttccccaaagccctttcattctttcagataaagaagtatttgtctggttttaatcatgtaaacaagagcagataatccccagccacgctcctcttatcattagattccatgcagcagcatccagccccaggctgagcgtgaacaccggccccctcccccagcgggagccaccgcctgtgagggccctgccctgcctgctcgctggcgcaatggcttactcttctgattgagcccgtcttcttgtgtgatggagatgacacctcctggaggacccagcagcctcagaagccatcatctctctgggactttactgttccccagacacctgaacacccagcccagtggatccttaaccttctgagtgaagcactgtggagttccactgcgagccacatttgtaatttagaattttctagtggtcacattaaaaagtaaaaag

SEQ ID NO: 1954 - DNA, 2298 bp, Homo sapiens
gtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttatgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacagggtattgcccagggtgccatccggggggcagtggctgacacacgggacacagagcagactcctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccc

SEQ ID NO: 1955 - DNA, 2352 bp, Homo sapiens
agtgatagtccccttcagagcacagtctgaacagtctgaacaggaaggaggacttcggaggcatggtagccacggaaacgtgagcctcacctcttcagtgctgcccccagaaatccgccaccactgcacgtgcttcccagtgcaccatggacagcaccgctaagctcccagtgcaggactgttcctgggagacacggggccctccgagtatgcatctgacagcctggctgagcgcacctagaaatgcagtgcagtcttagatgtaccccaccttcgctgcccccctcccctgtgccctaactgtgttgatgtcctccagtgctcccagctccctcctgccctccctgtcttccctcacaggcttagtccctaatcaatctcttacctagctgtttccatctggatgtctgcttctcagaggatgccagtaaacacaggaggccatgagctcaccccgaggggttccattgctccgagcatctttggagcagccctcatgcagcatggggctgtgggctgcctgtctctgtggttcctggtgatttgggagctcgggagccacgggtcactccttagcatcatgtgcacaggtcacaaagtggagtccaactctcccagccttctcaggcctccagtgtagtgggaagctctgaaagtcagggcagcctggcttcacgtcaaggactttgtggagggaggcaagttaatgagcagcctccctgccacctgccagtccctactcagtgccgcccatccctgtgctgctgtgcctgctcagagccatctggctccctgggatttgagtctgctgtttctcctctctctctctgcaggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctcgcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcgcaagcctcagaactcttgagctgtggcttacttgctgtcttcaccaggttcaagctccgtgggccacactgctgctgtgccaagaaggtgtacagcctccccaggatggggcctcatacaacccctcatctgcactcaacatttaatcgtgtccttgctgtctttttattttcctttttgtttgttagcaaaaacctctatttagatttcaataatcagagaagtgtaaaataaaacagattatattgt

SEQ ID NO: 1956 - DNA, 2305 bp, Homo sapiens
atcaagggcccccagtcccgggtgccgcggggacagtgtagggtcattagctgttgagccgccccgggcgggcccaagcctttggatctcaggtgaccggcacaggcggccgcggggtccggaactgcttgttccggcagtggaagagacgcgccggcgttggccgctgctgctagcagcttgaaccccagggtcgggaccgatgtcggcttgggctgctgccagcctaagcagggccgctgcccgatgcttgctggcacgaggccccggggtcagggcggctcctccgcgcgacccccggccctcccaccccgagccccggggctgcggtgccgctccgggcaggacgctgcactttaccgcggctgtccccgccgggcacaacaagtggtccaaagtcaggcacatcaagggtccgaaggacgtcgaaaggagtcgcatcttctccaaactctgtttgaacatccgcctggcagtgaaggaaggaggccccaaccctgagcacaacagcaacctggccaatatcttagaggtgtgtcgcagcaaacatatgcccaagtcaacgattgagacagcactgaaaatggagaaatccaaggacacttatttgctgtatgagggtcgaggccctggtggctcttctctgctcatcgaggcattatctaacagtagccacaagtgccaagcagacattagacatatcctgaataagaatgggtaagtgtgcgtctgggaggagtggtaggggacagagcctttatgttccaattctctgcaaggcaagtactgttgatctctgctagtgtttcagggttttgttttttgtttttttgttttttgagacggagtctcgctcttgtcgcccaggctggagtgcaatggcatgatcttggctcactgcaacctctgctttctgggttcaagtgattctcctgcctcagcctcctgagtagctgggattaaagatacccacagccatgcccagctaatttttgtatttttagtggaggtgacagggtttcatcatgttggccagactggtctcgaactcctgatctcaggtgatccacctgcctcagcctcccaaagtgctgggagccaccatgcctggccatgtttcaggttttaagcacacttgctccttagcagaatctaatgagttaattgactttcccttaatgtagtttctactagcaggatcccaaagacttgttcatcggatgtagaaggggatctttgtcctattatccccatctgtagccatataatgcctaagtcttaaaatgctccaccaggactggcatcttaatggcacaggaaattatcagctaagtctgcttcctcccaactacaatcagggcagaaaatcgagcgtggggacattcttgggctgttcccttacccagcagcagctgcattttctccttgaggatgcgatctgctccatgtctgtgtgtacttcatagactgggtaagaaagagacagtgatagaatgatgagctttatggaggctgagcttctagaggcatccactcatgccagcctgtttccttccctgtcagaggagtgatggctgtaggagctcgtcactcttttgacaaaaagggggtgattgtggttgaagtggaggacagagagaagaaggctgtgaacctagagcgtgccctggagatggcaatcgaagcaggagctgaggatgtcaaggaaactgaagatgaagaagaaaggaacgtttttaaatttatttgtgatgcctcttcactgcaccaagtgaggaagaagctggactccctgggcctgtgttctgcgtcctgtgcactagagttcatccccaactcaaaggtgcagctggctgagcccgacctggaacaggccgcacatctcattcaggctctcagcaaccacgaggatgtgattcacgtctatgataacattgaataaccaggctacatgtgcccccgggttccttcctagaaatgtggcagcccattccagcacacaggcttctgcagcaatctctgagggtaaagccggtgggaggctcagcaggccaggaggcccaaggacaggacttgcgaccttgaagccaaaggaatctcacttgtggggcctccttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggcgattattggttgctgcg

SEQ ID NO: 1957 - DNA, 1685 bp, Homo sapiens
aatagcaccgcgagatctgttgaaacattgatttttgacgattccttccctgagaagagggcgaggagaagaagaaagaaaaaggggaactgaattgaattagattagcatgaaggaccttttcacgcggagactaaaagtactgcgcatgacttcctgctcagaaatatatgcaaataagaagacagatcctgaaagagcaagctaggagagtacaggtcgtgctgcagttagttcattgaaaactcatttgctcttggagcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcaaaagaagatgaagaagatcaaaacgaagagaaaggggaagctggaaaagaagacaaagatgaaaaaggggaagaagatggaaaagaggataaaaatggaaatgagaaaggagaagatgcaaaagagaaagaagatggaaaaaaaggtgaagacggaaaaggaaatggagaagatggaaaagagaaaggagaagatgaaaaagaggaagaagacagaaaagaaacaggggatggaaaagagaatgaagatggaaaagagaagggagataaaaaagaggggaaagatgtaaaagtcaaagaagatgaaaaagagagagaagatggaaaagaagatgaaggtggaaatgaggaagaagctggaaaagagaaagaagatttaaaagaagaggaagaaggaaaagaggaagatgagatcaaagaagatgatggaaaaaaagaggagccacagagtattgtttaaaactgccctatgtagtttcataatttggtaacatgtaccttcatgttgtaaagttaatagagataaatatttttatcaaaaattttataaacacagcctttctttagcattgatttaatttcagaacatcttcatattgattattagccataaagtttctaacatgaaacatttatctataaattttgtgattatagtagtggaatacatagaaaaaaatatgctttcaactttgtgagtgaatttcgtgttgtgtaagttatatgtcaaatctttgaattttaattttactcttttatacatgtgataatttcataaagtgagggatcccaaaaaaagagtttcatccaacattcttgttctgcaggttgcttttataaagaaggtgaactattttcatgtaatgttaagagttaaacttatctttcccaaatataactttattattagcttgggaaaaatgaaattgtattcccatttttaaaataaatacaaatgtttatttcag

SEQ ID NO: 1958 - DNA, 2508 bp, Homo sapiens
agacaggtctgcgactctggtcaactgcagctgctttccccggcctccaccgctgccgcacaccccctttgcctttagcattttcctcctctcctctaattgcgtggcgtccccagatgaatggtgctggaaggaaaccctgaagtggggtccccccgaacctcagacctccagcaccgggggaacaagggctcttgcgttctctcctctcccggtgaagatgcgcagccaggcgaggagcccatcaagtatggtgaactcatctccacgccgctcgtctccaaggcactgagtaaccgtggtcagcacagcatctcgtatacactgtcccggagccactcggtcatagtggagtatacacatgatagcgacacagacatgttccagattggccgctccacagagaacatgattgacttcgtggtaacagacacgtcccctggaggaggggctgccgagggcccttctgcccagagcaccatctcccgctatgcctgccgcatcctctgtgaccgccggccaccctatactgcccgcatctatgccgctggcttcgatgcctctagcaacatcttccttggagagcgagcggccaaatggcggaccccagatggcctgatggatggactgaccaccaatggagtcctggtgatgcacccggcaggcggcttctccgaggactcagccccgggtgtctggcgggagatctcggtctgtgggaatgtgtacacattgcgggacagccgctcagcccagcagcggggcaagctggtggaaaacgagtccaacgtgctgcaggacggctctctcatcgacctgtgtggggccacactgctgtggcgcacaccggcggggctgctgcgggctcccacactgaagcaactggaggcccagcggcaggaggcaaatgcagcgcggccccagtgccccgtgggcctcagcactctggccttccccagcccagcccgtggccgcacagcgcccgacaaacagcagccctgggtctacgtccgctgcgggcacgtccatggctaccacggctggggctgccggcgggagcggggcccccaggagcgcgaatgtcctctctgccgccttgtggggccttatgtgcctctatggcttggccaggaggccggcctctgcctggaccctgggccgcctagccatgcctttgcaccttgcggccacgtctgctctgagaagactgcccgctactgggcccagacaccactgccccacggcacccatgctttccatgccgcctgccccttttgcggggcctggcttaccggcgagcatggctgcgtccgcctcattttccagggcccgctggattaggctccctggggccccctgctgctgtgcccacctgcccacccaggtccccacctcctgcagcccagagggagctctgcatgtgggacactccctgctggcacagccacaccagatggacatgttggatgggctgtgcccttccccccaactgtggccccccaaggaggtccccaagatctccaccccagtcatgctgatggggccttcagcaccagctctgtcctgggtcgatggaggaaagcccagccccatggccttgcccttcctggggcatcccacatcgtgccgccgacactgtgtgcccctgggggagtgaaggggccaggggcctttgacccccagcttaggctggctatgccctgagcctgccaacccagtttcagacactcatccttcatccttcctgctgccgccctgggttcctctataaacctcgctgctcagctgcccccacaagtcccacatgccccgcatgcgtgcaatgcctccagcccccaagtgagtggtgggtgggtggcaggctgggcctagcacttgctgatagccactatgggctcgactctgtgctaagtggtatctggggacacagaggcaatcagacctggttccccccctggtggagttcacagtctagtggaggatagactgttaacaaatggcaacacggcttcatgcgtgccaggatcagagtacaaatcaggctgtggcaggcctcactggtaatggaaaagtgagggaggcttcacggaggaggtgtcataggagctcagcctcaacggctgctcggaaccctccgagtccacaagatgggaagcaagtccacaagatgggaagcgtgctctatacagaagggagggcctgtgcacgggctcaggtgtcagtaagccagaaatccagggacagagtcaggatggctggagcatggactgcggggggaacagagaagggggtggagcaaaaggttgggaccatgtgaccagggaagatgctggatggaggattctgaacctcatttgtggacggtcaggagtcaacaaagggaggagagaggactcactggtcaagagtgtcggctgtgacacaagggccatcatccctgaatgcccaccatgtgccccgcactgtgctgatgatgataataataactacgtccattgagcactctcc

SEQ ID NO: 1959 - DNA, 2405 bp, Homo sapiens
gtttatccttggttagactgtatttcctatatataatattttgagataccttaaatcaaaactttatttcttcaattatctttaaatggattttagtaaaagacttctcttccttaggattttttctcttggttcttcagatcttgactagagccagacagttggatgtgtgcttttttactgagtttgttcattgcttcatttgttccactatttatttaacaaatgtttataaagtatataccatgtgtcaggcacattgttacaattctatctggtatttttttttaatcatttcaggactggtgaggaatattttaatatctcaagatggtgttaaattgggatcatatgttttcaaaaaagaagcacctggctcattgtattgttctactctgaggcaaccttggggggccaagatccccatccttaagcttgtaaggatcatgatgcttgtgaagctgtttcaggtgttttgtgacacttacctgatgcttgctgcctgcctatcctaatgctctcagcaaggaggaactcttcagcgagcttctagtctctgttaaggcacttttaaatgtcaccacctttccccctcctgtcactcattgtaccatatccatactcacttcaaaccgtgtgagctacttaagtaagagttgtaaattgtgtgttttatctgatattgtcatggacttagcatgttagctgtaagccactctcatctctaaagctgttacgttaaaattatatttaaagctatatcaaaattgctactttgaatggtatataaattgacaaatagattgcctgttgtacaaatgagggaacttattgctcttcatctggagagctgctgccgccagccattttgctatcagcaaagcttccaaatcgcttctaacagtagtggcttgtgttgtaccctggcacaaagaaacaccttaccttaggtctcctaagaggtcagtgacagagatataaatggaatattggtatgtagctttaaagcagcaaagcttaaaagctgacattttgccttccctttttctctccatctttcttgttaaaggagtggttaatgtgttgctaacaactccactctgggtggtaaacaccagactgaagcttcaaggagcaaaatttaggaatgaagacattgtaccaacaaactacaaaggtatcattgatgcttttcatcagatcattcgcgatgaaggaatctcggctttatggaatggcacatttccctcattgctgttggtcttcaatcctgccatccagttcatgttttatgaaggtttaaaacggcagcttttaaagaaacggatgaagctttcttccttggatgtgttcatcattggtgcagtagccaaagcgattgccaccacggtgacctatcccctgcagacggtacagtcaattctgaggtttgggcgtcatagactaaacccagaaaacagaacattgggaagtcttcggaatattctctatcttcttcaccaacgagtaagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccatccttacaagccctggtcagtcaagtcccaataaatggtcagcac

SEQ ID NO: 1960 - DNA, 2049 bp, Homo sapiens
attgtagtaaccaggtcttccttttttttgttttttttgcgatggagtcttgctctcttgcccaggttggagtgcagtggcccagtctcggctcactgcggcctccacctccaggttcaagcgatttttctgcctcggtctcccgagtggctgggattgcaggcacctgccaccatgcctggctaatttttgtatttttggtggagacggggtttcaccatgttggccgggctggtctcgggctcctgacctcgggtgatccgcctgccttggcctcccaagtgctgggattgcaggcgtgggccactgcgcccggacccaggtccttctttatagctgccagccaaggtgctgctctctgctcctagagactgttctcagttctgtctcaaggacccctccaactcagtaactgaaaaccagcctcaagtcaaatctgtctcccactatgaacctctgatggccttttctagccaaagaagactctgctttcaaagggcttctgtgattaggttaggcccacccatctccctagcataaggtctgctgattactaactttaatgacatccacaaaatttctcttgccatgtcacataattatagcattaacaccagggggcagaggtcaggagaatcatctcagaattctgcccaccataggtgctgtgccaagggactcagagcacatgtgctgtgaacacattccttacaggatcactccctctgtgccaggtgccaccatgccagaaacagagggcaggacacagggacaggtggtgcattcacaaataatttggaaacaagccagatggtgaccagagcttgcctctgaatgccccttgttggggatgctatacagaaagcccaggatttttagctgaaccaacaaggaggctttgaaaaggtgacatctgagctgggttgtgatacacgtaaaatttcaagaagcaaagaaagggctggaactgagggtaaagaagggctatctgctcaaggcacacattgattacgaaaggatacatcagtattacgttaacaatgaacataattgtaagcttttgtataaaccagcctgttaaggattaccaacagaataaatgttagcatattttgaacacctaccaaatgccaggcactatgtatactaggtacactaggtatattgtattcctagcttatttaatcttcaaagaaccctacatggtagaactttttcttcttacaacttttttgaaatataatttgcatactagaaaaatcactcatttaaagtgtacaatttaatggctttcagtaaattcacagagttgttcatctatcactactaaaatcgaatctatcttagaacagttttattaccctcagaagaaattctacgccccttaaccatgacaccctaattactccctggcttccagtcctaggcaaccactaatctaacttctgagtgtggatttgcacattctaaacattttatataaatgaaaacatagaaaatgtgaccttttgtgtctggctttcacataatatgctacgtgaaaggtacatccatgtcttaacatgtgttggtacttcattcctttttattgctgaataatattccattgtatggatataccacattttgcttaattattcattaattgacagacatttgacttgtttctacttttggccattatgaatactgcagctatgaacactcacatacaagtttttgtgtggatgtatgctttcattttccctgggtatgtaacctaaggatgaacttgcaggatcatatagttaattctacatttaactgattgaggataagataggaatttgtatcttcactttaggattgagaaagctgaggctcaaagaagttaaaatagctgcccaagattatagaacagagaagattgaaacacatattcatcatacatcaaagctctagacttccatggctctacatacatacaaaataagacagaggtctcttttaacaagtctcatcttaaaatatacatttctcaagagcagaaatttttgtctgttttatctc

SEQ ID NO: 1961 - DNA, 2092 bp, Homo sapiens
gatgacagtggcgccggaagccggggccggggctgcggggcgaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacagggtgagcacgtggccggctccaggcgtggggtgggagcaccctgaagctgggatgtacaaggactcgaaggagagccagcaagagtgcccgcatcaccaggccctgtctctcctccttcgtcagaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggagtaaggaggcccttgggtgggccagcagcactctgcttcgacctctcagggcacagggcttgactgtggtcttcatttcacccagatgtacttgacttgcctgcagccctgtctcaagagcctcacacaggcttttggggccctcctctcaggtgctggctctcaggtcctagcccccaccagctctacactaaactggcccctttcttcccagatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgt

SEQ ID NO: 1962 - DNA, 2586 bp, Homo sapiens
ctaagtcatggttgtcttttcaatacctggtatggtatgaggcacaggatagttgctgacaaacatttgttagctaattatcatgtgctgggggagttggagggagattgaaccaataaagggaaatttgggtacttctgaatgtgccctctgatgagggactgcctgtgtccctcctcagaggctgtcccaagagaagcagacctcagattctgacagcgtgggtgtgggtgacaactgttctacccttggccgccgggagacctgtgatcacggcaaagggaagaagagcagcctggcagaactgaagggctcaatgagcagggctgcgggccgcaagatcacccgtatcattggcttctccaagaagaagacactggccgatgacctgcagacgtcctccaccgaggaggaggttccctgctgtggctacctgaacgtgctggtgaaccagggctggaaggaacgctggtgccgcctgaagtgcaacactctgtatttccacaaggatcacatggacctgcgaacccatgtgaacgccatcgccctgcaaggctgtgaggtggccccgggctttgggccccgacacccatttgccttcaggatcctgcgcaaccggcaggaggtggccatcttggaggcaagctgttcagaggacatgggtcgctggctcgggctgctgctggtggagatgggctccagagtcactccggaggcgctgcactatgactacgtggatgtggagaccttaaccagcatcgtcagtgctgggcgcaactccttcctatatgcaagatcctgccagaatcagtggcctgagccccgagtctatgatgatgttccttatgaaaagatgcaggacgaggagcccgagcgccccacaggggcccaggtgaagcgtcacgcctcctcctgcagtgagaagtcccatcgtgtggacccgcaggtcaaagtcaaacgccacgcctccagtgccaatcaatacaagtatggcaagaaccgagccgaggaggatgcccggaggtacttggtagaaaaagagaagctggagaaagagaaagagacgattcggacagagctgatagcactgagacaggagaagagggaactgaaggaagccattcggagcagcccaggagcaaaattaaaggctctggaagaagccgtggccaccctggaagctcagtgtcgggcaaaggaggagcgccggattgacctggagctgaagctggtggctgtgaaggagcgcttgcagcagtccctggcaggagggccagccctggggctctccgtgagcagcaagcccaagagtggggaaactgcaaataaaccccagaacagcgttccagagcaacctctccctgtcaactgtgtttctgagctgaggaagaggagcccatccatcgtagcctccaaccaaggaagggtgctacagaaagccaaggaatgggaaatgaagaagacctaggaagaggatgaggatttcattccaaaggaaataccagcttgtccacctgaggaagaaatgcttttttcacaaggagacaccaagagaagactaggaagtagccctcgttctccagggcacccaaaataccagcctttattgtctgcatgattttaggggatatggggagggaacaagtagaagggaagagggaaatggagagcatccttatgactttacaaagggtggaaatgaggatggagggatacagaagtctgcacagctgtaaaggttttatagatgtctttgccttcccttctgaggaagggaagaagtaatgaaagcacatgtgaataaccccttccatcccattcacagcatcgcactcccagtccttaaggcaaagggaggcagtgctgaagcattggtggtgcagtgtaaagagacaagacctgatcatctgatcacacttgtgccaacttgattcatattgggcattactaacaacccctgggcaaggtaaataggttgaacaatcaataacattatccctgcctgcatacatgtgaacaaaagctattgaggacatgcaaattctacagtcattcctcatatgctttagacagagtgcagctactggaatcttccagatttcagtgttttaaaatcagagctctgaatacacaaaaggaaagagaaatggagcggctgacatattttaagctcacagtgatactcagtgacaggagcacagagctctaatgtccacaggatgtcgtagggtagggtctctcagtaaatcaagtcccttacctatgttctgacactgaggctcttggagctatgggttagaaatccaggaggcaatatgtctttattctaatgaagtcctcatcttgcactcagaggcccactagtttgcccttctatatattaagtaaaaccaagagaaattaagaggatgatggcttctttctgtcacatgggtgctaaaccttttacaaacacttgatacttctatagagggaccaaggacctcaagtcctgggcagtctccttactgtgctactcactactgtctcaacactgtagtgagtctgtctttaacacatttccttccaataaagataaaaccactt

SEQ ID NO: 1963 - DNA, 2858 bp, Homo sapiens
agaaccttcccacaccgcaaggcctcctgatgccagcccctgcctgggaccagggcaacaggaaggggggccctcgtgtgagagaacaacttcatctgctgaagcaacagctaagacatctgcaagagcacatcctacaggctgccaagcccagggacacagctcaggggccaggaggctgtggcacggggaaaggccctctgagtgcaaagcaggggaatggctgtgggcctcgcccctgggttgtggacggtgaccaccagcaaggtaccagcaaggacctctctggggcagaaaaacaccaagagtctgagaagcccagtttccttccttctggagcaccagcttcactagagattctgaggaaagagctgaccagggcagtgtcccaggctgtggactcggtattacaaaagttcaaccgctgcattacctcccagatgatcaagtggttcagcaactttcgtgagttttattacatccaaatggaaaaatctgcccggcaagcaatttcagatggtgtcacagatcccgaaatgctggtggttctccgcaattcagaactttttcaagctctcaatatgcactacaacaagggaaatgactttgaggttccagattgcttcttggaaattgccagcttgacgttacaggagttcttcagggctgtctccgcagggagagactcagatccttcctggaagaaacccatttataaaattatttcgaaactggacagtgacatcccagagatattcaaatcttccagctatccccagtagctgtttcggggttaagatcccacaacgtgaggagtgactggctagggtttcctgggtttgtcttaaagggcaatttagctgtagtcatataaaaagggcacaaggaaatctcctctatcaaaacaggtactattaccattttgatcatttatttccctttccagaatcatcagaaatttaactataaaatgtactaactatattggtgtattggtagtatattgtaaaaggaacacaagtttccaatcagaagacttgaagctcaactccattgtttccaggtgttgtgaccctgggaacttcctggtatctctgtatctgtaaaatgaggttgttaaggattaaaggacagtatgtcctatgcaatgtcattcacacacaaatgtcagtttttttgagcccctctttcagataaggttatcttatttggggtttttacaaattgctgtttttagtcacctaattataaagcgccatctatttgctagatactttcacatactttaagcttttcaccctgaaaagtagttattatcatcatttaaaagatgaccaaacagaagctttagaactgcaaggtaactcgccaaagcctatgaggctaggacatctgggttgatagggacagtcaggagcctggaggaaccaagactctctgatgcccaactgcatgctggacccatctcctgcagctaactcaggatctcaagcaggaccccacccctagtaagcatccagcgctgacagggcaccgtcacctgacaactcctgcccagcacttaggagcacttcaccgcccaagatttctgctgatcatttcagcaaactcaagacaaactttatgcaggacttgagtgttgctgtttattcacatttgtctgctggaagagtttatcagctggataatgcaattggtgccccaacctcatatatgcagaagaagctgaacttcagactgtgaaaggtagaaagggccttaggagatcatctggcccatgctgcttaaattgggaaggaagaaccgcagtccagacaggaggcttgcacaggctgtgcacagccttgcagatgataaatggcataactgggacaaatgcagcatcacacagaaatggaaattctcccactccataacaaaattacagtccatggctgaccttccactgatgaaggaattcatgaaatcaacatttccccctgctgctggcccagcacaattgtgacccactcttgagtatataggcaaggcatgtacaaagctgagtaactgcatctgtcttctaagctagtcaggatcaagtctttgtaagcactgccaaaggtacgccgggtggggtggggtgggggtaatacacagctcgggctttgtagtcctgataaggggtgtctgtgagttcattagcttctttcctgtctatataaaacaagtttcatattcggctactcaacttccataatttttctggtggggtgttgctggagcagatgagataaaatccctaaactattactagaactatcagcataaaaagtatgaaagatgaattttcctttgaattttctcttcaaacagctgaaaggaaaaacaaaacagacttagcccaaacccatctttacaggctaaaggttaagtgccctccagtacatccaattgcactcagaagatctttgccctattttcacaaaaatgaaggaatctgccaaacctaagttttaaacacaggcaagcatggagtgctctgagcaagggcaatcagttttctgtgtccggacatagtagaagaaccctctatccagagtgacattacatacctaagttagacatacaggggaaacaagttcacatgactgtccaatagagagcagcccttcttctgtcccaaacctgaaattcattagtgtgtgtttaaagactgagccaagtcacctccagggcagtgaaccttgtctcagggaccaatgagatgaaatgtacaagctcaaattgaaaacatttgtgtactgcagtctttccaggaagtgttctctaaccactgagctaaacacagaagaatgtataaatatgtatgctctgcc

SEQ ID NO: 1964 - DNA, 2355 bp, Homo sapiens
attagaattcctgttgttcgttaagctcttaccatgtgctttgcacacatgggtgtatttaatccttaccttctgaggagctggtgctatgaggggaggaaagtgaggctcgaagtcatacatctggaaggtggcaaagttaggggctggcctcaggtttgtctggctccaaaacccatgtccttcaacactgtgctgtcctgcttccctcgggggtgagttcttcatcaagcagataaaaaattcagtgaagaagctgagatgaaccagtcattctgctagtgttcagttaccactggcgtgtgaactgagcaggatggggtctggggcgacctcctgggtttggacgtgtcctgttagcgacagagtgattgagggtttcatctgccaggagacgcttctcagaggtaagggactgttttccagcttcagcatgacagagctgtctgagttctgcttgctcacaccctggatacctgtggaggaaggaagaaccttggagaggactggagatgggagtcatcttgcttcccagacaggcagggtctcagtgctgctgctggcagtgcatattgcctggttcttgcctcaggcagcagactttgcattttaaggtctttcctaaatactgtctagacccacaaggaaactcctgggttgtcatctaagaaagaaattgggtttgatttttacccaagtgctttttgtccctttgatcattgcaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggttggaccggtggccattctcagacccagatgttgaagggcagcttcccaggaaaggaggagaacagggaaaagaatcactggtgcaatgtgtgaagagaaacatggacgtatctggctccaagatgctgattctagttagtaatggtgctgatccaagaattggtttccattgcaggcacgcctcttctgggctgctccattcctacctgcaaggctgggttttctcagcctgtcatttttgatgtcacaccaggctgtggttttcattgctttggcagagggaggtacagagtcgtggagtcgggacagacattttgctgtcagctggaagagctgatctgctggctgtataatgttgcagatgttactgaccacgggactgcagccaggtccaatcttacaagtctcaagtcttctctgcagctttaccgggtaatatgcggtcctggctctggcttgttccctcacaagagtgtggctaaattactcgattacaaagtaaaatctcaaat

SEQ ID NO: 1965 - DNA, 2364 bp, Homo sapiens
ttttggccctttgccacttcctctgcacaaatcacctctgtcacccacttgaagttcccaaatgctgggcccagcacatcttttcactccataccactggtcagctgtggtgctggctgcccctgtgccagggccctgccttaacccagttctctgtgacctgggtggtggcggagtggggagtcacataatactaagcatggctgtcctaggactcaccctgcaccagggccctaggcagggcaggcactctgtggccatgtctgacatagcctggtcttgggagtgctccgggcaagccaagggagatggcatgatttgggccagagatgggggcagagggcataacagacaggggcagggcaccacctgggccccgggtggcagctaagaggaccctgacaaagcgagttgtgattgagggtctgtgggcagaggagcaaggtggccagagcctggcgtgtcagcacggagggggcgctgcagagggtggcggctgcttctcatccccaggcgggagtctcagggcaggggagaatgttttgaaggaacatcacaggaaatgacaaggccttgggggatgggatggggacagtcaaagatggcttggaatcatcaagggcagcagggcacccaggggcaaggagagcagacatagctgccgaaggggcggacatccaaggttctttggaagctgagcgatgccagcatctggagagtgccaggctgctgggtggtgtcagagcctggaggaaatgttaggactagagagaggaggtgccagccgagggcatgaggctcacttggagcctggatcccaaggctcccctgaagagggagcaggaagggagctgagagggtgacttggagcagatgggtgccccaagaaactcagtaaacgcagaactccctgggctggacaccatgctgcggggaggcaataacccactcaggatcactgtgccaacctcctggactcttatcacgttgctcagccccaaagatggcccacacagggaccaccccctgggcggcgttcaccccatggagttgggccccacagccactggacagccctggcccctgggtgagtgaggcaccagggggaggtggagagggaagggagaagggaagggctcatgcctcctgcctccttccagatgggcagcacccagtcaccttgagtcccctatgcccctccccagccccagggtctcctgctgaccatattcacaacatttaccctccaccatttctcccagaccctgagaactctcatgagcccagcagccaccctgagaagcctctgccagcagtctcgcctgacccccaagcagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacactcccctgcagcctggctggcctctgcaaacaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagccggggtaggaggatcaccagaggccagcaggtccacaccagcctgggcaacacagcaagacaccgcatctacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaagacatatt

SEQ ID NO: 1966 - DNA, 1866 bp, Homo sapiens
gaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacttcaacagattgagagagttcacactggagaaatactttcctctggcaaacccctgtggcagggttttcagtaaaatgttttgcctcatcgtgtgctaggaaataatgcagaaaaaacttatgaaaacattcaatgtagaagacttttaggaaaatatcagagaatttaatgaaggaaagaagccttggcaaaatgatggatgagagctttctgtcacaattctaaccttaacagataatatgcctcatgtgcatttgggaacaggatagcttgagccatattcctagttgccttgtcactgattttatacattttaaattgtgacttcctctaatcacgaactaaaatttaatattgtatataataccggagtattttatgcctgcctcattttattatatgattagctcctgcatttctttggttctaagtttgtgttatttcagaataactaaagtacttcagaatgaaactggatacagtatattcagttcataagtgtaattgaccatacttgaatatgtttaagtttataagtaacatcaggtgttatgaaattaatataaataagatgtttttgtaagtttttattttgaaataagtttagattcacaaaatcttaccaaaatattccagagttcttgcccttaacccagcttcttccaaagataacaacttacataagcatagttcattaccaaatacaggaaagtgaaattgttacaatactgttaactacagaatttatttggaaatcaccagttttaacatgcatgcatttttgtttgttttttatatgtagctttaagaaatcttaacacatatattgattcatgtcaccaccaccgtaatcgagattcagaatgttgcatcaatgcaaactccctcatgctccttgtttatagtcacaacctctcctcagccctaacccttggcaatcagaaatcttttcatctttagttttgtcattagtagcatgttataaaaatggaatcatacagcatgtacccttttggtattggctatttcaactaaagcagattaacctgaaatccatccaagttgttctgcatatcattgttctgtttttattggccactaataatctatgatacgaatataccactatttgtttattcacccactgaaggacattagttttgttcccggtttttcttactgttacaaataaaaatcctatgaacatttgtacacac

SEQ ID NO: 1967 - DNA, 2383 bp, Homo sapiens
agaggcgtacaggcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaagaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctggatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtcaaaaaaagaattgagaattttattctgtactttttaaaatttaagagccagggagttgcatcatgaaagcctttgtataataatggaaattttatatgggtaagcattttcaaacacatattagtagatacgttttttaaatttctattttcacattgatcagtgttactttgcttaatacttaggtagcccttatgtccactaaagtaaatgcttatgttgtagaagcatcgaacatcaaccaatgtcatggcacagcaccaaagattgcaaatacctcactatggtgcgcttagaaattttcaaattgataacctatagatacggctgcaggtgaattcatgatagtgaaatcagctaagtatacttaacctcacaggctagaaaggtttactgattcttgtttcacctggcacccaatgtggataccctcagtaagactcagggagccttataactcctcttaacatatgcttacccatgcttaaattctagggaagctgtatccacagccctctgcattgcagccatgagagctctcacgctttcaacccttccataacctaatttagtcatttgggcctctcaaaaggaaatgcttttgtttaaataggtcttactcatccagttccactgaagaggacacttcaaaacaaaagaaacaaaaatatctgaagaaag

SEQ ID NO: 1968 - DNA, 2239 bp, Homo sapiens
acttcattaaatctagaggcagttgagcatgggagccgtctgtatgttgaattagggctcgcactcttgcgcaacacgtcaccagtcggaaactgggggtttgcttctgtgatttatttcattattgtgctggtaaaaggtttggaagggaattctttttgggggtagtactttagcattgtgtagcaagttttggggttttttttgtatgtgaccccccagcccccagcgctgagtttgagtcagttgagccagtttagtaaataattttttaaaataaaagaacagtttaaaatctccatgaataattttacttacatgcaggagtaatcttactctactctttatgtgcgaaaagcattgggaagtgtttagtgaattgatttccattagaaaaagacccttagaaatcacagaacataaagcactgcatatggatgtgtttggggtctttggggaggagggaagatgttttgtagctctctgcattcctgcataaaaccttagtttgaggggaataatgctgatgaagagactagcagctcgctgctttgctggcttgttaattttatccccactaactgtgatttctgatagccggcctgctgatagtggtaaggccatcgaagacggcgatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagagaaagatgaagaagagtcagagtccgaggcaaaatcagtcaaggtgaaaattaagctcaataaaaaagatgagaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgac

SEQ ID NO: 1969 - DNA, 2668 bp, Homo sapiens
ttagctatgggagtaaatttgcctgctcacctagtagttataaaatctacaatgcattatgctggaggactgtttgaagagtacagtgaaacagatattctacagatgattggtagagctggtcgacctcaagttttgcatctggattgaacaaagatggaattgaagcaaaattacaagaattatgtttgaagaatctgaatgatttatcatccctggacttaataaagatggatgaaggtgttaatttcaaaccaactgaagcaggaagattgatggcttggtattatattacatttgagacagtgaagaaattttatacaatcagtggaaaagaaaccttatcagatctggttacattgatagctggctgcaaggaatttctagatatacagttaaggataaatgaaaagaaaacactgaatactttgaacaaagatccaaatcggataactatcagatttccaatggaaggaagaattaaaacaagagaaatgaaagtaaattgtcttattcaggctcaactaggatgcattcccatacaagattttgctttgacacaagatactgcaaagattttcagacatggctcccgaattacaagatggttgtcagattttgtagctgctcaagaaaagaagtttgctgtactattgaatagtttgattttagctaaatgttttaggtgtaaactttgggaaaactctctgcatgtatccaaacaactggaaaaaattggtataacattgtcaaatgcaattgtaaatgctggtttgacttcctttaaaaaaatagaagagacagatgcaagggaacttgaattgattttaaacagacatcccccctttggaacccagataaaagaaactgtgatgtatctaccaaaatatgaacttaaagtggaacagattacaagatatagtgatacgacggcagaaatattagtgactgttatattaagaaattttgaacagctacaaactaaaagaacagcatcggattctcactatgttaccttaatcataggtgacgcagataatcaagtagtttatctgcacaagattacggattctgttttgctaaaagctggaagttgggctaaaaagattgctgtgaaaagagctcttaaatctgaagatcttagcataaatctaataagttctgaatttgttgggcttgatattcagcagaaacttacagtcttttacttagaacccaagaggtttggaaatcaaatcactatgcaaagaaaatctgaaacacagatttcccattctaaacattcagacatatctacaatagcaggacctaataaaggaacgactgccagcaaaaaacctgggaaccgagaatgcaatcatctttgtaaaagtaaacatacatgtggacatgactgctgtaaaattggagttgcacagaagtcagaaattaaagagtcaacaatttcttcatatttatctgatttaagaaacaggaatgctgtttcatctgttcctccagttaaacgtctgaagatacagatgaataaatctcaaagtgtggaccttaaagagtttggttttactccaaaaccttcccttcctagtatatcaaggtcagaatatttaaacatatctgaattgcctataatggagcagtgggatcagcctgaaatctatggaaaagttagacaagaaccatctgaatatcaagacaaagaagttttgaatgtgaactttgaattgggaaatgaagtttgggatgattttgatgatgaaaacttagaagttactagcttttcaactgatactgagaagacaaaaatatcagttttgtttcatcacatgagatgtcggatatttctttatcaaattctgctatgcccaagttcagtgcatcctccatgacaaaattacctcaacaagctggaaatgcagttattgtccattttcaagaaagaaaaccacaaaatctgtcaccagagattgagaagcaatgctttactttctctgaaaaaaacccaaattcttcaaattataaaaaagtggatttttttattagaaacagtgaatgtaaaaaggaagttgatttcagtatgtatcatcctgatgatgaagctgatgaaatgaagtctttattgggaatatttgatggtattttctaaaacaaacaaatactttttatattgataagagaaagaataaagacacctaatcacaaagcatgctttttatttttaaaaagtagttcataattgttcggatttttttctcctgtatttgattagctttgttcactttttgcaacaaaatgtatgggccgatttattttcccattatattgtaacttcttgaaaagctcttttacagtggctttgtttcaataagcccttaagttaagggctgattgcacttagaaataagttgcacttagaaataattatttggctattaattggattttgacaagaaccaatgtaaaatttcatttttatattttcttaacaagaagaaaaatattctatgaaagcaaagtaatgctaacttaatgaatctgcttattgtatggattaatcactaatattattcccatgtattttgttttactaaagatttttaagaatccagtggctatttgaacctactgttatctaactttgagcaacaataaatgaaacattaatcagtat

SEQ ID NO: 1970 - DNA, 3017 bp, Homo sapiens
tatagggatatcacactatcttgtaaagtgtttcagctgttaaagttgctgtaggtttttatgcctgatgtcatttaatttatttgacattgaacttcattaataatcagagatggtcagtgaaagcgcttcctctttaactctttcttgcttaaccttggaaggttgactcaactcctaggtgtctatgggaaactctgggctaggaacgtgctataaagacactgagctagttcagacatggccatgctgctgtagcctcctgggaaagaagggcggcagagagaccagcccgcctgttggcttgcaggggtaatgagccttggcttgaaaaaattgttggcctccagagagcacggggctgtggtttcagaatcagtgatgggtgccgcacatcaagacgggaatcaagcaagaccaaggccctgtggactgagcagcgtggagggcgaacggctgcaggctccagacttcaccacagggtggccaacagtggcatcgggaccaaataaagatgtctaacagcttcctgggagcaggaggaggcaggattctggttgccatgaaaaacatctctctccctctccatcactccccatgctgcagtgcacaggtgggttgcagagacaggctgcatcccggaatcatgttgtcccactgcctattaatagaacaagtgaagggcagaatgctggaacacaccagacatagagggagggaggtcctgccagatgtgtctacacaactgtctacatagcatgacagtagcagtggattcgggacccacctgtacatgtttccaaagctccttcctgcacactcgggacctcagctccaaggcgtgactcatttctcagtctcaccatcctttgttggctcagacatcgcatgcctctgccccactggggttgtgtgcctgcgtctctcacttctttgaggttggggaaagcctagtccagaaaatgaaaacccatagaccagcctaacttcctttcaaccaagtgacggcctcctggttcctctcagttcatcatcaaaatcagtgtgtacatgtcatacaagccaagagtgttcatgtcctcgttcctttcaaatgaaggtgatatatactttttcactgagtttttattcctgaaattctttcttctggagcaggaagcaaatgtcctggaatcgtagacttttacagtcagaagggtcattcacgttcatctagtgcccctctcactctgcagggatcctcctgcctctcctctgcccctgtccagtgcctggtggtccagcctgtgatgggcaggcctaggctgccatccgcaggctctgtagttctgctttctattgaaccaagatgtttctacgttgcctattggtcgtggttctgtccagagcagttcaggctggggctgttctcttgcccctccttgaggcagacctttagatattttcagttttcatcacatgtctaacaccacttccaccccacccctcacctcttaggctaaatccaagctaaatcccccaatgtctttttttttttttttttttgagacgagtctcatctgtcacccaggctggagtgcaatggcacggtctcggctcactgcaacctccgcctcctgggttcaagctattctgcctcagcctcccaaggagccaggactacaggtgcatgccaccacgcccggctagtttttgtattttttggtagagacagggtttcacccagccattgagacaagctggtttcaaactcctgaccttgtggtccgcccgccccggcctcccagagtgctgggattacgggcgtgagccaccgcgcccatctcccctgcaatgtctttagttagaccttttccaccatcatgtctaactgggctacggtttggggaaagtgtccaaattagtccgtgttatcctaaaaggggtgtgccccggattagcagggccagggctagggtgagacaaatgaggcacctggggcatacatttaagttggtgcttgcttgcaggtgccaagagagtgcttccttgggtttacccccgtggtgcctcctttacctcattctggccccagccctggggttagagtcgcaccagtgtggtccaagtggcataattatctccctaaatgcttgggcagcatcagctttcagtagctgtgccccatgggaggcacattaagctagtggcaagttgagactgcagacctcagcttaatatcagttgttgcccaagacagatctcaccccacatcttcatgacaggcctaacaacaaggcactttgcccttaatcctctactactgcctgctcttcattttgggccaactgtacagctcattttgagatagtagctgatcatttttctgatcagttaactttgtcttattaagcaaaatggagaatataatgttgggaaataagtgtgttgattaaaagaaagtatccccttctaccatcttccatttgtgtctgggttgtgctgggtaaagttctagacttactaacgcagacttcattttggtccggtttccacagcatgcctcgggcatcagtgtccaggagtagctgtatttgaggtttccttcactctggtaggttcctgattcctgatgaaaataacttgaaaaaaaaataattatactactgatcctcttttgggataatgaaattgcgaaggaatgttgttgattataacttttattttttaatgtacagatgtactgtctctcattgagcactgatagaatttatttttctttcaatagtttaaaatcacttatgtggagacacatacttaagtgtgttcaactcgttttcttcccacatatctagtgtgacctttaaaaaccacaactttattttggacattaaatgtgcaatattcactacctattcattgttccacatttttcatacttgtacaaagggtaagtttttatataatggtgagaaacaggaagaaatgacaactggttaagtaaaattctgcaaataaactagattcgaatttaattt

SEQ ID NO: 1971 - protein, 535 aa, Homo sapiens
MRRERTRGPQAWEFPSPTKSGCSLQSLSRDLRELREGEKPEDQAETEESWQGLARKTPGKACAPEGGSCQPGKTENTITMTTSHQPQDRYKAVWLIFFMLGLGTLLPWNFFMTATQYFTNRLDMSQNVSLVTAELSKDAQASAAPAAPLPERNSLSAIFNNVMTLCAMLPLLLFTYLNSFLHQRIPQSVRILGSLVAILLVFLITAILVKVQLDALPFFVITMIKIVLINSFGAILQGSLFGLAGLLPASYTAPIMSGQGLAGFFASVAMICAIASGSELSESAFGYFITACAVIILTIICYLGLPRLEFYRYYQQLKLEGPGEQETKLDLISKGEEPRAGKEESGVSVSNSQPTNESHSIKAILKNISVLAFSVCFIFTITIGMFPAVTVEVKSSIAGSSTWERYFIPVSCFLTFNIFDWLGRSLTAVFMWPGKDSRWLPSLVLARLVFVPLLLLCNIKPRRYLTVVFEHDAWFIFFMAAFAFSNGYLASLCMCFGPKKVKPAEAETAGAIMAFFLCLGLALGAVFSFLFRAIV

SEQ ID NO: 1972 - protein, 185 aa, Homo sapiens
MRLGSPGLLFLLFSSLRAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 1973 - protein, 116 aa, Homo sapiens
MAPAASWAPSPGCASGATKGASASHLPGSGAPPGIFVPVSGAITCPTSWTRALPCPNHVLLCTTIPTPKVLPGLIPSPLSPWPWSQLKPRPLPPGPSAQPPLWPPSPQHPPLSPSP

SEQ ID NO: 1974 - protein, 492 aa, Homo sapiens
MGFQRRFFHQDQSPVGGLTAEDIEKARQAKARPENKQHKQTLSEHARERKVPVTRIGRLANFGGLAVGLGFGALAEVAKKSLRSEDPSGKKAVLGSSPFLSEANAERIVRTLCKVRGAALKLGQMLSIQDDAFINPHLAKIFERVRQSADFMPLKQMMKTLNNDLGPNWRDKLEYFEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 1975 - protein, 752 aa, Homo sapiens [sequence omitted]

SEQ ID NO: 1976 - protein, 119 aa, Homo sapiens [sequence omitted]

SEQ ID NO: 1977 - protein, 142 aa, Homo sapiens [sequence omitted]

SEQ ID NO: 1978 - protein, 209 aa, Homo sapiens
MEREGPEYWDRNTQICKAQARTERENLRIALRYYNQSEGGSHTMQVMYGCDVGPDGRFLCGYEQHAYDGKDYIALNEDLRSWTAADMAAQITKRKWEAARRAEQRRVYLEGEFVEWLRRYLENGKETLQRAGTRGHRAPPGWPVDLRGWPPTRKGDKWDQHYNIALPLVLREKNPPGFPESDSEGPPCSLTQLRDEISEEMKGRQSLEY

SEQ ID NO: 1979 - protein, 101 aa, Homo sapiens [sequence omitted]

SEQ ID NO: 1980 - protein, 136 aa, Homo sapiens
MAPQPAAQCPCHPAWASAWTMSGAGFPSWMLFPSVGSWSAPWTAQGLCALPFASSGVAQYSSRSQWALSLRGKSPLGASPSWTEPSRPLMQTWGPPGPWPPNLLAPGCYPLAASPPNSPTMWPCSFSRVCLPTVFS

SEQ ID NO: 1981 - protein, 119 aa, Homo sapiens
MSSSELLSKPLTVVYKSLHDLSCYIFHSRSRPDLRGFSLNLLNMLLPEGPFPLPLPGMLFPRHASAWIISMPPQVFALMKPSLTTLFKIVIPSHSGPYLLETECFCPPQNSYVEALIST

SEQ ID NO: 1982 - protein, 103 aa, Homo sapiens [sequence omitted]

SEQ ID NO: 1983 - protein, 121 aa, Homo sapiens
MYLLPGLKRLCGRSLAQMLDEDTVVGVWRVAKLFRLARLEDQCTEYMAKVIEKLVEREDFVEAVKEEAAAVAARQETDSIPLVDDIRFHVASTVQTYSAIEEAQQRLRALVDLLVSIGLDC

SEQ ID NO: 1984 - protein, 156 aa, Homo sapiens [sequence omitted]

SEQ ID NO: 1985 - protein, 330 aa, Homo sapiens [sequence omitted]

SEQ ID NO: 1986 - protein, 439 aa, Homo sapiens
MVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITE

SEQ ID NO: 1987 - protein, 106 aa, Homo sapiens [sequence omitted]

SEQ ID NO: 1988 - protein, 464 aa, Homo sapiens
MHRKFQETEQTIQKLQQDFSFLYSQLNHTENDVTHLQKEMSNCRAGENAGMGRFTKVGEQERTVDTLPSPQHPVAHCCSQLEERWQRLQSQVISELDACKECTQGVQREVSMVEGRVSHMEKTCSKLDSISGNLQRIKEGLNKHVSSLWNCVRQMNGTLRSHSRDISGLKNSVQQFYSHVFQISTDLQDLVKFQPSAKAPSPPPPAEAPKEPLQPEPAPPRPSGPATAEDPGRRPVLPQRPPEERPPQPPGSTGVIAETGQAGPPAGAGVSGRGLPRGVDGQTGSGTVPGAEGFAGAPGYPKSPPVASPGAPVPSLVSFSAGLTQKPFPSDGGVVLFNKVLVNDGDVYNPSTGVFTAPYDGRYLITATLTPERDAYVEAVLSVSNASVAQLHTAGYRREFLEYHRPPGALHTCGGPGAFHLIVHLKAGDAVNVVVTGGKLAHTDFDEMYSTFSGVFLYPFLSHL

SEQ ID NO: 1989 - protein, 246 aa, Homo sapiens [sequence omitted]

SEQ ID NO: 1990 - protein, 561 aa, Homo sapiens
MELKKDINAVSIDMLLIVHSEKRRAAQGTLSDQQANPSSLLQRGGGFQGVGNGVRRWQKLEGNDFHENLVEKQHPQQPQVITSYNSQGTQLTVEVHPRDAMPQLLKKFSLAKRLQGDKNGNTRPRQPGGKDAHAYPWDRSSLKSMSLDLQQFEKLDIYTSQVTAKSGLDELVSDLLQEAHTDLERVRAIWIWICHHIEYDIAAAQEKDRQAFKPTDILRTQKTNCDGYAGLFERMCRLAGVQCMTVPGYSKGFGYQTGQSFSGEFDHAWNAVYLEGRWHLVDSTWGSGLVDTITSKFTFLYNEFYFLTHPALFIEDHFPDNKNWQLLKPPQSLRQFENNMYHKSEFYNKGMLSAHPETSMIRTVNGKATVTIESCAPTLFMFMLNGKQEHGLLSLRKNGMKLEVYPPTMGTHKLQIFAKGNSDIYSSVLEYTLKCNYVDMGVQLPAELHQPVGPSWFSEQMGIMKPSHPDPIIHTSDGRCSISFSVEEGINVLASLHGDDGPITEETQRRYIFQLHREKQTELKVQLPHAGKFALKIYVMVLENANHNFYSYILKYKVNAQ

SEQ ID NO: 1991 - protein, 195 aa, Homo sapiens [sequence omitted]

SEQ ID NO: 1992 - protein, 154 aa, Homo sapiens
MDSTNMDSNLKPEEVVHKEKRRTKSLLEEKLVLKSKSKTQGKQVKVVETELQEGATKQATTPKPDKEKNTEENDSEKQRKSKVEDKPFEETGVEPVLETASSSAHSTQKDSSHRAKLPLAKEKYKSDKDSTSTRLERKLSDGHKSRSLKHSSKD

SEQ ID NO: 1993 - protein, 165 aa, Homo sapiens
MNLTGIFCHDLPASVHPTLDFCRRLDSIVGPQLTVLASDICEQFNINKRISGSEKEPQFKFIYFNHMNLAEKSTVHMRKTPSVSLTSVHPDLMKILGDINSDFTRVDEDEEIIVKAMSDYWVVGKKSDRRELYVILNQKNANLIEVNEEVKKLCATQFNNIFFLD

SEQ ID NO: 1994 - protein, 198 aa, Homo sapiens
MCPHPISLRMPLIPHTLEPWWQRAVLEPKSHVASVCLTPLNHPSVSPGGLDTQEPPHHCGDSARFLRHAFRASALRASGLQDRVLEGCGQTGSRDLPGKAHWRMARDASSGLSPCPHPSIHPGKGSPNSGSAPIFSHWQRRQQSPGSLDTCCPWPQDTDGEQAPCRLLHTHHTPSSFWVALLILPKQPQGGFLLFLGV

SEQ ID NO: 1995 - protein, 373 aa, Homo sapiens [sequence omitted]

SEQ ID NO: 1996 - protein, 456 aa, Homo sapiens [sequence omitted]

SEQ ID NO: 1997 - protein, 163 aa, Homo sapiens [sequence omitted]

SEQ ID NO: 1998 - protein, 247 aa, Homo sapiens [sequence omitted]

SEQ ID NO: 1999 - protein, 113 aa, Homo sapiens [sequence omitted]

SEQ ID NO: 2000 - protein, 107 aa, Homo sapiens
MALAMLVLVVSPWSAARGVLRNYWERLLRKLPQSRPGFPSPPWGPALAVQGPAMFTEPANDTSGSKENSSLLDSIFWMAAPKNRRTIEVNRCRRRNPQKLIKVKVMH

SEQ ID NO: 2001 - protein, 156 aa, Homo sapiens
MLLGDMRLPFFQVEDELSSPVVVFRFFQELPGSDPVFKAVPVPNMTPSGVGRERHSCDALNRWLGEQLKQLVPASGLTVMDLEAEGTCLRFSPLMTAAVLRTRGEDVDQLVACIESKLPVLCCTLQLREEFKQEVEATAGLLYVDDPNWSGIGVVR

SEQ ID NO: 2002 - protein, 208 aa, Homo sapiens
MGEGTWRGKGPGNGPDRELVLTGRRWCGRAPQALHRPFLLLHVHAHPTHTFHVTASQPPLSDQREQALQGEPVPLPQPRLPKKQCLELAVSRLPSCMSSPVGDRASGAVPKMFLALSPWSPFIIHVRFNELHAYQPQAITTLMDGSGGRHSWPTPCRKDQIIPRKQVALILTSQEVCASSFISAGKTPVEWALSGAFTGFQLYSIPGS

SEQ ID NO: 2003 - protein, 562 aa, Homo sapiens
MNYSTHLFQMPLFLKLFICFIFIRSSPTIVSNKRVSKRKFIPPAFTNVSTKFELLSLGATLKLASELIQVHKLNKDQATALIQIAQMMASHESIEEVKELQTHTFPITIIHGVFGAGKSYLLAVVILFFVQLFEKSEAPTIGNARPWKLLISSSTNVAVDRVLLGLLSLGFENFIRVGSVRKIAKPILPYSLHAGSENESEQLKELHALMKEDLTPTERVYVRKSIEQHKLGTNRTLLKQVRVVGVTCAACPFPCMNDLKFPVVVLDECSQITEPASLLPIARFECEKLILVGDPKQLPPTIQGSDAAHENGLEQTLFDRLCLMGHKPILLRTQYRCHPAISAIANDLFYKGALMNGVTEIERSPLLEWLPTLCFYNVKGLEQIERDNSFHNVAEATFTLKLIQSLIASGIAGSMIGVITLYKSQMYKLCHLLSAVDFHHPDIKTVQVSTVDAFQGAEKEIIILSCVRTRQVGFIDSEKRMNVALTRGKRHLLIVGNLACLRKNQLWGRVIQHCEGREDGLQHANQYEPQLNHLLKDYFEKQVEEKQKKKSEKEKSKDKSHS

SEQ ID NO: 2004 - protein, 206 aa, Homo sapiens
MEVDINGESRSTLTTLPFPGAEANSPGKAEAEKPRCSSTPCSPMRRTVSGYQILHMDSNYLVGFTTGEELLKLAQKCTGGEESKAEAMPSLRSKQLDAGLARSSRLYKTRSRYYQPYEIPAVNGRRRRRMPSSGDKCTKSLPYEPYKALHGPLPLCLLKGKRAHSKSLDYLNLDKMIKEPADTEVLQYQLQHLTLRGDRVFARNNT

SEQ ID NO: 2005 - protein, 657 aa, Homo sapiens
MIPLSSIPTYNAAMDSNSFLKNSFHKFPYPTKAELCYLTVVTKYPEEQLKIWFTAQRLKQGISWSPEEIEDARKKMFNTVIQSVPQPTITVLNTPLVASAGNVQHLIQAALPGHVVGQPEGTGGGLLVTQPLMANGLQATSSPLPLTVTSVPKQPGVAPINTVCSNTTSAVKVVNAAQSLLTACPSITSQAFLDASIYKNKKSHEQLSALKGSFCRNQFPGQSEVEHLTKVTGLSTREVRKWFSDRRYHCRNLKGSRAMIPGDHSSIIIDSVPEVSFSPSSKVPEVTCIPTTATLATHPSAKRQSWHQTPDFTPTKYKERAPEQLRALESSFAQNPLPLDEELDRLRSETKMTRREIDSWFSERRKKVNAEETKKAEENASQEEEEAAEDEGGEEDLASELRVSGENGSLEMPSSHILAERKVSPIKINLKNLRVTEANGRNEIPGLGACDPEDDESNKLAEQLPGKVSCKKTAQQRHLLRQLFVQTQWPSNQDYDSIMAQTGLPRPEVVRWFGDSRYALKNGQLKWYEDYKRGNFPPGLLVIAPGNRELLQDYYMTHKMLYEEDLQNLCDKTQMSSQQVKQWFAEKMGEETRAVADTGSEDQGPGTGELTAVHKGMGDTYSEVSENSESWEPRVPEASSEPFDTSSPQAGRQLETD

SEQ ID NO: 2006 - protein, 262 aa, Homo sapiens [sequence omitted]

SEQ ID NO: 2007 - protein, 420 aa, Homo sapiens
METKRVEIPGSVLDDLCSRFILHIPSEERDNAIRVCFQIELAHWFYLDFYMQNTPGLPQCGIRDFAKAVFSHCPFLLPQGEDVEKVLDEWKEYKMGVPTYGAVILDETLENVLLVQGYLAKSGWGFPKGKVNKEEAPHDCAAREVFEETGFDIKDYICKDDYIELRINDQLARLYIIPGIPKDTKFNPKTRREIRNIEWFSIEKLPCHRNDMTPKSKLGLAPNKFFMAIPFIRPLRDWLSRRFGDSSDSDNGFSSTGSTPAKPTVEKLSRTKFRHSQQLFPDGSPGDQWVKHRQPLQQKPYNNHSEMSDLLKGKNQSMRGNGRKQYQDSPNQKKRTNGLQPAKQQNSLMKCEKKLHPRKLQDNFETDAVYDLPSSSEDQLLEHAEGQPVACNGHCKFPFSSRAFLSFKFDHNAIMKILDL

SEQ ID NO: 2008 - protein, 123 aa, Homo sapiens [sequence omitted]

SEQ ID NO: 2009 - protein, 507 aa, Homo sapiens [sequence omitted]

SEQ ID NO: 2010 - protein, 398 aa, Homo sapiens
MASSGSLWQEIPVVRNSTVLLSMTHEDQKLQEVKFELIVSEASYLRSLNIAVDHFQLSTSLRATLSNQEHQWLFSRLQDVRDVSATFLSDLEENFENNIFSFQVCDVVLNHAPDFRRVYLPYVTNQTYQERTFQSLMNSNSNFREVLEKLESDPVCQRLSLKSFLILPFQRITRLKLLLQNILKRTQPGSSEEAEATKAHHALEQLIRDCNNNVQSMRRTEELIYLSQKIEFECKIFPLISQSRWLVKSGELTALEFSASPGLRRKLNTRPVHLHLFNDCLLLSRPRESEKLRWISALAMPREELDLLECYNSPQVQCLRAYKPRENDELALEKADVVMVTQQSSDGWLEGVRLSDGERGWFPVQQVEFISNPEVRAQNLKEAHRVKTAKLQLVEQQA

SEQ ID NO: 2011 - protein, 555 aa, Homo sapiens
MLSRLMSGSSRSLEREYSCTVRLLDDSEYTCTIQRDAKGQYLFDLLCHHLNLLEKDYFGIRFVDPDKQRHWLEFTKSVVKFYPADPAALKEEITRYLVFLQIKRDLYHGRLLCKTSDAALLAAYILQAEIGDYDSGKHPEGYSSKFQFFPKHSEKLERKIAEIHKTELSGQTPATSELNFLRKAQTLETYGVDPHPCKDVSGNAAFLAFTPFGFVVLQGNKRVHFIKWNEVTKLKFEGKTFYLYVSQKEEKKIILTYFAPTPEACKHLWKCGIENQAFYKLEKSSQVRTVSSSNLFFKGSRFRYSGRVAKEVMESSAKIKREPPEIHRAGMVPSRSCPSITHGPRLSSVPRTRRRAVHISIMEGLESLRDSAHSTPVRSTSHGDTFLPHVRSSRTDSNERVAVIADEAYSPADSVLPTPVAEHSLELMLLSRQINGATCSIEEEKESEASTPTATEVEALGGELRALCQGHSGPEEEQVNKFVLSVLRLLLVTMGLLFVLLLLLIILTESDLDIAFFRDIRQTPEFEQFHYQYFCPLRRWFACKIRSVVSLLIDT

SEQ ID NO: 2012 - protein, 116 aa, Homo sapiens [sequence omitted]

SEQ ID NO: 2013 - protein, 163 aa, Homo sapiens
MVVAGGSLMVVAGGSPMVVAGDSLMVAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 2014 - protein, 247 aa, Homo sapiens [sequence omitted]

SEQ ID NO: 2015 - protein, 386 aa, Homo sapiens [sequence omitted]

SEQ ID NO: 2016 - protein, 388 aa, Homo sapiens
MDPIRSFCGKLRSLASTLDCETARLQRALDGEESDFEDYPMRILYDLHSEVQTLKDDVNILLDKARLENQEGIDFIKATKVLMEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQKFQWIYPTQKLNKMR

SEQ ID NO: 2017 - protein, 263 aa, Homo sapiens [sequence omitted]

SEQ ID NO: 2018 - protein, 124 aa, Homo sapiens
MTRDRTETFSTSTLGGRKFTFLSKNTKPEAEISGSDREDSLFPLGLWTGCNNGMRPWGGNECLLCVGKRGKQIFGDLKRRPWQNLISCSTILFSFSPGHTAMHFPAILVVRCPVTVLRMEYGQM

SEQ ID NO: 2019 - protein, 513 aa, Homo sapiens [sequence omitted]

SEQ ID NO: 2020 - protein, 394 aa, Homo sapiens
MANYFRDYANLCFEAFGDRVKHWITFSDPRAMAEKGYETGHHAPGLKLRGTGLYKAAHHIIKAHAKAWHSYNTTWRSKQQGLVGISLNCDWGEPVDISNPKDLEAAERYLQFCLGWFANPIYAGDYPQVMKDYIGRKSAEQGLEMSRLPVFSLQEKSYIKGTSDFLGLGHFTTRYITERNYPSRQGPSYQNDRDLIELVDPNWPDLGSKWLYSVPWGFRRLLNFAQTQYGDPPIYVMENGASQKFHCTQLCDEWRIQYLKGYINEMLKAIKDGANIKGYTSWSLLDKFEWEKGYSDRYGFYYVEFNDRNKPRYPKASVQYYKKIIIANGFPNPREVESWYLKALETCSINNQMLAAEPLLSHMQMVTEIVVPTVCSLCVLITAVLLMLLLRRQS

SEQ ID NO: 2021 - protein, 327 aa, Homo sapiens
MPLSSRDDEAKGATSDFSGKAFCFLPLPPGEESSTGLPVHISGFFGLTDNRRSIKWRELDQWRDPAALWNEFLVMNVVPKAYATLILDSIKRLEMEKSSDFPLSVDVIYKLWPEASKVKVHWQPVLEPLFSELLQNAVIYSISCDWVRLEQVYFSELDENLEYTKTVLNYLQSSGKQIAKVPGNVDAAVQLTAASGTTPVRKVTPAWVRQVLRKCAHLGCAEEKLHLLEFVLSDQAYSELLGLELLPLQNGNFVPFSSSVSDQDVIYITSAEYPRSLFPSLEGRFILDNLKPHLVAALKEAAQTRGFLFDEDSNGKLKMVAVLITSC

SEQ ID NO: 2022 - protein, 470 aa, Homo sapiens
MNFDKRQHEARIQQMENEIHYLQENLKSMEEIQGLTDLQLQEADEEKERILAQLRELEKKKKLEDAKSQGQVFGLDKELKKLKKAVATSDKLATAELTIAKDQLKSLHGTVMKINQERAEELQEAERFSRKAAQAARDLTRAEAEIELLQNLLRQKGEQFRLEMEKTGVGTGANSQVLEIEKLNETMERQRTEVARLQNVLDLTGSDNKGGFENVLEEIAELRREVSYQNDYISSMADPFKRRGYWYFMPPPPSSKVSSHSSQATKDSGVGLKYSASTPVRKPRPGQQDGKEGSQPPPASGYWVYSPIRSGLHKLFPSRDADSGGDSQEESELDDQEEPPFVPPPGYMMYTVLPDGSPVPQGMTLYAPPPPLPNNSRPLTPGTVVYGPPPAGAPMVYGPPPPNFSIPFIPMGVLHCNVPEHHNLENEVSRLEDIMQHLKSKKREERWMRASKRQSEKEMEELHHNIDDLL

SEQ ID NO: 2023 - protein, 400 aa, Homo sapiens
MGKNPVRPPRALPPVPSQDDIPLSRPKKKKPRTKNTPASASLEGLAQTAGRRPSEGNEPSTKELKEHPEAPVQRRQKKTRLPLELETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 2024 - protein, 102 aa, Homo sapiens
MTRPPPPPCNRSPGPLNADTDDPRRGRWARGAQATGRGLSGPLLPPASAASACRGHCQNLSKVLGRKGSFTPPLNEQMACLDCSHSLLIGTNESLPTPWDFP

SEQ ID NO: 2025 - protein, 105 aa, Homo sapiens
MTQHFWAQGRAQRGAWGPQPSPQAPPAALLGCNKHTINCAYSSVHVDEFGHMHTLPKPPAQSRQQTYPSPPRVSLCLFVIHPSRPPHPHSHRLPTVADLLSAAVD

SEQ ID NO: 2026 - protein, 124 aa, Homo sapiens [sequence omitted]

SEQ ID NO: 2027 - protein, 812 aa, Homo sapiens
MASEGPREPESEGIKLSADVKPFVPRFAGLNVAWLESSEACVFPSSAATYYPFVQEPPVTEQKIYTEDMAFGASTFPPQYLSSEITLHPYAYSPYTLDSTQNVYSVPGSQYLYNQPSCYRGFQTVKHRNENTCPLPQEMKALFKKKTYDEKKTYDQQKFDSERADGTISSEIKSARGSHHLSIYAENSLKSDGYHKRTDRKSRIIAKNVSTSKPEFEFTTLDFPELQGAENNMSEIQKQPKWGPVHSVSTDISLLREVVKPAAVLSKGEIVVKNNPNESVTANAATNSPSCTRELSWTPMGYVVRQTLSTELSAAPKNVTSMINLKTIASSADPKNVSIPSSEALSSDPSYNKEKHIIHPTQKSKASQGSDLEQNEASRKNKKKKEKSTSKYEVLTVQEPPRIEDAEEFPNLAVASERRDRIETPKFQSKQQPQDNFKNNVKKSQLPVQLDLGGMLTALEKKQHSQHAKQSSKPVVVSVGAVPVLSKECASGERGRRMSQMKTPHNPLDSSAPLMKKGKQREIPKAKKPTSLKKIILKERQERKQRLQENAVSPAFTSDDTQDGESGGDDQFPEQAELSGPEGMDELISTPSVEDKSEEPPGTELQRDTEASHLAPNHTTFPKIHSRRFRDYCSQMLSKEVDACVTDLLKELVRFQDRMYQKDPVKAKTKRRLVLGLREVLKHLKLKKLKCVIISPNCEKIQSKGGLDDTLHTIIDYACEQNIPFVFALNRKALGRSLNKAVPVSVVGIFSYDGAQDQFHKMVELTVAARQAYKTMLENVQQELVGEPRPQAPPSLPTQGPSCPAEDGPPAL

SEQ ID NO: 2028 - protein, 356 aa, Homo sapiens
MQHVSSSQSSQRHVQWPGACPGAGEEQPACSQPSLPLTLPSPSHQLQQLMDGSGLTQIAQGAQVQLQHPGTPITVRERRPSQPHTQSGGTIHHLGPQSPAAAGGAGLQPLASPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHHQEMQALKEVFKEYLIELFFLQHFQGNMMDFLAFKERLYGPLQAYLRQNDLDIEEEEEEHFEVINDEVKVVARKHGQPGTPVAIATQLPPRTSAAFPAQQQPLQVLSDGSTVQLPRLSSLGFEDSMC

SEQ ID NO: 2029 - protein, 336 aa, Homo sapiens [sequence omitted]

SEQ ID NO: 2030 - protein, 113 aa, Homo sapiens
MLLQQGQGPCQPPTRHTRESPACEGATPRAGIRMKTRLHSEHGARDRTQRGRPAREAFTLQTARSTYTKSETPSQKKKKIKHRITLWSSNPTSGHICKIIDSRVSERSLHPCP

SEQ ID NO: 2031 - protein, 414 aa, Homo sapiens
MAAVGSGGYARNDAGEKLPSVMAGVPARRGQSSPPPAPPICLRRRTRLSTASEETVQNRVSLEKVLGITAQNSSGLTCDPGTGHVAYLAGCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSFLFHRKAEAVYPDTVALTFDPTHQWLSCVYKDHSIYIWDVKDINRVGKVWSELFHSSYVWNVEALS

SEQ ID NO: 2032 - protein, 648 aa, Homo sapiens
MEKARRGGDGVPRGPVLHIVVVGFHHKKGCQVEFSYPPLIPGDGHDSHTLPEEWKYLPFLALPDGAHNYQEDTVFFHLPPRNGNGATVFGISCYRQIEAKALKVRQADITRETVQKSVCVLSKLPLYGLLQAKLQLITHAYFEEKDFSQISILKELYEHMNSSLGGASLEGSQVYLGLSPRDLVLHFRHKVLILFKLILLEKKVLFYISPVNKLVGALMTVLSLFPGMIEHGLSDCSQYRPRKSMSEDGGLQESNPCADDFVSASTADVSHTNLGTIRKVMAGNHGEDAAMKTEEPLFQVEDSSKGQEPNDTNQYLKPPSRPSPDSSESDWETLDPSVLEDPNLKEREQLGSDQTNLFPKDSVPSESLPITVQPQANTGQVVLIPGLISGLEEDQYGMPLAIFTKGYLCLPYMALQQHHLLSDVTVRGFVAGATNILFRQQKHLSDAIVEVEEALIQIHDPELRKLLNPTTADLRFADYLVRHVTENRDDVFLDGTGWEGGDEWIRAQFAVYIHALLAATLQLDNEKILSDYGTTFVTAWKNTHNYRVWNSNKHPALAEINPNHPFQGQYSVSDMKLRFSHSVQNSERGKKIGNVMVTTSRNVVQTGKAVGQSVGGAFSSAKTAMSSWLSTFTTSTSQSLTEPPDEKP

SEQ ID NO: 2033 - protein, 516 aa, Homo sapiens [sequence omitted]

SEQ ID NO: 2034 - protein, 601 aa, Homo sapiens
MDLDKPSVWGSLKQRTRPLLINLSKKKVKKNPSKPPDLRARHHLDRRLSLSVPDLLEAEALAPEGRPYSGPQSSYTSVPSSLSTAGIFPKSSSSSLKQSEEELDWSQEEASHLHVVETDSEEAYASPAERRRVSSNGIFDLQKTSLGGDAPEEPEKLCGSSDLNASMTSQHFEEQSVPGEASDGLSNLPSPFAYLLTIHLKEGRNLVVRDRCGTSDPYVKFKLNGKTLYKSKVIYKNLNPVWDEIVVLPIQSLDQKLRVKVYDRDLTTSDFMGSAFVILSDLELNRTTEHILKLEDPNSLEDDMGVIVLNLNLVVKQGDFKRHRWSNRKRLSASKSSLIRNLRLSESLKKNQLWNGIISITLLEGKNVSGGSMTEMFVQLKLGDQRYKSKTLCKSANPQWQEQFDFHYFSDRMGILDIEVWGKDNKKHEERLGTCKVDISALPLKQANCLELPLDSCLGALLMLVTLTPCAGVSVSDLCVCPLADLSERKQITQRYCLQNSLKDVKDVGILQVKVLKAADLLAADFSGKSDPFCLLELGNDRLQTHTVYKNLNPEWNKVFTFPIKDIHDVLEVTVFDEDGDKPPDFLGKVAIPLLSVSFLY

SEQ ID NO: 2035 - protein, 670 aa, Homo sapiens [sequence omitted]

SEQ ID NO: 2036 - protein, 121 aa, Homo sapiens
MFCSEPLLSVKGMVTLLKLYIWLTPRLTHAQTHSHLERVKPSQNCLRFLECFSSYPPLTPPTPLGPQLKPDTTPFPVRGVHSCPLPCSFLCPQWEAHASLSHRLLALTKGTKADMTEATSK

SEQ ID NO: 2037 - protein, 154 aa, Homo sapiens
MQLLQVRTTNTLRRLPGTPLMPSAGAVRVVASVQSGHSWWRMWDGPTGAAEAGSCAEMLRTSAPGTSRPNLSFLLGQVIPLAHTGSVETLPSEESWGCRQRASPLPPSTAPMAVSASHRGGTGTRTWLVDPTLSRDTSPLGGQSWGSPQPSRGA

SEQ ID NO: 2038 - protein, 176 aa, Homo sapiens
MASQLWEESPCPGPAQQAGGPPEATVRLWPLTLPAGLNSWPRVRFGGAPFCLPQNGLLYFHPQAAGPRLASRWRGRTVATVAPARYLSWGWIPGEALTHRVKASWQPPQGRSLGSPRFADEETVTCSSHTARKRWSYGWVQVCLDPALCQCLHPPSRPRRLASFHKLEGPQDSLLS

SEQ ID NO: 2039 - protein, 177 aa, Homo sapiens [sequence omitted]

SEQ ID NO: 2040 - protein, 116 aa, Homo sapiens
MLSSGFSVGDFWIRWYQQKPGNPPRYLLYYHSDSNKGQGSGVPSRFSGSNDASANAGILRISGLQPEDEADYYCGTWHSNSKTHTVLQTHEEQNTAKSFARISCRLAFSDGEQTPR

SEQ ID NO: 2041 - protein, 119 aa, Homo sapiens
MNKILSSTVCFGLLTLLSVLIFLQSVHGRPYLTQGNEIFPDKKYTNREELLLALLNKNFDFQRPFNTDLALPNKLEELNQLEKLKEQLVEEKDSETSYAVDGLFSSHPSKRACFWKYCV

SEQ ID NO: 2042 - protein, 726 aa, Homo sapiens
MAAPGGRGRSLSGLLPAQTSLEYALLDAVTQQEKDSLVYQYLQKVDGWEQDLSVPEFPEGLEWLNTEEPISVYKDLCGKIVVLDFFTYCCINCIHLLPDLHALEHTYSDKDGLLIIGVHSAKFPNEKVLDNIKSAVLRYNITHPMVNDADASLWQELEVSCWPTLVILGPRGNMLFSLIGEGHKDKLFLYTSIALKYYKDRGQIRDNKIGIKLYKDSLPPSPLLFPGKVTVDQVTDRLVIADTGHHRILVVWKNGQIQYSIGGPNPGRKDGIFSESTFNSPQGVAIMNNIIYVADTENHLIRKIDLEAEKVSTVAGIGIQGTDKEGGAKGEQQPISSPWDVVFGTSGSEVQRGDILWIAMAGTHQIWALLLDSGKLPKKNELTKGTCLRFAGSGNEENRNNAYPHKAGFAQPSGLSLASEDPWSCLFVADSESSTVRTVSLKDGAVKHLVGGERDPMNLFAFGDVDGVGINAKLQHPLGVTWDKKRNLLYVADSYNHKIKVVDPKTKNCTTLAGTGDTNNVTSSSFTESTFNEPGGLCIGENGELLYVADTNNHQIKVMDLETKMVSVLPIFRSENAVVDGPFLVEKQKTLPKLPKSAPSIRLSPVTACAGQTLQFKLRLDLPSGSKLTEGVSSCWFLTAEGNEWLLQGQIAAGDIENISSQPTISLQIPDDCLSLEAIVSVSVFLYYCSADSSACMMKAILFSQPLQITDTQQGCIAPVELRYVF

SEQ ID NO: 2043 - protein, 843 aa, Homo sapiens
MKEETAEERLRRRAYERGCQRLRKRIEVVEELQVQILKLLLDNKDDNGGEASRYIFLTKFRKFLQENASGRGNMPMLCPPEYMVCFLHRLISALRYYWDEYKASNPHASFSEEAYIPPQVFYNGKVDYFDLQRLGGLLSHLRKTLKDDLASKANIVIDPLELQSTAMDDLDEDEEPAPAMAQRPMQALAVGGPLPLPRPGWLSSPTLGRANRFLSTAAVSLMTPRRPLSTSEKVKVRTLSVEQRTREDIEGSHWNEGLLLGRPPEEPEQPLTENSLLEVLDGAVMMYNLSVHQQLGKMVGVSDDVNEYAMALRDTEDKLRRCPKRRKDILAELTKSQKVFSEKLDHLSRRLAWVHATVYSQEKMLDIYWLLRVCLRTIEHGDRTGSLFAFMPEFYLSVAINSYSALKNYFGPVHSMEELPGYEETLTRLAAILAKHFADARIVGTDIRDSLMQALASYVCYPHSLRAVERIPEEQRIAMVRNLLAPYEQRPWAQTNWILVRLWRGCGFGYRYTRLPHLLKTKLEDANLPSLQKPCPSTLLQQHMADLLQQGPDVAPSFLNSVLNQLNWAFSEFIGMIQEIQQAAERLERNFVDSRQLKVCATCFDLSVSLLRVLEMTITLVPEIFLDWTRPTSEMLLRRLAQLLNQVLNRVTAERNLFDRVVTLRLPGLESVDHYPILVAVTGILVQLLVRGPASEREQATSVLLADPCFQLRSICYLLGQPEPPAPGTALPAPDRKRFSLQSYADYISADELAQVEQMLAHLTSASAQAAAASLPTSEEDLCPICYAHPISAVFQPCGHKSCKACINQHLMNNKDCFFCKTTIVSVEDWEKGANTSTTSSAA

SEQ ID NO: 2044 - protein, 115 aa, Homo sapiens
MAPETGFAEDNFSMDLEEIKSPCLPWLRWPQIPGLGAMWTPPGQGPDVVSPVSAPDLQVPQDSSDEVSDCPSTALSQDPWVHEPQHGSWMNPSSSPAQLLGAGLSIAPHLLVRKG

SEQ ID NO: 2045 - protein, 620 aa, Homo sapiens
MAEARTSLSAHCRGPLATGLHPDLDLPGRSLATPAPSCYLLGSEPSSGLGLQPETHLPEGSLKRCCVLGLPPTSPASSSPCASSDVTSIIRSSQTSLVTCVNGLRSPPLAGDLGGPSKRARPGPASTDSHEGSLQLEACRKASFLKQEPADEFSELFGPHQQGLPPPYPLSQLPPGPSLGGLGLGLGGRVVAGRQACRWVDCCAAYEQQEELVRHIEKSHTDQRKGEDFTCFWAGCVRRYKPFNARYKLLIHMRVHSGEKPNKCMFEGCSKAFSRLENLKIHLRSHTGEKPYLCQHPGCQKAFSNSSDRAKHQRTHLDTKPYACQIPGCSKRYTDPSSLRKHVKAHSAKEQQVRKKLHAGPDTEADVLTECLVLQQLHTSTQLAASDGKGGCGLGQELLPGVYPGSITPHNGLASGLLPPAHDVPSRHHPLDATTSSHHHLSPLPMAESTRDGLGPGLLSPIVSPLKGLGPPPLPPSSQSHSPGGQPFPTLPSKPSYPPFQSPPPPPLPSPQGYQGSFHSIQSCFPYGDCYRMAEPAAGGDGLVGETHGFNPLRPNGYHSLSTPLPATGYEALAEASCPTALPQQPSEDVVSSGPEDCGFFPNGAFDHCLGHIPSIYTDT

SEQ ID NO: 2046 - protein, 523 aa, Homo sapiens [sequence omitted]

SEQ ID NO: 2047 - protein, 159 aa, Homo sapiens
MSQAWVPGLAPTLLFSLLAGPQKIAAKCGLILACPKGFKCCGDSCCQENELFPGPVRIFVIIFLVILSVFCICGLAKCFCRNCREPEPDTPVDCRGPLELPSIIPPERVRVSLSAPPPPYSEVILKPSLGPTPTEPPPPYSFRPEEYTGDQRGIDNPAF

SEQ ID NO: 2048 - protein, 619 aa, Homo sapiens
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLGNCPCSPWH

SEQ ID NO: 2049 - protein, 108 aa, Homo sapiens [sequence omitted]

SEQ ID NO: 2050 - protein, 816 aa, Homo sapiens
MKYCPRSASQGALTSPSVSFSNHRTRSWDYIEGQDETLENVNSGTPIPDSNGEKKQTYKWSGFTEQDDRRGICERPRQQEIHKSFRGSNFTVAPSVVNSDNRRMSGRGVGSVSQFKKIPPDLKTLQSNRNFQTTCGMSLPRGISQDRSPLVKVRSNSLKAPSTHVTKPSFSQKSFVSIKDQRPVNHLHQNSLLNQQTWVRTDSAPDQQVETGKSPSLSGASAKPAPQSSENAGTSDLELPVSQRNQDLSLQEAETEQSDTLDNKEAVILREKPPSGRQTPQPLRHQSYILAVNDQETGSDTTCWLPNDARREVHIKRMEERKASSTSPPGDSLASIPFIDEPTSPSIDHDIAHIPASAVISASTSQVPSIATVPPCLTTSAPLIRRQLSHDHESVGPPSLDAQPNSKTERSKSYDEGLDDYREDAKLSFKHVSSLKGIKIADSQKSSEDSGSRKDSSSEVFSDAAKEGWLHFRPLVTDKGKRVGGSIRPWKQMYVVLRGHSLYLYKDKREQTTPSEEEQPISVNACLIDISYSETKRKNVFRLTTSDCECLFQAEDRDDMLAWIKTIQESSNLNEEDTGVTNRDLISRRIKEYNNLMSKAEQLPKTPRQSLSIRQTLLGAKSEPKTQSPHSPKEESERKLLSKDDTSPPKDKGTWRKGIPSIMRKAFEKKPTATGTFGVRLDDCPPAHTNRYIPLIVDICCKLVEERGLEYTGIYRVPGNNAAISSMQEELNKGMADIDIQDDKWRDLNVISSLLKSFFRKLPEPLFTNDKYADFIEANRKEDPLDRLKTLKRLIHDLPEHHYETLKFLSAHLKTV

SEQ ID NO: 2051 - protein, 546 aa, Homo sapiens
MASKVTDAIVWYQKKIGAYDQQIWEKSVEQREIKGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQVGIM

SEQ ID NO: 2052 - protein, 353 aa, Homo sapiens
MLFPALFPMLFPALFSVLFPALFPMLFPELFPVLFPMLFPALLPALFHMLFPALFPMLFPALFSAPFPMRSLHCSLHCSPCCSLRCSPCCSLHCSPCCSLRCSPCCSLRCSPCCSLHCSPCCSLQCSLHCSPHCSLHCSPCCFLHYSPCCSLHFSLCRSPCIPCTVPCTVPHAVPCNAPCTVPRTAPCTIPHAVPCTFLCAVPHAFPALFPALFPMLFPALFPMLFPAPFPMLFPAGFPALFPMLFPAPFPMLFPAGFPALFPMLFPAHFMPQTFPFSHQHTGSSFKSFCSVSNHSSAGTGLGQDGVRPCRPWPSRSVPLRRLPQRHGRLLKATERSTCWTPTTRATPSCGCP

SEQ ID NO: 2053 - protein, 504 aa, Homo sapiens
MLDNYRNLVFLGIAVSKPDLITCLEQGKEPCNMKRHAMVAKPPVVCSHFAQDLWPKQGLKDSFQKVILRRYGKYGHENLQLRKGCKSADEHKVHKRGYNGLNQCLTTTQSKIFQCDKYVKVLHKFSNSNIHKKRQTGKKPFKCKECGKSCCILSQLTQHKKTATRVNFYKCKTCGKAFNQFSNLTKHKIIHPEVNPYKCEECGKAFNQSLTLTKHKKIHTEEKPYKCEDCGKVFSVFSVLTKHKIIHTGTKPYNCEECGKGFSIFSTLTKHKIIHTGEKPYKCNECGKAFNWSSTLTKHKRIHTGEKPYKCEECGKAFNQSSTLTRHKIVHTGEKPYKCEECGKAFKRSTTLTKHKRIYTKEKPYKCEECGKAFSVFSTLTKHKIIHTGAKPYKCEECGSAFRAFSTLTEHKRVHTGEKPYKCNECGKAFNWSSTLTKHKRIHTGEKPYKCEECGKAFNRSSNLTRHKKIHTGEKPYKPKRCDSAFDNTPNFSRHKRNHMGEKS

SEQ ID NO: 2054 - protein, 558 aa, Homo sapiens
MALKGQEDYIYLFKDSTHPVDFLDAFRTFYLDGLFTDITLQCPSGIIFHCHRAVLAACSNYFKAMFTADMKEKFKNKIKLSGIHHDILEGLVNYAYTSQIEITKRNVQSLLEAADLLQFLSVKKACERFLVRHLDIDNCIGMHSFAEFHVCPELEKESRRILCSKFKEVWQQEEFLEISLEKFLFILSRKNLSVWKEEAIIEPVIKWTAHDVENRIECLYNLLSYINIDIDPVYLKTALGLQRSCLLTENKIRSLIYNALNPMHKEISQRSTATMYIIGGYYWHPLSEVHIWDPLTNVWIQGAEIPDYTRESYGVTCLGPNIYVTGGYRTDNIEALDTVWIYNSESDEWTEGLPMLNARYYHCAVTLGGCVYALGGYRKGAPAEEAEFYDPLKEKWIPIANMIKGVGNATACVLHDVIYVIGGHCGYRGSCTYDKVQSYNSDINEWSLITSSPHPEYGLCSVPFENKLYLVGGQTTITECYDPEQNEWREIAPMMERRMECGAVIMNGCIYVTGGYSYSKGTYLQSIEKYDPDLNKWEIVGNLPSAMRSHGCVCVYNV

SEQ ID NO: 2055 - protein, 156 aa, Homo sapiens [sequence omitted]

SEQ ID NO: 2056 - protein, 311 aa, Homo sapiens
MAPPNPNAQRSLPTTMWDSTPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 2057 - protein, 111 aa, Homo sapiens
MKSSSASFNASSNYGHFSDLGCRSLWQQCRMLMSSVSRAFEVLLFSFFPHSGGTCLRGSPLPSGLTQPTSSYSGADSNCRCSEWPWGWDPRLSICEPTAAPVPCGMWQGLV

SEQ ID NO: 2058 - protein, 249 aa, Homo sapiens
MFQLPSFMKALKFETPAPNYYNASVSCCKQRNNVCTRAGFMSKTQRGSFAFADKGPPPGHYDINESLVKQSPNTLMSCFKSKTNRGLKLTSTGPGPGYYNPSDCTKVPKKTLFPKNPILNFSAQPSPLPPKPPFPGPGQYEIVDYLGPCKQRNNVCTRAGFMSKTQRGSFAFADKGPPPGHYDINESLVKQSPNTLMSCFKSKTNRGLKLTSTGPGPGYYNPSDCTDSRWVGSCQAPFLISQQALTDAV

SEQ ID NO: 2059 - protein, 104 aa, Homo sapiens
MGMCSRQDRIQKDIDVVIQKSRAEDCLFAGSDCTFSTSFSMAVSLTTCFGPRAEMSILETNQYFRSELEKCKQNFQDLTEKFLTSKATAYSLANHLQKYRYTIP

SEQ ID NO: 2060 - protein, 113 aa, Homo sapiens
MLTLLEGLLGKGQCKTLREVSFPPFQPLSTCSLLGAVRIWIWGESLCSGTSDRSCSLEFSGWLYSAVRMRESSWAESLAKSSGKVMFIHWECFPQPDSYANSLKFSSSLFRFK

SEQ ID NO: 2061 - protein, 625 aa, Homo sapiens
MADVTARSLQYEYKANSNLVLQADRSLIDRTRRDEPTGEVLSLVGKLEGTRMGDKAQRTKPQMQEERRAKRRKRDEDRHDINKMKGYTLLSEGIDEMVGIIYKPKTKETRETYEVLLSFIQAALGDQPRDILCGAADEVLAVLKNEKLRDKERRKEIDLLLGQTDDTRYHVLVNLGKKITDYGGDKEIQNMDDNIDETYGVNVQFESDEEEGDEDVYGEVREEASDDDMEGDEAVVRCTLSANLVASGELMSSKKKDLHPRDIDAFWLQRQLSRFYDDAIVSQKKADEVLEILKTASDDRECENQLVLLLGFNTFDFIKVLRQHRMMILYCTLLASAQSEAEKERIMGKMEADPELSKFLYQLHETEKEDLIREERSRRERVRQSRMDTDLETMDLDQGGEALAPRQVLDLEDLVFTQGSHFMANKRCQLPDGSFRRQRKGYEEVHVPALKPKPFGSEEQLLPVEKLPKYAQAGFEGFKTLNRIQSKLYRAALETDENLLLCAPTGAGKTNVALMCMLREIGKHINMDGTINVDDFKIIYIAPMRSLVQEMVGSFGKRLAKSNSLISIKRLTLQQKAKVKLDFVAPATGAHNYTLYFMSDAYMGCDQEYKFSVDVKEAETDSDSD

SEQ ID NO: 2062 - protein, 150 aa, Homo sapiens
MTDLGPEARPQVVFANDTILYLENSIVSAQKLLKQLQQSLRIQNQCGKSQALLYTNNRQAESQIMNELPFTITAKRVRYLEIQLAREVKDLFKENYKLLLRKIREDTNKWKKIPCSWIGRINIIKMAILTKVIYRFNVIPIKLLMLSTFE

SEQ ID NO: 2063 - protein, 242 aa, Homo sapiens
MASRIIHYTEPINSPNLSDNTCHFEDEKICGYTQDLTDNFDWTRQNALTQNPKRSPNTGPPTDISGTPEGYYMFIETSRPRELGDRARLVSPLYNASAKFYCVSFFYHMYGKHIGSLNLLVRSRNKGALDTHAWSLSGNKGNVWQQAHVPISPSGPFQIIFEGVRGPGYLGDIAIDDVTLKKGECPRKQTDPNKGARREGGGGAESGGSCAWRGFLSVEGGCLGLNRGSECLSDGNHVALTV

SEQ ID NO: 2064 - protein, 270 aa, Homo sapiens
MRQQQLESEQFLFFEDQLKKQELARGQMRSQQTSGLSEQIDGSALSCFSTHQNNSLLNVFADQPNKSDATNYASHSPPVNRALTPAATLSAVQNLVVEGLRCVVLPEDLCHKFLQLAESNTVRGIETCGILCGKLTHNEFTITHVIVPKQSAGPDYCDMENVEELFNVQDQHDLLTLGWIHTHPTQTAFLSSVDLHTHCSYQLMLPEAIAIVCSPKHKDTGIFRLTNAGMLEVSACKKKGFHPHTKEPRLFSICKHVLVKDIKIIVLDLR

SEQ ID NO: 2065 - protein, 130 aa, Homo sapiens
MDGTCIERRRQWYRDDLPLCFKKEENPPSNNVDGPGGCYAKCKKKREGQMLHDLIPMGPATATSFLTEDIGLAFYQVSPLLGFLCLLSQDTWNMYTCPRWIGRSAEPPSAACQAGGTRLLGTLHSPALLS

SEQ ID NO: 2066 - protein, 206 aa, Homo sapiens [sequence omitted]

SEQ ID NO: 2067 - protein, 263 aa, Homo sapiens [sequence omitted]

SEQ ID NO: 2068 - protein, 294 aa, Homo sapiens
MAGTVRCQSQRCSPLSCGPDKAPALSPGSCCPRCLPRPASCMAFGDPHYRTFDGRLLHFQGSCSYVLAKDCHSGDFSVHVTNDDRGRSGVAWTQEVAVLLGDMAVRLLQDGAVTVDGHPVALPFLQEPLLYVELRGHTVILHAQPGLQVLWDGQSQVEVSVPGSYQGRTCGLCGNFNGFAQDDLQGPEGLLLPSEAAFGNSWQVQEGRGYPPGLELPPVLLQMEWSRRAQEQLLWDLELLTGVELGLFWPPQAQFFGPRGQAQQAWSQCCQPGGSTGGDPEQPILKASCDGSRL

SEQ ID NO: 2069 - protein, 199 aa, Homo sapiens
MTNGDLFLYECATSKAFPLETHRSRVACVEVSHKEQLVVSGSEDALLCLWDLQARKWKFEMSYTSSYCRGVQCACFSKDDKYVYVGLKDRSILVWSVLDGTLLTVQFVHAVVNRIIPTTSGFIAPTRHGYLIRENFQCLSAKASPQDPLKNFKKAMWMVKSRQREELVAAAGAPQDLESESAQGNETKSNKCSQVCLIV

SEQ ID NO: 2070 - protein, 218 aa, Homo sapiens [sequence omitted]

SEQ ID NO: 2071 - protein, 152 aa, Homo sapiens [sequence omitted]

SEQ ID NO: 2072 - protein, 509 aa, Homo sapiens
MRKKMAKLGREKDELEQELQKYKSLYGDVDSSLPTGEAGGPPSTREAELKLRLKLVEEEANILGRKIVELEVENRGLKAEMEDTRGQQEREGPGRDHAPSIPTSPFGDSLESSTELRRHLQFVEEEAELLRRSISEIEDHNRQLTHELSKFKFEPPREPGWLGEGASPGAGGGAPLQEELKSARLQISELSGKVLKLQHENHALLSNIQRCDLAAHLGLRAPSPRDSDAESDAGKKESDGEESRLPQPKREGPVGGESDSEEMFEKTSGFGSGKPSEASEPCPTELLKAREDSEYLVTLKHEAQRLERTVERLITDTDSFLHDAGLRGGAPLPGPGLQGEEEQGEGDQQEPQLLGTINAKMKAFKKELQAFLEQVNRIGGGLSPLPHLTESSSFLSTVTSVSRDSPIGNLGKELGPDLQMCPPAPLLILILVQTERAAGVAARAGPRGRAGEPAPPSRAGAAPPRRRGHREPRAGRPDLLQPGDGGGAPLCLEVERTGNAQPGFAKHPP

SEQ ID NO: 2073 - protein, 333 aa, Homo sapiens [sequence omitted]

SEQ ID NO: 2074 - protein, 231 aa, Homo sapiens [sequence omitted]

SEQ ID NO: 2075 - protein, 430 aa, Homo sapiens
MESPKLTRPFPTGTPPPLPPKNVPATPPRTGSPLTIGPGASSPARPATPLVPCRSTTPPPPPPRPPSRPKLPPGKPGVGDVSRPFSPPIHSSSPPPIAPLARAESTSSISSTNSLSAATTPTVVSEDDVFYDKLPSFERRCETPAGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 2076 - protein, 224 aa, Homo sapiens [sequence omitted]

SEQ ID NO: 2077 - protein, 167 aa, Homo sapiens
MASAEPLTALSRWYLYAIHGYFCEVMFTAAWEFVVNLNWKFPGVTSVWALFIYGTSILIVERMYLRLRGRCPLLLRCLIYTLWTYLWEFTTGFILRQFNACPWDYSQFDFDFMGLITLEYAVPWFCGALIMEQFIIRNTLRLRFDKDAEPGEPSGALALANGHVKTD

SEQ ID NO: 2078 - protein, 113 aa, Homo sapiens [sequence omitted]

SEQ ID NO: 2079 - protein, 316 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKVRMMAGVCPCGACSPPGPPLISSAFSRVCCGTLFPWS

SEQ ID NO: 2080 - protein, 113 aa, Homo sapiens
MGRCCCQWILFMKTHQRDAYWASAPKKGHDPPEQPVHVCLTDSRNHLINTIFQVCSSCCKAQDQSHGASLSPTKNFVVCVLHIDLVLHYFLSFSLHPLIWFRSVSLPKSHVKL

SEQ ID NO: 2081 - protein, 408 aa, Homo sapiens
MMCSRVPSEQSSGTSLLPKDGAPFSWDSLDEDGLDDSLLELSEGEEDDGDVNYTEEEIDALLKEDDPSYEQSSGEDDGGHVEKGERGSQILLDTPREKNSSYSLGPVAETPDLFKLPQLSTSSGHGPAHTKPLNRRSVLEKNLIKVTVAPFNPTVCDALLDKDETDSSKDTEKLSSLGEEMREDGLSPNESKLCTESEGISPNNSAWNGPQLSSSNNNFQQTVSDKNMPDSENPTSVFSRISDHSETPNMELSCRNGGSHKSSCEMRSLVVSTSSNKQDVLNKDSGKMKGHERRLGKVIPVLQTKTRTNVPTFSQSNLEQQKQLYLRSVIAHIEDPEDTNQGISGELCALMDQVHHMQHSKWQHPSDLTTRNYARRQKHLQRYSLTQWVDRNMRSHHRFQRLPDFSYS

SEQ ID NO: 2082 - protein, 161 aa, Homo sapiens
MMDPGLLKAPVLPCSPVSGLSTQVLWDGQSQVEVSVPGSYQGRTCGLCGNFNGFAQDDLQGPEGLLLPSEAAFGNSWQVQEGRGYPPGLELPPVLLQMEWSRRAQEQLLWDLELLTGVELGLFWPPQAQFFGPRGQAQQAWSQCCQPGGSTGGDPEQPVSG

SEQ ID NO: 2083 - protein, 454 aa, Homo sapiens
MRRLICKRICDYKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLKSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLGKRTDYGKLYHVLSLISVKTSSYTLIISIHSCYLRIVHMF

SEQ ID NO: 2084 - protein, 209 aa, Homo sapiens [sequence omitted]

SEQ ID NO: 2085 - protein, 166 aa, Homo sapiens [sequence omitted]

SEQ ID NO: 2086 - protein, 462 aa, Homo sapiens
MISTLATFPPFLHKDIIEYLSTSFLPMAILGSSRREGVPAHVNLSASSMLMIAMQYTSNPAWNPIHCQHIECHNAINKPAVKMCIDPSLSVALGDKPPPLYLCEECSERIAGDHSEWLIDVLLPQAEISAICQKKNCSSHVRRAVVTCFSAGCCGRHGNRPVRYCKRCHSNHHSNEVGAAAETHLYQTSPPPINTRECGAEELVCAVEAVISLLKEAEFHAEQREHELNRRRQLGLSHIRLLSWLLLGSLTHNAVCPNASSPCLPIPLDAGSHVADHLIVILIGFPEQSKTSVLHMCSLFHAFIFAQLWTVYCEQSAVATNLQNQNEFSFTAILTALEFWSRVTPSILQLMAHNKVMVEMVCLHVISLMEALQECNSTIFVKLIPMWLPMIQSNIKHLSAGLQLRLQAIQNHVNHHSLRTLPGSGQSSAGLAALRKWLQCTQFKMAQVEIQSSEAASQFYPL

SEQ ID NO: 2087 - protein, 201 aa, Homo sapiens
MAEVLKGLTCLLLLFAQKRGNVKHLVLFLHEAVLVQYVDTLKLAVPSLIYTLQNNLQYVAISNLPAATFQVSTLRRSSKAAQAPCGCATCNWASSAQHWAWWGSGGLRVPPWPPVVSFLGTHLLSGAWCSTRPSAGYWWLWLSSTLTISSRALPPPCPLCCPLLPPFASLASTWTHYLPLALDSSLVLSTSTAFPEVQPKP

SEQ ID NO: 2088 - protein, 293 aa, Homo sapiens [sequence omitted]

SEQ ID NO: 2089 - protein, 152 aa, Homo sapiens [sequence omitted]

SEQ ID NO: 2090 - protein, 125 aa, Homo sapiens
MSDISGQVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVRPAQARLVL

SEQ ID NO: 2091 - protein, 112 aa, Homo sapiens
MSLHFSTLSPIPPNSQQAHKHTQAHTCTCAHTHAHTQHTHTHMPSASSSLSHSHFSFQMLAFEKIPYFVSPSFSASLKSFRRGVLMVHLSVNRFGSVKLLPESHSLRVPFSF

SEQ ID NO: 2092 - protein, 454 aa, Homo sapiens
MIWEQNTATIVMVTNLKERKECKCAQYWPDQGCWTYGNIRVSVEDVTVLVDYTVRKFCIQQVGDMTNRKPQRLITQFHFTSWPDFGVPFTPIGMLKFLKKVKACNPQYAGAIVVHCSAGVGRTGAFVVIDAMLDMMHTERKVDVYGFVSRIRAQRCQMVQTDMQYVFIYQALLEHYLYGDTELEVTSLETHLQKIYNKIPGTSNNGLEEEFKKLTSIKIQNDKMRTGNLPANMKKNRVLQIIPYEFNRVIIPVKRGEENTDYVNASFIDGYRQKDSYIASQGPLLHTIEDFWRMIWEWKSCSIVMLTELEERGQEKCAQYWPSDGLVSYGDITVELKKEEECESYTVRDLLVTNTRENKSRQIRQFHFHGWPEVGIPSDGKGMISIIAAVQKQQQQSGNHPITVHCSAGAGRTGTFCALSTVLERVKAGDFGCLPDCQEPAATEATHGPDTGTV

SEQ ID NO: 2093 - protein, 115 aa, Homo sapiens
MHIHTYIHTPSRSPAPRLLSYVGNGMNPHLCLDHQSRSSRAGGGAAMCPDPHHPQSLGFPGKGFVQLPGLFFFFFSPCASLSPNLCTKAHCRQCWKRTAFERKRKRRLWFCFRPL

SEQ ID NO: 2094 - protein, 116 aa, Homo sapiens [sequence omitted]

SEQ ID NO: 2095 - protein, 140 aa, Homo sapiens [sequence omitted]

SEQ ID NO: 2096 - protein, 416 aa, Homo sapiens
MKRSKELITKNHSQEETSILRCWKCRKCIASSGCFMEYLENQVIKDKDDSVDAQNICHVWHMNVEALPEWISCLIQKAQWTVGKLNCPFCGARLGGFNFVSTPKCSCGQLAAVHLSKSRTDYQPTQAGRLMRPSVKYLSHPRVQSGCDKEALLTGGGSENRNHRLLNMARNNNDPGRLTEALCLEVRPTYFEMKNEKLLSKASEPKYQLFVPQLVTGRCATRAFHRKSHSLDLNISEKLTLLPTLYEIHSKTTAYSRLNETQPIDLSGLPLQSSKNSYSFQNPSSFDPSMLLQRFSVAPHETQTQRGGEFQCGLEAASVYSDHTNTNNLTFLMDLPSAGRSMPEASDQEEHLSPLDFLHSANFSLGSINQRLNKRERSKLKNLRRKQRRRERWLQKQGKYSGVGLLDHMVSIYLLI

SEQ ID NO: 2097 - protein, 111 aa, Homo sapiens
MQVPTNLTLRNLQALGTLAGGMSCEFLQQINSMVDFLEVVHMIYQLPTRVRGSLRACIWAELQRRMAMPEPEWTTVGPELNGLDSKLLLDLPCGVPPGDFVLSRSCSSVGS

SEQ ID NO: 2098 - protein, 134 aa, Homo sapiens
MLFTLPGTPVFSYGDEIGLDAAALPGQPMEAPVMLWDESSFPDIPGAVSANMTVKGQSEDPGSLLSLFRRLSDQRSKERSLLQASDLPASASLPAKADLLLSTQPGREEGSPLELERLKLEPHEGLLLRFPYAA

SEQ ID NO: 2099 - protein, 132 aa, Homo sapiens
MEKRKGSPSLNLIDSRLAPLAQQGYRNLRIPASQSSSPQQEFPWCPPVGKGQDRITLCHPHPPPSSQSHGIATTQQRAKESGSHTPLQMGRLSPGMVAHACNPRTLGGRGRWITSSQEFETSLANVVKPCCY

SEQ ID NO: 2100 - protein, 120 aa, Homo sapiens
MSILKFMTTDLKWALKIAEQSFQHCKTFLICLLSNSLKLLFCTFASHFKTPPSVGQAWWLRPIISVLWEAKVGGLLEPRLECGGMIMAHCRPPGLKRSSRLSLLSGWDHRYMSPCLANCF

SEQ ID NO: 2101 - protein, 120 aa, Homo sapiens [sequence omitted]

SEQ ID NO: 2102 - protein, 103 aa, Homo sapiens [sequence omitted]

SEQ ID NO: 2103 - protein, 580 aa, Homo sapiens
MDYPKMDYFLDVESAHRLLDVESAQRFFYSQGAQARRATLLLPPTLMAASSEDDIDRRPIRRVRSKSDTPYLAEARISFNLGAAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPDPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLESSEQRVPCSTSYHSSGLHSGDGVTKAGPMGLPEIRQVPTVVIECDDNKENVPHESDYEDSSCLYTREEEEEEEDEDDDSSLYTSSLAMKVCRKDSLAIKLSNRPSKRELEEKNILPRQTDEERLELRQQIGTKLTRRLSQRPTAEELEQRNILKPRNEQEEQEEKREIKRRLTRKLSQRPTVEELRERKILIRFSDYVEVADAQDYDRRADKPWTRLTAADKAAIRKELNEFKSTEMEVHELSRHLTRFHRP

SEQ ID NO: 2104 - protein, 262 aa, Homo sapiens
MLILMTSLAWDPTTVSTVEVLKKIDIPSVFIGESSANSLKDEFTYEKGGHLILVPEFSLPLEYYLIPFLIIVGICLILIVIFMITKFVQDRHRARRNRLRKDQLKKLPVHKFKKGDEYDVCAICLDEYEDGDKLRILPCSHAYHCKCVDPWLTKTKKTCPVCKQKVVPSQGDSDSDTDSSQEENEVTEHTPLLRPLASVSAQSFGALSESRSHQNMTESSDYEEDDNEDTDSSDAENEINEHDVVVQLQPNGERDYNIANTV

SEQ ID NO: 2105 - protein, 777 aa, Homo sapiens
MQCLGIRSRSRSRELYLQERSLKVAALNGRRLGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQKLQHWIHSCLRKADKNKDNKMSFKELQNFLKELNIQVDDSYARKIFRECDHSQTDSLEDEEIEAFYKMLTQRVEIDRTFAEAAGSGETLSVDQLVTFLQHQQREEAAGPALALSLIERYEPSETAKAQRQMTKDGFLMYLLSADGSAFSLAHRRVYQDMGQPLSHYLVSSSHNTYLLEDQLAGPSSTEAYIRALCKGCRCLELDCWDGPNQEPIIYHGYTFTSKILFCDVLRAIRDYAFKASPYPVILSLENHCTLEQQRVMARHLHAILGPMLLNRPLDGVTNSLPSPEQLKGKILLKGKKLGGLLPPGGEGGPEATVVSDEDEAAEMEDEAVRSRVQHKPKEDKLRLAQELSDMVIYCKSVHFGGFSSPGTPGQAFYEMASFSENRALRLLQESGNGFVRHNVGHLSRIYPAGWRTDSSNYSPVEMWNGGCQIVALNFQTPGPEMDVYQGRFQDNGACGYVLKPAFLRDPNGTFNPRALAQGPWWARKRLNIRVISGQQLPKVNKNKNSIVDPKVTVEIHGVSRDVASRQTAVITNNGFNPWWDTEFAFEVVVPDLALIRFLVEDYDASSKNDFIGQSTIPLNSLKQGYRHVHLMSKNGDQHPSATLFVKISLQD

SEQ ID NO: 2106 - protein, 205 aa, Homo sapiens
MSAQRLISNRTSQQSASNSDYTWEYEYYEIGPVSFEGLKAHKYSIVIGFWVGLAVFVIFMFIVLTLLTKTGAPHQDNAESSEKRFRMNSFVSDFGRPLEPDKVFSRQGNEESRSLFHCYINEVERLDRAKACHQTTALDSDVQLQEAIRSSGQPEEELNRLMKFDIPNFVNTDQNYFGEDDLLISEPPIVLETKPLSQTSHKDLD

SEQ ID NO: 2107 - protein, 106 aa, Homo sapiens
MELELTFGFYSFLKNVAEENTRVLYSLYGVVEHSGTMRSGHYTAYAKARTANSHLSNLVLHGDIPQDFEMESKGQWFHISDTHVQAVPTTKVLNSQAYLLFYERIL

SEQ ID NO: 2108 - protein, 776 aa, Homo sapiens [sequence omitted]

SEQ ID NO: 2109 - protein, 570 aa, Homo sapiens [sequence omitted]

SEQ ID NO: 2110 - protein, 108 aa, Homo sapiens
MLEAGGSDAATARGDFGAASYSDLAFRCASSQSPRSPEPVASISERRRRQPSRGTTGLGSPRPSWSHQVASNKGLKPGLRGCWSDGERGTTLEDTRVLLSNPLAKTSN

SEQ ID NO: 2111 - protein, 162 aa, Homo sapiens
MAWGLPCHQNTAGANPHLFLGCYSTSSLQGLEYGGQRGDAHGKPGVLHGELEPHDHTSRLERHDLHSQLPTSVQVRHHWWEGALDLAKKRQQQTSINVFTTIKQGSRCDRWMVLGAISLLYNQEEAPDDRPLRARREVRSQHLSWAFPGTAGPGLVCAGDSQ

SEQ ID NO: 2112 - protein, 123 aa, Homo sapiens
MRGWAKSMRFFSDLFIYLFIYLFLETESCSVTQAGVQWCDLSSLQPLPPGFKQFSCLSLLSSWDYRCPPPHPANFCIFSRDGVLPCWPSWSRTPDLVIRPPRPPQVLGLQASATMPGPCQPLF

SEQ ID NO: 2113 - protein, 198 aa, Homo sapiens
MHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPSPGPGPSPGPGPGPSPCPGPSPSPQ

SEQ ID NO: 2114 - protein, 116 aa, Homo sapiens [sequence omitted]

SEQ ID NO: 2115 - protein, 120 aa, Homo sapiens
MVCFHFADYCRNGILQCALVLSGSFHPAYFEIHLCCCSYLFFYFYFLRRSLALSPRLECSGQTSAHCKLRLLGSRHSPASASPVAGTTGARYHARLIFSVFLVETGFYHVSQDGLNLLTS

SEQ ID NO: 2116 - protein, 347 aa, Homo sapiens
MPYPKRPTVKDPGSVVVQGVSKQVARSAFLISRLTPAVAITNLYQNRFLGLAAMASPSRNSQSRRRCKEPLRYSYNPDQFHNMDLRGGPHDGVTIPRSTSDTDLVTSDSRSTLMVSSSYYSIGHSQDLVIHWDIKEEVDAGDWIGMYLIDEVLSENFLDYKNRGVNGSHRGQIIWKIDASSYFVEPETKICFKYYHGVSGALRATTPSVTVKNSAAPIFKSIGADETVQGQGSRRLISFSLSDFQAMGLKKGMFFNPDPYLKISIQPGKHSIFPALPHHGQERRSKIIGNTVNPIWQAEQFSFVSLPTDVLEIEVKDKFAKSRPIIKRFLGKLSMPVQRLLERHAIG

SEQ ID NO: 2117 - protein, 101 aa, Homo sapiens
MTNFQLASASTTPQCVLLKCFRDGPSPCWLWLGGHHHIPPCPASCALGGAGEYSASSTAYAVSWPLKILYSSLLFLYLSCDLAQNTLFLWVSLCSPILKIM

SEQ ID NO: 2118 - protein, 128 aa, Homo sapiens
MVHPKLFKCQSRLPAPQLQCWALSSPSPSRLPAPQCQVLGPVLTLVLPAAQQAVRAARQAADFALKVEVECSSLQEAVQAAEAGADLVLLDNFKPEVRWALPPGRDLWWALTSPWLVSRRSCTPRPPC

SEQ ID NO: 2119 - protein, 260 aa, Homo sapiens
MMKKEKKSEALNIRGVLLHVMGDALGSVVVVITAIIFYVLPLKSEDPCNWQCYIDPSLTVLMVIIILSSAFPLIKETAAILLQMVPKGVNMEELMSKLSAVPGISSVHEVHIWELVSGKIIATLHIKYPKDRGYQDASTKIREIFHHAGIHNVTIQFENVDLKEPLEQKDLLLLCNSPCISKGCAKQLCCPPGALPLAHVNGCAEHNGGPSLDTYGSDGLSRRDAREVAIEVSLDSCLSDHGQSLNKTQEDQCYVNRTHF

SEQ ID NO: 2120 - protein, 252 aa, Homo sapiens
MVEKERVVEIAACHSAHTSAAKTQGGHVYMWGQCRGQSVILPHLTHFSCTDDVFACFATPAVSWRLLSVEHEDFLTVAESLKKEFDSPETADLKFRIDGKYIHVHKAVLKIRCEHFRSMFQSYWNEDMKEVIEIDQFSYPVYRAFLQYLYTDTVDLPPEDAIGLLDLATSYCENRLKKLCQHIIKRGITVENAFSLFSAAVRYDAEDLEEFCFKFCINHLTEVTQTAAFWQMDGPLLKEFIAKASKCGAFKN

SEQ ID NO: 2121 - protein, 116 aa, Homo sapiens [sequence omitted]

SEQ ID NO: 2122 - protein, 107 aa, Homo sapiens
MCIGISITTLFLLRWLRQGLAVLSTLECSGVQWHDHSSLQPRPPELKGASHLSLPSSWDYRRAPPCLANFCIFCREWVSPCYPRLVSNFWARVIRLPQPSKVLGLQV

SEQ ID NO: 2123 - protein, 447 aa, Homo sapiens
MEDLVQDGVASPATPGTGKSKLETLPKEDLIKFAKKQMMLIQKAKSRCTELEKEIEELRSKPVTEGTGDIIKALTERLDALLLEKAETEQQCLSLKKENIKMKQEVEDSVTKMGDAHKELEQSHINYVKEIENLKNELMAVRSKYSEDKANLQKQLEEAMNTQLELSEQLKFQNNSEDNVKKLQEEIEKIRPGFEEQILYLQKQLDATTDEKKETVTQLQNIIEANSQHYQKNINSLQEELLQLKAIHQEEVKELMCQIEASAKEHEAEINKLNELKENLVKQCEASEKNIQKKYECELENLRKATSNANQDNQICSILLQENTFVEQVVNEKVKHLEDTLKELESQHSILKDEVTYMNNLKLKLEMDAQHIKDEFFHEREDLEFKINELLLAKEEQGCVIEKLKSELAGLNKQFCYTVEQHNREVQSLKEQHQKEISELNETFLSD

SEQ ID NO: 2124 - protein, 320 aa, Homo sapiens
MVKRKSSEGQEQDGGRGIPLPIQTFLWRQTSAFLRPKLGKQYEASCVSFERVLVENKLHGLSPALSEAIQSISRWELVQAALPHVLHCTATLLSNRNKLGHQDKLGVAETKLLHTLHWMLLEAPQDCNNERFGGTDRGSSWGGSSSAFIHQVENQGSPGQPCQSSSNDEEENNRRKIFQNSMATAELFVFLFAPLVHRIKESDLTFRLASGLVIWQPMWEHRQPGVSGFTALVKPIRNIITAKRSSPINSQSRTCESPNQDARHLEGLQVVRETFQSDSISPKATISGCHRGNSFDGSLSSQTSQERGPSHSRSTFHFPP

SEQ ID NO: 2125 - protein, 131 aa, Homo sapiens
MSGLTRHQWIHTGEKPYVCIQCGKAFCRTTNLIRHFSIHTGEKPYECVECGKAFNRRSPLTRHQRIHTAEKSHEPIQSGNVSCECTDLIQHSIIHTESSPVSAVNMETPSIAAHSSSLDINGFIVEETLPL

SEQ ID NO: 2126 - protein, 278 aa, Homo sapiens
MHQSLLGCQRTKGSWEMLPSGWAMGHPSCSPRTPVPPMSSIPGSSGCLGVPFSAPEGCVPRPHAGLQATCPWISPSPPTELLQDLSNPPPRSHKQQQGKLDQALEGLGMWLKVAPCKCKASGSPTFILGKGIRLQVPQLPSSCLWCSRKPGMCTALSPAVGSWSRGIPVEGVLLSPCAHSLRGSRGWAHPQQHPLAGTRAPSARGAGCSHTHTHAQLSPCGLGLWRRLPRGLNILPLPDAQGLAWGASWKCHRLPLHSLVTHFPPTGFLNKCFQQFDP

SEQ ID NO: 2127 - protein, 364 aa, Homo sapiens
MLDLRHNKLREIPSVVYRLDSLTTLYLRFNRITTVEKDIKNLSKLSMLSIRENKIKQLPAEIGNLSSLSRLGLRYNRLSAIPRSLAKCSALEELNLENNNISTLPESLLSSLVKLNSLTLARNCFQLYPVGGPSQFSTIYSLNMEHNRINKIPFGIFSRAKVLSKLNMKDNQLTSLPLDFGTWTSMVELNLATNQLTKIPEDVSGLVSLEVLILSNNLLKKLPHGLGNLRKLRELDLEENKLESLPNEIAYLKDLQKLVLTNNQLTTLPRGIGHLTNLTHLGLGENLLTHLPEEIGTLENLEELYLNDNPNLHSLPFELALCSKLSIMSIENCPLSHLPPQIVAGGPSFIIQFLKMQGPYRAMV

SEQ ID NO: 2128 - protein, 635 aa, Homo sapiens
MPTVCGSSSRRISSTAVPWMNVFSSTPRRSRSRPGGPCPGREGGWLPLVGWPRAAGASQSGWFAFQLAQDDAWKCPHCQVLQQGMVKLSLWTLPDILIIHLKRFCQVGERRNKLSTLVKFPLSGLNMAPHVAQRSTSPEAGLGPWPSWKQPDCLPTSYPLDFLYDLYAVCNHHGNLQGGHYTAYCRNSLDGQWYSYDDSTVEPLREDEVNTRGAYILFYQKRNSIPPWSASSSMRGSTSSSLSDHWLLRLGSHAGSTRGSLLSWSSAPCPSLPQVPDSPIFTNSLCNQEKGGLEPRRLVRGVKGRSISMKAPTTSRAKQGPFKTMPLRWSFGSKEKPPGASVELVEYLESRRRPRSTSQSIVSLLTGTAGEDEKSASPRSNVALPANSEDGGRAIERGPAGVPCPSAQPNHCLAPGNSDGPNTARKLKENAGQDIKLPRKFDLPLTVMPSVEHEKPARPEGQKAMNWKESFQMGSKSSPPSPYMGFSGNSKDSRRGTSELDRPLQGTLTLLRSVFRKKENRRNERAEVSPQVPPVSLVSGGLSPAMDGQAPGSPPALRIPEGLARGLGSRLERDVWSAPSSLRLPRKASRAPRGSALGMSQRTVPGEQASYGTFQRVKYHTLSLGRKKTLPESSF

SEQ ID NO: 2129 - protein, 127 aa, Homo sapiens
MEVYVLTPLLYLVKLPVFRFIPFFFLRRTLVLSPRLKCSGAILAHYNLRLLGSSDSFASASQVAGITGMCHHTRLIFVFLVETGLRHVDQAGLNSSGNPPVLAFQGAGITGVSHWNLALFCFIFSLT

SEQ ID NO: 2130 - protein, 294 aa, Homo sapiens
MVPGEEPARELMAVLLTPRFRRLVSQNELPGPGLNGPSSRNRRDGFCRKRRTGCSGPFQATQLWDGIIHSLQAQVEIKRRRHHLQTYKDCFTGSDAVDVVLSHLMQNTCLSSNDISCLKGVHLCQVLMNHKVFEPVGMKKLFKKEKELEFEDSNISLYRFLGNKSSYDCCKRQKDAENEFNETLRPGYEMISNPLAQEIGEERIEELIHTINGNPALCPNITVQKPFLRLSKEDVWKEQTLLCLLQLIHLPFLDNILEPPVKTQNLQLNKEEDLVITNTCLDRELIPSLCLPEK

SEQ ID NO: 2131 - protein, 168 aa, Homo sapiens
MPLLRGLLWLQVLCAGPLHTEAVVLLVPSDDGRAFLLRSRLLHPEAHVPPAADRGASLQCVLHQAAPKSRPRSPAAGAALLHRPRRTGDEPCREFHGNGFPGPTQLTPGECGLPAPSSLLQHASAPVRTGSEGQVVGCPRARGETGEGLSLAFLSSLMFTSRNGLVGC

SEQ ID NO: 2132 - protein, 277 aa, Homo sapiens
MLSLVAPASPSLCCHCHSGCCNVPSFRRSAFGPPSNPRAGLEAVGSGQAAPWGVAPTEVWGWEEGGANGMELIFLSPSQFEVGPYGCILLTLSAILSRSTELIRQDFDVPTSHLIGAHGYCTQELVNLLLTGKAVSNVFNDVVELDSGDGNITLLRGIAARSDIGFLSLFEHYNMCQVGCFLKTPRFPIWVVCSESHFSILFSLQPGLLRDWRTERLFDLYYYDGLANQQEQIRLTIDTTQTISEDTDNDLVPPLELCIRTKWKGASVNWNGSDPIL

SEQ ID NO: 2133 - protein, 120 aa, Homo sapiens
MHADKCLCEHIKSACVGEHSTSGHCPSLHICGVWLIRLVFCHFTYFYLKYNDYLITIKCFISATPLWYFFHLISYLPPSLDFSVGPAGLRPSGKSQLFLNVFSLWPAQAGAVGVGAILWL

SEQ ID NO: 2134 - protein, 248 aa, Homo sapiens [sequence omitted]

SEQ ID NO: 2135 - protein, 139 aa, Homo sapiens [sequence omitted]

SEQ ID NO: 2136 - protein, 115 aa, Homo sapiens
MGCDGRVSGLLRRNLQPTLTYWSVFFSFGLCIAFLGPTVLVTGAGVGEMVLQMLVGSIFQAQGSYSFLVCGVIFGCLAFTFYILLLFFHRMHPGLPSVPTQDRSIGMENSECYQR

SEQ ID NO: 2137 - protein, 529 aa, Homo sapiens [sequence omitted]

SEQ ID NO: 2138 - protein, 226 aa, Homo sapiens
MIIANDATVKGGAYYPVTVKKQLRAQEIAMQNRLPCIYLVDSGGAYLPRQADVFPDRDHFGRTFYNQAIMSSKNIAQIAVVMGSCTAGGAYVPAMADENIIVRKQGTIFLAGPPLVKAATGEEVSAEDLGGADLHCRKSGVSDHWALDDHHALHLTRKVVRNLNYQKKLDVTIEPSEEPLFPADELYGIVGANLKRSFDVREVCESGTVSFMTSCESLCMCIYLQS

SEQ ID NO: 2139 - protein, 450 aa, Homo sapiens [sequence omitted]

SEQ ID NO: 2140 - protein, 543 aa, Homo sapiens
MTPSSSVPYMSPNQEVKSPFLPDLKPNLNSLHSSPSGSGPCDELRLTFPVRDGVVLEPFRLQHNLAVSNHVFQLRDSVYKTLIMRPDLELQFKCYHHEDRQMNTNWPASVQVSVNATPLTIERGDNKTSHKPLYLKHVCQPGRNTIQITVTACCCSHLFVLQLVHRPSVRSVLQGLLKKRLLPAEHCITKIKRNFSSGTIPGTPGPNGEDGVEQTAIKVSLKCPITFRRIQLPARGHDCRHIQCFDLESYLQLNCERGTWRCPVCNKTALLEGLEVDQYMLGILIYIQNSDYEEITIDPTCSWKPVPVKPDMHIKEEPDGPALKRCRTVSPAHVLMPSVMEMIAALGPGAAPFAPLQPPSVPAPSDYPGQGSSFLGPGTFPESFPPTTPSTPTLAEFTPGPPPISYQSDIPSSLLTSEKSTACLPSQMAPAGHLDPTHNPGTPGLHTSNLGAPPGPQLHHSNPPPASRQSLGQASLGPTGELAFSPATGVMGPPSMSGAGEAPEPALDLLPELTNPDELLSYLGPPDLPTNNNDDLLSLFENN

SEQ ID NO: 2141 - protein, 265 aa, Homo sapiens [sequence omitted]

SEQ ID NO: 2142 - protein, 157 aa, Homo sapiens
MKLKCIFGFATKETSCYNVTNIGFKSPSDFWQSVHSTLPRELAPCLVFNTSPNLALFSAAFAFIVVKDSAGDSDVVVQELKSMVATKIAKYAVPDEILVVKRLPKTRSGKVMRRLLRKIITSEAQELGDTTTLEDPSIIAEILSVYQKCKDKQAAAK

SEQ ID NO: 2143 - protein, 116 aa, Homo sapiens
MGPHSDKRVFADVIKDLKMKSSWTNQVGPRPHDTDRDTGRVPCDSGGRDWSDVSVPKEHQGLPAAPRRRWDGADALQSLQKEPNLILDFRPAELGENAFLFEVTKFVVICESSPRR

SEQ ID NO: 2144 - protein, 174 aa, Homo sapiens
MGLLSQRKWTLSGSQQTGCVALTVPSFPWVASRMHYGRKQVSWIIFLKIGAGCQVHVGHDCSTLRRQQGAPWSFASSFRPAASPLAPPSPGVSGLFPPHERWSGGSQTRCGKCVKMQILGSTLKLFRHPPSQVTRLWGRHHLKTPAPFLQSPGIQLNPGKVPASLLRLATWKPL

SEQ ID NO: 2145 - protein, 129 aa, Homo sapiens [sequence omitted]

SEQ ID NO: 2146 - protein, 186 aa, Homo sapiens
MLPVPGSAPRLGPPDASPSDLHLQSMPSALHPPSESHLPGPTSSDCPPPRALCPQVELTTVATQAGSLLHSLVLRAQELVLQLLALQLDRQEFVCLKFIILFSLDLKFLNNHILVKDAQEKANAALLDYTLCHYPHCGDKFQQLLLCLVEVRALSMQAKEYLYHKHLGNEMPRNNLLIEMLQAKQT

SEQ ID NO: 2147 - protein, 105 aa, Homo sapiens [sequence omitted]

SEQ ID NO: 2148 - protein, 151 aa, Homo sapiens
MGTSEHPNAPRWAAASGAGIWEDTAGSAGLLQGWPKASAAARSGTCPASSLPPSGTSLATLAVMTSWLIGPGPAHSSHACQKLEGCWRPIELMGAAGAGLRLLRPQNPRERHGGHMGPPGSLGMAPPALLKPRFPSTSTFQVTTRVSSSSS

SEQ ID NO: 2149 - protein, 160 aa, Homo sapiens [sequence omitted]

SEQ ID NO: 2150 - protein, 162 aa, Homo sapiens
MHLLPLDSSSTLTCTVPSACTKPPSRWRPTVDIFFVVTLLLTVFGEDDQSQDVLRLHQDINDYNRRFSGQPRSIMERIMDLPTLLRHAFREMFSVGGLFWMFRIRIILCLMGAFFYLISPLDFVPEALFGILGFLDDFFVIFLLLIYISIMYREVITQRLTR

SEQ ID NO: 2151 - protein, 260 aa, Homo sapiens
MTNFLKTEGQEQRLCPEYPTRRTLCSSDRGCKKGWMDPQSKGIQTGRCVVYEGNQKTCEVSAWCPIEAVEEAPRPALLNSAENFTVLIKNNIDFPGHNYTTRNILPGLNITCTFHKTQNPQCPIFRLGDIFRETGDNFSDVAIQGGIMGIEIYWDCNLDRWFHHCRPKYSFRRLDDKTTNVSLYPGYNFRYAKYYKENNVEKRTLIKVFGIRFDILVFGTGGKFDIIQLVVYIGSTLSYFGLVRDSLFHALGKWFGEGSD

SEQ ID NO: 2152 - protein, 253 aa, Homo sapiens
MSECPLILYIHKHIDTYSQSYLFNDLFYPVYSGGRMVTYEHLREVVFGKSEDEHYPLWKSVIGGMMAGVIGQFLANPTDLVKVQMQMEGKRKLEGKPLRFRGVHHAFAKILAEGGIRGLWAGWVPNIQRAALVNMGDLTTYDTVKHYLVLNTPLEDNIMTHGLSSLCSGLVASILGTPADVIKSRIMNQPRDKQGRGLLYKSSTDCLIQAVQGEGFMSLYKGFLPSWLRMTPWSMVFWLTYEKIREMSGVSPF

SEQ ID NO: 2153 - protein, 147 aa, Homo sapiens [sequence omitted]

SEQ ID NO: 2154 - protein, 702 aa, Homo sapiens [sequence omitted]

SEQ ID NO: 2155 - protein, 124 aa, Homo sapiens
MDPYSALTSAWKSSMHSVTSWSCACAWRMSACHRVVTVPSTLQRWCPQPPSPTQCSLTASPTHSTWRSSKPRFPVPRTFTPPCWTVPTRSRARHPHHLLALGALCEVGDREWGRQWLVGGVQRE

SEQ ID NO: 2156 - protein, 232 aa, Homo sapiens
MAEMEKEGRPPENKRSRKPAHPVKREINEEMKNFAENTMNELLGWYGYDKVELKDGEDIEFRSYPTDGESRQHISVLKENSLPKPKLPEDSVISPYNISTGYSGLATGNGLSDSPAGSKDHGSVPIIVPLIPPPFIKPPAEDDVSNVQIMCAWCQKVGIKRYSLSMGSEVKSFCSEKCFAACRRAYFKRNKARDEDGHAENFPQQHYAKETPRLAFKNNCELLVRITYLQQV

SEQ ID NO: 2157 - protein, 139 aa, Homo sapiens
MMKTITRLHKAMVFLEYFTSNSWVWNTENVNMLMNQLNPEDKKTFNIDVRQLHWAEYIENYCLGTKKYVLNEEMSGLPAARKHLNKLRNIRYGFNTILVILIWRIFIARSQMARNIWYFVVSLCYKFLSYFRASSTMRY

SEQ ID NO: 2158 - protein, 200 aa, Homo sapiens
MPLVEERHRILNETGKILLEKFGGSFLNCVRESENSAQKLMHLVVESFPSYRDVTLFEGKRVSFYKRAQILVADTWSVLEGKGDGCFKDISSITMFADYRLPQVLAHLGALKYSDDLLKKLLKGEMLSYGDRQEVEIRGCSLWCVELIRDCLLELIEQKGEKPNGEINSILLDYYLWDYAHDYREDMKGIPFHRIRCIYY

SEQ ID NO: 2159 - protein, 186 aa, Homo sapiens
MESTLSASNMQDPSSSPLEKCLGSANGNGDLDSEEGSSLEETGFNWGEYLEETGASAAPHTSFKHVEISIQSNFQPGMKLEVANKNNPDTYWVATIITTCGQLLLLRYCGYGEDRRADFWCDVVIADLHPVGWCTQNNKVLMPPDAIKEKYTDWTEFLIRDLTGSRTAPANLLEGVCIVVIHLMYL

SEQ ID NO: 2160 - protein, 108 aa, Homo sapiens
MSTASLNIVGCHPDTSICAAEEISSFSRIIMMDIETSGCRTNTCSSSWMLKNWVTCQAVSLGWAMRISSKKHAVLCPSHNQHTRDLSPGTPKFKSGLQIFWRPWPCYM

SEQ ID NO: 2161 - protein, 541 aa, Homo sapiens
MRLKMTTRNFPEREVPCDVEVERFTREVPCLSSLGDGWDCENQEGHLRQSALTLEKPGTQEAICEYPGFGEHLIASSDLPPSQRVLATNGFHAPDSNVSGLDCDPALPSYPKSYADKRTGDSDACGKGFNHSMEVIHGRNPVREKPYKYPESVKSFNHFTSLGHQKIMKRGKKSYEGKNFENIFTLSSSLNENQRNLPGEKQYRCTECGKCFKRNSSLVLHHRTHTGEKPYTCNECGKSFSKNYNLIVHQRIHTGEKPYECSKCGKAFSDGSALTQHQRIHTGEKPYECLECGKTFNRNSSLILHQRTHTGEKPYRCNECGKPFTDISHLTVHLRIHTGEKPYECSKCGKAFRDGSYLTQHERTHTGEKPFECAECGKSFNRNSHLIVHQKIHSGEKPYECKECGKTFIESAYLIRHQRIHTGEKPYGCNQCQKLFRNIAGLIRHQRTHTGEKPYECNQCGKAFRDSSCLTKHQRIHTKETPYQCPECGKSFKQNSHLAVHQRLHSREGPSRCPQCGKMFQKSSSLVRHQRAHLGEQPMET

SEQ ID NO: 2162 - protein, 239 aa, Homo sapiens
MQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 2163 - protein, 252 aa, Homo sapiens
MGRLSWQVAAAAAVGLALTLEALPWVLRWLRSRRRRPRREALFFPSQVTCTEALLRAPGAELAELPEGCPCGLPHGESALSRLLRALLAARASLDLCLFAFSSPQLGRAVQLLHQRGVRVRVVTDCDYMALNGSQIGLLRKAGIQVRHDQDPGYMHHKFAIVDKRVLITGSLNWTTQAIQNNRENVLITEDDEYVRLFLEEFERIWEQFNPTKYTFFPPKKSHGSCAPPVSRAGGRLLSWHRTCGTSSESQT

SEQ ID NO: 2164 - protein, 250 aa, Homo sapiens
MFGECCFQTGDVKLTMGTGTFLDINTGNSLQQTTGGFYPLIGWKIGQEVVCLAESNAGDTGTAIKWAQQLDLFTDAAETEKMAKSLEDSEGVCFVPSFSGLQAPLNDPWACASFMGLKPSTSKYHLVRAILESIAFRNKQLYEMMKKEIHIPVRKIRADGGVCKNGFVMQMTSDLINENIDRPADIDMSCLGAASLAGLAVGFWTDKEELKKLRQSEVVFKPQKKCQEYEMSLENWAKAVKRSMNWYNKT

SEQ ID NO: 2165 - protein, 109 aa, Homo sapiens
MMVHLLTGSFDSITSFTGITNAILIFSKHSEEVGFSLLQIRYSEACFGALSCHCRPGFPLCITFLYHIVYDGASAINNGRLPGNISRVFGYFLNSHIDRWPRSIWINSR

SEQ ID NO: 2166 - protein, 111 aa, Homo sapiens [sequence omitted]

SEQ ID NO: 2167 - protein, 133 aa, Homo sapiens
MYRQGHAELRGIPEHTGTPACPWAVPISSRSSQVLWRGRQGTRGTHKRPDTITAPRTGQRRDMALGPDHQVMRAGGQRETRPQERRWPSAAQSTSWPQAPSNPTSLIPDEMPRLGVKVPELRGGASTTEKTVI

SEQ ID NO: 2168 - protein, 140 aa, Homo sapiens [sequence omitted]

SEQ ID NO: 2169 - protein, 308 aa, Homo sapiens [sequence omitted]

SEQ ID NO: 2170 - protein, 572 aa, Homo sapiens
MDRAGADMWASTFTLAMAERKPQDVWVLLPEHSLVPGCLDGGGVQYLLVGLSRLQCGHCPGTWDSAHVHVLFHLWWDRASHRGLVKMRIWGQRCRLCPAPEDCQVRPPGEQPFLSRLVLHILQDCYGDGPGPARHPREAYEGCCEACELGVCFLQKAPDPAWSANATKGNFPATAWGGTGTVSRGKPLSTPGDDLGKGGVVIAIPFSLVGTSNDQVPIAEGPAPPAGASLPVTGSCEALVTGQGSIFLSGDSVAMPGGKGFPVAIGDPLFHGPGLLGSSIQTFELKGFLFKGRGSLCSPVGVAQGWGPISLNNGLVPVGKHTPTVFYCVGLSASGEGSLTFPSSLTSIFTNTLSEPTDGPVATKEASITFPFIFTDVKDAVAEVAEGNGKEGGGQGLVPVGHDALPETNAGGLPSQVKGSLALPFPADVQGKDAFTDITEGKEKEGGLVTAGHDAPLEANAEGPITVSEGCITIPFAVFDVIKRKGGGHVAYGPQGNGCFSQGYYQKRQLRSRFHKARCGCRREEDERPGRACRRPHAEPYEDFWIWVSMTVCVFWLMCMCRLNPGIYPQQV

SEQ ID NO: 2171 - protein, 134 aa, Homo sapiens
MICRWPWIISSQRLRCCSRRRTASWRWRSAPSRSSACDCISVFSTSSSCTRHSRLSTSRCSSEPMRRGSVSSRRRPRARSSRQRCSSASFCLRSCFCSSTRAAMLSRAAATSGGSRMSGWSSPVSESFSLSSLA

SEQ ID NO: 2172 - protein, 116 aa, Homo sapiens
MNLSCSHYKNTDSFRDSIKNQLNTYNYCESIYLSKKVSLQPVGKFFLLFFWFVCLFVCLFDRDRVSLCCQALLGSSNPPASASQNAGITGMSHRVRLPGGKNNLRRWLKVEKPITW

SEQ ID NO: 2173 - protein, 124 aa, Homo sapiens [sequence omitted]

SEQ ID NO: 2174 - protein, 107 aa, Homo sapiens
MMEGLGEHSTAGEMGPLLGAVAATVSPQSLMEYSSDADFIESLPLVVKYRVYTLKKLQAKCAVLEAKYLREFHSVERKFATIYGPLLEKRRQITNALYEPTKEECER

SEQ ID NO: 2175 - protein, 114 aa, Homo sapiens [sequence omitted]

SEQ ID NO: 2176 - protein, 405 aa, Homo sapiens
MFLLAPVATGINSHNDRGRGIQGTINEQCASSLKIRASHGTKMMTPEVLAEAYGKKEWKHFLSDTGMACRSGKYYFYDNYFDLPGALLCARVVDYLTKLNNGQKTFDFWKDIVAAIQHNYKMSAFKENCGIYFPEIKRDPGRYLHSCPESVKKWLRQLKNAGKILLLITSSHSDYCRLLCEYILGNDFTDLFDIVITNALKPGFFSHLPSQRPFRTLENDEEQEALPSLDKPGWYSQGNAVHLYELLKKMTGKPEPKVVYFGDSMHSDIFPARHYSNWETVLILEELRGDEGTRSQRPEESEPLEKKGKYEGPKAKPLNTSSKKWGSFFIDSVLGLENTEDSLVYTWSCKRISTYSTIAIPSIEAIAELPLDYKFTRFSSSNSKTAGYYPNPPLVLSSDETLISK

SEQ ID NO: 2177 - protein, 531 aa, Homo sapiens
MQQEAAQRESEELQHVQWRPRAVSGWGVPQLLWYLVFLQPIITEVHLRRRNVQFLFIRFSAWQYAGTDKLWAGLVTTLCEGIRRHYGALPFSVYSVLGNKPATRQDCCQSEWHCRRRVCLGLLALLAALGLGVGLLYLSLGGHALGHGSPSGSLLKVFGGAATTLSGSGLLMAVYSVGKHLFVSQRKKIERLVSREKFGSQLGFMCEVKKEVELLTDFLCFLEIYQRRRLRVVLEVTGLDTCYPERVVGVLNAINTLLSDSHAPFIFILVVDPSILAACLESAGNMKGTADNGYLFLNRTVTLPFSVPIMGRRTKLQFLHDAVQSRDDLLYREMTHKPWLPGDAGGESAQLLAVQAQAGTERGQGRIDDEAARRIQEALFCLHDERDCLYEYVPDNVVSMRRIVNTVPITVRLLQQQQQQGDFGGPTPRQAVAWVVLANQWPCRLSWALQCLEDRQQTGGEPEGRARLWDVFRDTPHAAHRANSASRAPPSGRASGQAGEGHHTGDLAHRGKLWPVACALFRPGQSSPGGP

SEQ ID NO: 2178 - protein, 115 aa, Homo sapiens
MDHFEPYTSASQWPLHPRQKQQKSKEPLASGGGSRSALRKETGPAGGSPAPTHRSSYSRTNPPPTPSLRILSPGLGGGCRPVSLDKASGAFTPPAHQVQQRMKSREQNEASFSQS

SEQ ID NO: 2179 - protein, 227 aa, Homo sapiens
MTSGGGVGVNGGSMRPGGFLGAGQRLSRAMSRCVLEPRPPGKRWMVAGLGNPGLPGTRHSVGMAVLGQLARRLGVAESWTRDRHCAADLALAPLGDAQLVLLRPRRLMNANGRSVARAAELFGLTAEEVYLVHDELDKPLGRLALRLGGSARGHNGVRSCISCLNSNAMPRLRVGIGRPAHPEAVQAHVLGCFSPAEQELLPLLLDRATDLILDHIRERSQGPSLGP

SEQ ID NO: 2180 - protein, 565 aa, Homo sapiens
MNYEGARSERENHAADDSEGGALDMCCSERLPGLPQPIVMEALDEAEGLQDSQREMPPPPPPSPPSDPAQKPPPRGAGSHSLTVRSSLCLFAASQFLLACGVLRFSGYGHIWSQNATNLVSSLLTLLKQLEPTAWLDSGTWGVPSLLLVFLSVGLVLVTTLVWHLLRTPAEPPTPLPPEDRRQSVSRQPSFTYSEWMEEKIEDDFLDLDPVPETPVFDCVMDIKPEADPTSLTVKSMGLQERRGSNVSLTLDMCTPGCNEEGFGYLMSPREESAREYLLSASRVLQAEELHEKALDPFLLQAEFFEIPMNFVDPKEYDIPGLVRKNRYKTILPNPHSRVCLTSPDPDDPLSSYINANYIRGYGGEEKVYIATQGPIVSTVADFWRMVWQEHTPIIVMITNIEEMNEKCTEYWPEEQVAYDGVEITVQKVIHTEDYRLRLISLKSGTEERGLKHYWFTSWPDQKTPDRAPPLLHLVREVEEAAQQEGPHCAPIIVHCSAGIGRTGCFIATSICCQQLRQEGVVDILKTTCQLRQDRGGMIQTCEQYQFVHHVMSLYEKQLSHQSPE

SEQ ID NO: 2181 - protein, 115 aa, Homo sapiens [sequence omitted]

SEQ ID NO: 2182 - protein, 269 aa, Homo sapiens
MLGPGQVRLRPRVWRDKAGGRVADGASGLPPARGSWREAGTGRALGASSPPRPAQGSSSPGIQSGPSSRPGSPRGAEQAGTPRPRLSLGISQATGSAARWRTRRTGKGLGYNSDEIRPRTLLIEHLMEGGRRDHHTMTVLWGTQEIIVAEFHKKIKEAFEVFDHESNNTVDVREIGTIIRSLGCCPTEGELHDLIAEVEEEEPTGYIRFEKFLPVMTEILLERKYRPIPEDVLLRAFEVLDSAKRGFLTKDELIKYMTEEDGVSLRRPG

SEQ ID NO: 2183 - protein, 174 aa, Homo sapiens
MPKSLEIYKGSCNWEESGLLGSCFSQGLALLPRVEWSGAILAHCIVDLPSSSDPPTSASHFSGLQAHTTTARWSLTLLPRLECSGTISAHYNLRLLGSSNSPVSASQVAETTEACHHTRLIFVFSVETGFHHVGQAGLKLLTSGDPPASASQSAGITGVSHSARPKSCFLQLLG

SEQ ID NO: 2184 - protein, 258 aa, Homo sapiens
MDELDWVRVIDHSQYLCRSWQKLYFPARVCRYIRIVGTHNTVNKIFHIVAFECMFTNKTFTLEKGLIVPMENVATIADCASVIEGVSRSRNALLNGDTKNYDWDSGYTCHQLGSGAIVVQLAQPYMIGSIRLLLWDCDDRSYSYYVEVSTNQQQWTMVADRTKVSCKSWQSVTFERQPASFIRIVGTHNTANEVFHCVHFECPEQQSSQKEENSEESGTGDTSLAGQQLDSHALRAPSGSSLPSSPGSNSRSPNRQHQ

SEQ ID NO: 2185 - protein, 120 aa, Homo sapiens [sequence omitted]

SEQ ID NO: 2186 - protein, 508 aa, Homo sapiens [sequence omitted]

SEQ ID NO: 2187 - protein, 112 aa, Homo sapiens [sequence omitted]

SEQ ID NO: 2188 - protein, 208 aa, Homo sapiens
MIVVLHVHFHMAMLPFPIFLVLLLRGLVLWTPASSGTIMPEERKTEIERETETESETVIGTEKENAPERERGSVITVLHQVFSTGLLAMKNDTDTGNMQKEVMSVTEQVEKKKNDIEKDDTGRKRKPDISLLEVIVDVAMKVKKEIVTGDTNTKNLKEAKKEKKRAVSLPLNRRAPKLHLQNRHGFGLLCILVPEVDTINLVIFLDNV

SEQ ID NO: 2189 - protein, 522 aa, Homo sapiens
MIDTGQKIKQFTGCHGNAEISTMALDANETRLLTGSTDGTVKIWDFNGYCHHTLNVGQDGAVDISQILILKKKILVTGWERAITVFRPQNFNQFFIQPEEWKGGIQHHDDILCAAFLPPQTLVTGSYDGEIVLWNNSTENAHHVLHPDYQRLLKSKLDTKPQKLLSAGRSQPSHPMADHSTTGVRNFEIDTEGKNAVMRLCFLKARKNTAVTGGANLVSCGGSGYVRFWDIYKKQLLAEFLAHSGVGSIIMSTDKMNRYLTTGDLDGWLKIWNIEEYCLNSSKNKITKAPTLIRSFQPHEDRISSLEMCEPGGQLLIISSSADCSICVTGVCNAPVWIFGQAKHWHIENCLFLPKRDTNLVESEIQKEISLFSKEESCLDPTEHSLLNKKNKDDSTYNVRPSEDINLDIKYKERSTCMKETQKPYYGEVIKKSFSTFRSLNIGALEELPEVNKPAFLLDPEKYFRKEPEEERPQILEAPSLFKTLKAVFDEKNLFPKEILHHERKAKQLCQEKSCEVKKNKK

SEQ ID NO: 2190 - protein, 218 aa, Homo sapiens
MLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 2191 - protein, 274 aa, Homo sapiens [sequence omitted]

SEQ ID NO: 2192 - protein, 263 aa, Homo sapiens
MVVDSQLYVVVAQLFGGSYIYHWDPNTTRFTRLQDIDPQRVRKPNDLEAFRIDGDWYFAVADSSKAGATSLYRWHQNGFYSHQALHPWHRDTDLEFVDGEGKPRLIVSSSSQAPVIYQWSRTQKQFVAQGEVTQVPDAQAVKHFRAGRDSYLCLSRYIGDSKILRWEGTRFSEVQALPSRGSLALQPFLVGGRRYLALGSDFSFTQIYQWDEGRQKFVRFQELAVQAPRAFCYMPAGDAQLLLAPSFKGQTLVYRHIVVDLSA

SEQ ID NO: 2193 - protein, 101 aa, Homo sapiens [sequence omitted]

SEQ ID NO: 2194 - protein, 199 aa, Homo sapiens
MTPVSLLKYNKSHLLQFPTSSSSPSETTSAWISLSILLSAFWSKPFNKSLGSSKLSHIFLSSSEPSKLFQPLPVTSSKVASTFLGIFSVVLHFWYQFIVLVHFHAADKDIPKPGQFTKERGLMDLQFHMAGEASQSWWKTRRSKSHLTWMAAGKKRACAGKLPFLKQSDLIKFIHHHKNGAGKTHPHNSITSHPVPLMT

SEQ ID NO: 2195 - protein, 246 aa, Homo sapiens [sequence omitted]

SEQ ID NO: 2196 - protein, 215 aa, Homo sapiens
MATRGSNGTICDNQRDCQPGLCCAFQRGLLFPVCTPLPVEGELCHDPASRLLDLITWELEPDGALDRCPCASGLLCQPHSHSLSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQP

SEQ ID NO: 2197 - protein, 136 aa, Homo sapiens [sequence omitted]

SEQ ID NO: 2198 - protein, 315 aa, Homo sapiens
MHGHGGYDSDFSDDERCGESSKRKKRTVEDDLLLQKPFQKEKHGKVAHKQVAAELLDREEARNRRFHLIAMDAYQRHTKFVNDYILYYGGKKEDFKRLGENDKTDLDVIRENHRFLWNEEDEMDMTWEKRLAKKYYDKLFKEYCIADLSKYKENKFGFRWRVEKEVISGKGQFFCGNKYCDKKEGLKSWEVNFGYIEHGEKRNALVKLRLCQECSIKLNFHHRRKEIKSKKRKDKTKKDCEESSHKKSRLSSAEEASKKKDKGHSSSKKSEDSLLRNSDEEESASESELWKGPLPETDEKSQEEEFDEYFQDLFL

SEQ ID NO: 2199 - protein, 626 aa, Homo sapiens
MLPARGCVRKRTVWPRLARVLIVTLLTLELSYAPLPCQLSGVPYNTGDPVGRWARPCIWPCPWHTTINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELEGLQRKLGRQEKMQETLVGLELENERLLAKLQSWERLDQTMGLSIRTPEDLSRFVVELQQRELALKDKNSAVTSSARGLEKARQQLQEELRQVSGQLLEERKKRETHEALARRLQKRVLLLTKERDGMRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVA

SEQ ID NO: 2200 - protein, 157 aa, Homo sapiens
MSKSCGNNLAAISVGISLLLLLVVCGIGCVWHWKHRVATRFTLPRFLQRRSSRRKVCTKTFLGPRIIGLRHEISVETQDHKSAVRGNNTHDNYENVEAGPPKAKGKTDKELYENTGQSNFEEHIYGNETSSDYYNFQKPRPSEVPQDEDIYILPDSY

SEQ ID NO: 2201 - protein, 342 aa, Homo sapiens [sequence omitted]

SEQ ID NO: 2202 - protein, 231 aa, Homo sapiens
MEKRPQNSHLDFHPAPSSTPRRRCLTRVPSPRLSSKTCTCFSWPLRDRQVHSLLSSEHQISPDCLRDLMTPPGMLSGWGSPLLVLHPLLGHILVSAHIPLPGYKACPRPLNLLGRFGAHGTPWVSVQEQQRRLTGPAPSALGVSGSPSSHPPNAYMLKLTEWASCLTASQRMSLISKCKLTFHPQASLPPAPFPMSTLLGKENGLLAFTLSRALEMPQACPELLLCTCSHF

SEQ ID NO: 2203 - protein, 241 aa, Homo sapiens
MNTNDAKEYLARREIPQLFESLLNGLMCSKPEDPVEYLESCLQKVKELGGCDKVKWDTFVSQEKKTLPPLNGGQSRRSFLRNESDTDLSETAELIEEYEVFDPTRPRPKIILVIGGPGSGKGTQSLKIAERYGFQYISVGELLRKKIHSTSSNRKWSLIAKIITTGELAPQETTITEIKQKLMQIPDEEGIVIDGFPRDVAQALSFEDQYSLRPQTKMPVQSDPLPYAAPCGVCPVRQDSP

SEQ ID NO: 2204 - protein, 430 aa, Homo sapiens
MLRVKEFIRFHQIPNPLRQRLEEYFQHAWSYTNGIDMNAVLKGFPECLQADICLHLHRALLQHCPAFSGAGKGCLRALAVKFKTTHAPPGDTLVHLGDVLSTLYFISRGSIEILRDDVVVAILGKNDIFGEPVSLHAQPGKSSADVRALTYCDLHKIQRADLLEVLDMYPAFAESFWSKLEVTFNLRDAAGGLHSSPRQAPGSQDHQGFFLSDNQSDAAPPLSISDASGLWPELLQEMPPRHSPQSPQEDPDCWPLKLGSRLEQLQAQMNRLESRVSSDLSRILQLLQKPMPQGHASYILEAPASNDLALVPIASETTSPGPRLPQGFLPPAQTPSYGDLDDCSPKHRNSSPRMPHLAVATDKTLAPSSEQEQPEGLWPPLASPLHPLEVQGLICGPCFSSLPEHLGSVPKQLDFQRHGSDPGFAGSWGH

SEQ ID NO: 2205 - protein, 218 aa, Homo sapiens [sequence omitted]

SEQ ID NO: 2206 - protein, 446 aa, Homo sapiens
MLGRPKSFIPSFQVYKLLYASRLADYGLVSQALHYREAIGAAVLSQGESSHPVLLVELIKLAEKLKLSDPLVLERRSGDRDLEPDWLAQLRRQLEQKVAGDIGDPHPTRSDISGARGTTTENTFYQDFSGCQGYSEAPGYRSALWLTPEQTCLLQPSPQQPFPLQPGSYPAGGGAGQTGTPRPFYSVPETHLPGTGSSVAVTEATGGTVWEEMLQTHLGPGENTVSQETSQPPDGQEVISKPQTPLAARPRSISESSASSAKEDEKESSDEADKNSPRNTAQRGKLGDGKEHTKSSGFGWFSWFRSKPTKNASPAGDEDSSDSPDSEETPRASSPHQAGLGLSLTPSPESPPLPDVSAFSRGRGGGEGRGSASSGGAAAGAGVGGLSGPESVSFELCSNPGVLLPPPALKGAVPLYNPSQVPQLPTATSLNRPNRLAQRRYPTQPC

SEQ ID NO: 2207 - protein, 295 aa, Homo sapiens
METCAGPHPLRLFLCRMQLCLALLLGPWRPGTAEEVILLDSKASQAELGWTALPSNGWEEISGVDEHDRPIRTYQVCNVLEPNQDNWLQTGWISRGRGQRIFVELQFTLRDCSSIPGAAGTCKETFNVYYLETEADLGRGRPRLGGSRPRKIDTIAADESFTQGDLGERKMKLNTEVREIGPLSRRGFHLAFQDVGACVALVSVRVYYKQCRATVRGLATFPATAAESAFSTLVEVAGTCVAHSEGEPGSPPRMHCGADGEWLVPEGRCSCSAGFQERGDFCEGIQLAGGRGVGV

SEQ ID NO: 2208 - protein, 249 aa, Homo sapiens [sequence omitted]

SEQ ID NO: 2209 - protein, 445 aa, Homo sapiens
MWAGSCTSISTRGSARQSHERLIDKSRVTCVKWVPGSESLFLVAHSSGNMYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVVSFNP

SEQ ID NO: 2210 - protein, 170 aa, Homo sapiens [sequence omitted]

SEQ ID NO: 2211 - protein, 360 aa, Homo sapiens
MQIIRHSEQTLKTALISKNPVLVSQYEKLDAGEQRLMNEAFQPASDLFGPITLHSPSDWITSHPEAPQDFEQFFSDPYRKTPSPNKRSIYIQSIGSLGNTRIISEEYIKWLTGYCKAYFYGLRVKLLEPVPVSVTRCSFRVNENTHNLQIHAGDILKFLKKKKPEDAFCVVGITMIDLYPRDSWNFVFGQASLTDGVGIFSFARYGSDFYSMHYKGKVKKLKKTSSSDYSIFDNYYIPEITSVLLLRSCKTLTHEIGHIFGLRHCQWLACLMQGSNHLEEADRRPLNLCPICLHKLQCAVGFSIVERYKALVRWIDDESSDTPGATPEHSHEDNGNLPKPVEAFKEWKEWIIKCLAVLQK

SEQ ID NO: 2212 - protein, 218 aa, Homo sapiens [sequence omitted]

SEQ ID NO: 2213 - protein, 117 aa, Homo sapiens [sequence omitted]

SEQ ID NO: 2214 - protein, 119 aa, Homo sapiens
MSIYLCTYMAYFSTGIQYIIIASGLSEASFTHSISPLFYKQSKPTLFKNFLLLLFLLLLRRSLALSPRLECAISARCKLHFPGSRHFPASASRAAGTTGAHHHARLIFCIFSRDGVSPC

SEQ ID NO: 2215 - protein, 151 aa, Homo sapiens
MFYGNSDLMGSKLVHISRNYFIFSRQSFTLVGQAGVQWRDLGSPQPLLPGFKRFSCLSLPSSWDYRHTPPHPANFFVFLLETGFLHVGQAGLELPTSGDPPTSASQSDDFIFIFNCINLHLDNDFVKGVCCVQNLRYWLRVKYIIFIICWV

SEQ ID NO: 2216 - protein, 243 aa, Homo sapiens
MRGESYFIGMRSPGQQGHVPEDGGLFLLCCIDRDWAVTRCFAEEAFQAITDFNDLPNSLFACNVHQSVFEGEESKEKFEGLFRTYDDCVTFQLFKSFRRVRINFSNPKSAARARIELHETQFRGKKLKLYFAQVQTPETDGDKLHLAPPQPAKQFLISPPSSPPVGWQPINDATPVLNYDLLYAVAKLGPGEKYELHAGTESTPSVVVHVCDSDIEEEEDPKTSPKPKIIQTRRPGLPPSVSN

SEQ ID NO: 2217 - protein, 666 aa, Homo sapiens
MASSPWGCVCGLLLLLLPLLGTGPALGRGFPRPLENSEIPMIPGAHPKGSVGSEPQAFDVFPENPRADSHRNSDVRHAPAEEMPEKPVASPLGPALYGPKAAQGAQRERLPVTDDLQMAQGPSSHGWTGPLDSQELLEQEAVAPHPVGHPHLTFIPTTPRRQLRVATVPPSLQHEGQEGQWPPRDEGLKAKTKSRVPPTSPSDHQGPPHTLVPHSGTVKRPVLEGQGGFEEHFQEAAQGPHFTQQDPAAPDVGSVPPVEVVYSQEPGAQPDLALARSLPPAEELPVETPKRAGAEVSWEVSSPGPPPKQADLPDAKDSPGPQPTDPPASEAPDGPSKPERAAMNGADPISPQRVRGAVEAPGTPKSLIPGPSDPGPAVNRTESPMGALQPDEAEEWPGRPQSHPPAPPVQAPSTSRRGLIRVTTQRALGQPPPPEPTASSMASAPASSPPANATAPPLRWGPLRRVLSFSWELHVYGVGVLFLLPALLALAALAAAPAGPRLALVAAVLVLVASALRSAYMLTDPYGSQARLGVRGGLVLYNLPFPLLLTALAALTLLGLGAGLPPPLQNPLLLGAVALVHGVGLLATDLLSTWSVLNLLTQGLSCAWGAAVALGTLCLCRRRLLDGPRGWDASPGPRLLAVAGALGLLASGLQLAAALWLYPGPG

SEQ ID NO: 2218 - protein, 106 aa, Homo sapiens
MSKARAAPRANCGISLGNATGEPFPAPVHFGRWNHSPFCSRLSDCLPGPGHRGQDRTRSSHLPLQLWGDKRNHFLPANSKIVRCKLFECRTPGLGSSSRSLWCGQW

SEQ ID NO: 2219 - protein, 469 aa, Homo sapiens [sequence omitted]

SEQ ID NO: 2220 - protein, 135 aa, Homo sapiens
MFTDPPAPPSPAGPWPGSTLEAAERGTSNGDPVWMPLGSSAVYLLPLTLNHTSGAWSCWGHIDWKGLGGTRSESQRRAGQPRDWQSWPQKLLVPLRFKYPLLLPQVTDRVKTEAGFKPRAHALPSFPDWSVFLAG

SEQ ID NO: 2221 - protein, 575 aa, Homo sapiens
MASWLRRKLRGKRRPVIAFCLLMILSAMAVTRFPPQRPSAGPDPGPMEPQGVTGAPATHIRQALSSSRRQRARNMGFWRSRALPRNSILVCAEEQGHRARVDRSRESPGGDLRHPGRVRRDITLSGHPRLSTQHVVLLREDEVGDPGTKDLGHPQHGSPIQETQSEVVTLVSPLPGSDMAALPAWRATSGLTLWPHTAEGRDLLGAENRALTGGQQAEDPTLASGAYQWPGSVGKLQGSVWCDAETLLSSSRTGGQAPPWLTDHDVQMLRLLAQGEVVDKARVPAHGQVLQVGFSTEAALQDLSSPRLSQLCSQGLCGLIKRPGDLPEVLSFHVDRVLGLRRSLPAVARRFHSPLLPYRYTDGGARPVIWWAPDVQHLSDPDEDQNSLALGWLQYQALLAHSCNWPGQAPCPGIHHTEWARLALFDFLLQVHDRLDRYCCGFEPEPSDPCVEERLREKCRNPAELRLVHILVRSSDPSHLVYIDNAGNLQHPEDKLNFRLLEGIDGFPESAVKVLASGCLQNMLLKSLQMDPVFWESQGGAQGLKQVLQTLEQRGQVLLGHIQKHNLTLFRDEDP

SEQ ID NO: 2222 - protein, 185 aa, Homo sapiens [sequence omitted]

SEQ ID NO: 2223 - protein, 301 aa, Homo sapiens [sequence omitted]

SEQ ID NO: 2224 - protein, 724 aa, Homo sapiens
MLSGVWFLSVLTVAGILQTESRKTAKDICKIRCLCEEKENVLNINCENKGFTTVSLLQPPQYRIYQLFLNGNLLTRLYPNEFVNYSNAVTLHLGNNGLQEIRTGAFSGLKTLKRLHLNNNKLEILREDTFLGLESLEYLQADYNYISAIEAGAFSKLNKLKVLILNDNLLLSLPSNVFRFVLLTHLDLRGNRLKVMPFAGVLEHIGGIMEIQLEENPWNCTCDLLPLKAWLDTITVFVGEIVCETPFRLHGKDVTQLTRQDLCPRKSASDSSQRGSHADTHVQRLSPTMNPALNPTRAPKASRPPKMRNRPTPRVTVSKDRQSFGPIMVYQTKSPVPLTCPSSCVCTSQSSDNGLNVNCQERKFTNISDLQPKPTSPKKLYLTGNYLQTVYKNDLLEYSSLDLLHLGNNRIAVIQEGAFTNLTSLRRLYLNGNYLEVLYPSMFDGLQSLQYLYLEYNVIKEIKPLTFDALINLQLLFLNNNLLRSLPDNIFGGTALTRLNLRNNHFSHLPVKGVLDQLPAFIQIDLQENPWDCTCDIMGLKDWTEHANSPVIINEVTCESPAKHAGEILKFLGREAICPDSPNLSDGTVLSMNHNTDTPRSLSVSPSSYPELHTEVPLSVLILGLLVVFILSVCFGAGLFVFVLKRRKGVPSVPRNTNNLDVSSFQLQYGSYNTETHDKTDGHVYNYIPPPVGQMCQNPIYMQKEGDPVAYYRNLQEFSYGNLE

SEQ ID NO: 2225 - protein, 696 aa, Homo sapiens
MEVSSPSPAQRLRRKKRPMVQGPAGCQVFQPSPSGGTAGDPGGLSDPFYPPRSGSLALGDPSSDPACSQSGPMEAEEDSLPEQPEDSAQLQQEKPSLYIGVRGTVVRSMQEVLWTRLRELPDPVLSEEVVEGIAAGIEAALWDLTQGTNGRYKTKYRSLLFNLRDPRNLDLFLKVVHGDVTPYDLVRMSSMQLAPQELARWRDQEEKRGLNIIEQQQKEPCRLPASKMTHKGEVEIQRDMDQTLTLEDLVGPQMFMDCSPQALPIASEDTTGQHDHHFLDPNCHICKDWEPSNELLGSFEAAKSCGDNIFQKALSQTPMPAPEMPKTRELSPTEPQDRVPPSGLHVPAAPTKALPCLPPWEGVLDMFSIKRFRARAQLVSGHSCRLVQALPTVIRSAGCIPSNIVWDLLASICPAKAKDVCVVRLCPHGARDTQNCRLLYSYLNDRQRHGLASVEHMGMVLLPLPAFQPLPTRLRPLGGPGLEVTHSSLLLAVLLPKEGLPDTAGSSPWLGKVQKMVSFNSKVEKRYYQPDDRRPNVPLKGTPPPGGAWQQSQGRGSIAPRGISAWQRPPRGRGRLWPEPENWQHPGRGQWPPEPGLRQSQHPYSVAPAGHGFGRGQHFHRDSCPHQALLRHLESLATMSHQLQALLCPQTKSSIPRPLQRLSSALAAPEPPGPARDSSLGPTDEAGSECPFPRKA

SEQ ID NO: 2226 - protein, 113 aa, Homo sapiens
MIFLNEQRSQLRATHPDLPFTEIMKMLAVQWAQLSQDKKGEMNSMTSTAGPPGSSSAPCATRRNLLQRQHLQRLSGNQPGPGGSAANAGLDSTCARGHQQAAHVTPLVIKMQF

SEQ ID NO: 2227 - protein, 465 aa, Homo sapiens
MELPNYSRQLLQQLYTLCKEQQFCDCTISIGTIYFRAHKLVLAAASLLFKTLLDNTDTISIDASVVSPEEFALLLEMMYTGKLPVGKHNFSKIISLADSLQMFDVAVSCKNLLTSLVNCSVQGQVVRDVSAPSSETFRKEPEKPQVEILSSEGAGEPHSSPELAATPGGPVKAETEEAAHSVSQEMSVNSPTAQESQRNAETPAETPTTAEACSPSPAVQTFSEAKKTSTEPGCERKHYQLNFLLENEGVFSDALMVTQDVLKKLEMCSEIKGPQKEMIVKCFEGEGGHSAFQRILGKVREESLDVQTVVSLLRLYQYSNPAVKTALLDRKPEDVDTVQPKGSTEEGKTLSVLLLEHKEDLIQCVTQLRPIMESLETAKEEFLTGTEKRVILNCCEGRTPKETIENLLHRMTEEKTLTAEGLVKLLQAVKTTFPNLGLLLEKLQKSATLPSTTVQPSPDFPLHTL

SEQ ID NO: 2228 - protein, 104 aa, Homo sapiens
MPEGTHTGLRCQEILRPRREGTSSASGSLQRTLASWRDCTCHPTWTQPGQRPQPRRGRPMPRSLSQGNTRGWTFHMDLQGSLLQRNSKHSVSGGPPPREDPRSH

SEQ ID NO: 2229 - protein, 134 aa, Homo sapiens [sequence omitted]

SEQ ID NO: 2230 - protein, 199 aa, Homo sapiens [sequence omitted]

SEQ ID NO: 2231 - protein, 201 aa, Homo sapiens
MPRPAVAVGPHPATGTQARRLGLEPPWVSAARLPRTLRPSRSLGTCRSVRPAAGAPDSVPAREGHDFPPGAPGDQLAAVFVPGAECPRAPLAGPAATALARQPVAGGGGRGSGASSVVHLARGGVFIPAMGGALCDVVLQTERKGGSGVVLHQWGHNKQTWSILGLLHALPEPVPAAGGSPGERLWPLQLLRECARQTRQI

SEQ ID NO: 2232 - protein, 246 aa, Homo sapiens [sequence omitted]

SEQ ID NO: 2233 - protein, 194 aa, Homo sapiens
MFPRPVLNSRAQAILLPQPPNMLDHRQWPPRLASFPFTKTGMLSRATSVLAGLTAHLWDLGGGAGRRTSKAQRVHPQPSHQRQPPPPQHPGPYQERIWVGGEGWGEVGGLRLSKVGRRDREVRRGLRAPAGRGRAMGGMPRMGTVGDFGQALSSLAWTSTCFQDFCLPSLPGKLPAPLISKQQFLSNSSRSLFN

SEQ ID NO: 2234 - protein, 123 aa, Homo sapiens
MSLVHNACLHYSLSHKVFTLLLNCLIVPLPWMRTASLPSLILSGLAKTFTDSMGKLHLQRKEPSSCGQVMCPCSFPDVPSPLASDLKGCTSLAAGRGVKKVLASPSPSAMILSFLTPPSRASC

SEQ ID NO: 2235 - protein, 321 aa, Homo sapiens
MKHCLMVHQRTHTGEKPYKCNECGKGFALKSPLIRHQRTHTGEKPYVCTECRKGFTMKSDLIVHQRTHTAEKPYICNDCGKGFTVKSRLIVHQRTHTGEKPYVCGECGKGFPAKIRLMGHQRTHTGEKPYICNECGKGFTEKSHLNVHRRTHTGEKPYVCSECGKGLTGKSMLIAHQRTHTGEKPYICNECGKGFTMKSTLSIHQQTHTGEKPYKCNECDKTFRKKTCLIQHQRFHTGKTSFACTECGKFSLRKNDLITHQRIHTGEKPYKCSDCGKAFTTKSGLNVHQRKHTGERPYGCSDCGKAFAHLSILVKHKRIHR

SEQ ID NO: 2236 - protein, 159 aa, Homo sapiens
MAPIWLPWVAKVSRGALPTDWHPHYFCPGGLGRGLGHSGTLWGSGDCQLPRGWRSCCSVPIGTSWESGDLHQGPELTLTVLSALVFSSPTYLLISLSHTKPPLHSPLPSSIPFPAFVLYDAVTWVRKLIKVIIPCTEMCLSSHSYLMFLPLDLLMLFNS

SEQ ID NO: 2237 - protein, 181 aa, Homo sapiens [sequence omitted]

SEQ ID NO: 2238 - protein, 217 aa, Homo sapiens [sequence omitted]

SEQ ID NO: 2239 - protein, 366 aa, Homo sapiens
MMSSSWPGTSPRLSRGSGSCLTSGATGPCQADSSLKAGPGAGVFFLSSAEGEQISFLFDCIVRGISPTKGPFGLRPVLPDPSPPGPSTVEERVAQEALETLQLEKRLSLLSHAGRPGSGGDDRSLSSSSSEASHLDVSASSRLTAWPEQSSSSASTSQEGPRPAAAQAAGEAMVGASRPPPKPLRPRQLQEVGRQSSSDSGIATGSHSSYSSSLSSYAGSSLDVWRATDELGSLLSLPAAGAPEPSLCTCLPGTVEYQVPTSLRAHYDTPRSLCLAPRDHSPPSQGSPGNSAARDSGGQTSAGCPSGWLGTRRRGLVMEAPQGSEATLPGPAPGEPWEAGGPHAGPPPAFFSACPVCGGLKVNPPP

SEQ ID NO: 2240 - protein, 484 aa, Homo sapiens
MGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFGKICRTSPHSFAFYSDDHGRTWRCGGLVPNLRSGECQLAAVDGGQAGSFLYCNARSPLGSRVQALSTDEGTSFLPAERVASLPETAWGCQGSIVGFPAPAPNRPRDDSWSVGPGSPLQPPLLGPGVHEPPEEAAVDPRGGQVPGGPFSRLQPRGDGPRQPGPRPGVSGDVGSWTLALPMPFAAPPQSPTWLLYSHPVGRRARLHMGIRLSQSPLDPRSWTEPWVIYEGPSGYSDLASIGPAPEGGLVFACLYESGARTSYDEISFCTFSLREVLENVPASPKPPNLGDKPRGCCWPS

SEQ ID NO: 2241 - protein, 643 aa, Homo sapiens
MLENYGNVASLGFPLLKPAVISQLEGGSELGGSSPLAAGTGLQGLQTDIQTDNDLTKEMYEGKENVSFELQRDFSQETDFSEASLLEKQQEVHSAGNIKKEKSNTIDGTVKDETSPVEECFFSQSSNSYQCHTITGEQPSGCTGLGKSISFDTKLVKHEIINSEERPFKCEELVEPFRCDSQLIQHQENNTEEKPYQCSECGKAFSINEKSIWHQRLHSGEKPFKCVECGKSFSYSSHYITHQTIHSGEKPYQCKMCGKAFSVNGSLSRHQRIHTGEKPYQCKECGNGFSCSSAYITHQRVHTGEKPYECNDCGKAFNVNAKLIQHQRIHTGEKPYECNECGKGFRCSSQLRQHQSIHTGEKPYQCKECGKGFNNNTKLIQHQRIHTGEKPYECTECGKAFSVKGKLIQHQRIHTGEKPYECNECGKAFRCNSQFRQHLRIHTGEKPYECNECGKAFSVNGKLMRHQRIHTGEKPFECNECGRCFTSKRNLLDHHRIHTGEKPYQCKECGKAFSINAKLTRHQRIHTGEKPFKCMECEKAFSCSSNYIVHQRIHTGEKPFQCKECGKAFHVNAHLIRHQRSHTGEKPFRCVECGKGFSFSSDYIIHQTVHTWKKPYMCSVCGKAFRFSFQLSQHQSVHSEGKS

SEQ ID NO: 2242 - protein, 264 aa, Homo sapiens
MMDCTWTLPGMRATWQPAPFLPWDQTPWRVSFSWSPVLLAWGGVWSGEAHPCAHVLRPPASPCPPRPRRGCGDSGSSGMAQRAQAGSNQSRGKCGRDGRCPPRSSPGAPEAAERVESAETRGPGKSWILSPSSMSEPRRGKARRSPGRRRHPHSSFPQASSPSSPSRRETIPQVQSSGVPGAMSPEQTLFSRSPRGLSHLGQSLCRTVKESEAQRGKTMPPGSHSPSGAGQGRTARKGPAREEIPSSDSSAKPSVYPHPHLTAT

SEQ ID NO: 2243 - protein, 246 aa, Homo sapiens
MGQVASVDCTPPSLQTELLPPWGPRSSLPADCAPCLGTALLPPWGPCSSLPPCGPRSSLPGDRAPPSLRTALGPPWGPRPSLPADRAPPSLGTSLLPPSLRTVLLPPCGLCFSLPWSSLDLPELCQVGPGRPFPGPAVALSFLTCFHSCCPRWALGFVLLLKPFVLNLRGSRDWGIPSKELWLGAQKEGHRVLVGCPGSGPPPLPPPSLPASISVQGSPGPCSPLLSVSAERWPPLSPEGWGRGPG

SEQ ID NO: 2244 - protein, 110 aa, Homo sapiens
MAASSSSSSAGGVSGSSVTGSGFSVSDLAPPRKALFTYPKGAGEMLEDGSERFLCESVFSYQVASTLKQVKHDQQVARMEKLAGLVEELEADEWRFKPIEQLLGFTPSSG

SEQ ID NO: 2245 - protein, 138 aa, Homo sapiens
MAGILARCNLRLPGSSHSPISASQVAGITGMRHHGQLIFCIFSRDGVSPYWSAGLELQTSGDSPTSASQSAGITGMSHCAWPAIFFHDHKVTSSCLTKKQHISSLYCGNKEYWAKSEWLARASKHRPDQNFFSFFFSF

SEQ ID NO: 2246 - protein, 723 aa, Homo sapiens
MSVDMQLRHYEMQQQQFQHLYQEWEREFQLWEEQLHSYPHKDQLQEYEKQWKTWQGHMKATQSYLQEKVNSFQNMKNQYMGNMSMPPPFVPYSQMPPPLPTMPPPVLPPSLPPPVMPPALPATVPPPGMPPPVMPPSLPTSVPPPGMPPSLSSAGPPPVLPPPSLFSAGPPPVLPPPSLSSTAPPPVMPLPPLSSATPPPGIPPPGVPQGIPPQLTAAPVPPASSSQSSQVPEKPRPALLPTPVSFGSAPPTTYHPPLQSAGPSEQVNSKAPLSKSALPYSSFSSDQGLGESSAAPSQPITAVKDMPVRSGGLLPDPPRSSYLESPRGPRFDGPRRFEDLGSRCEGPRPKGPRFEGNRPDGPRPRYEGHPAEGTKSKWGMIPRGPASQFYITPSTSLSPRQSGPQWKGPKPAFGQQHQQQPKSQAEPLSGNKEPLADTSSNQQKNFKMQSAAFSIAADVKDVKAAQSNENLSDSQQEPPKSEVSEGPVEPSNWDQNVQSMETQIDKAQAVTQPVPLANKPVPAQSTFPSKTGGMEGGTAVATSSLTADNDFKPVGIGLPHSENNQDKGLPRPDNRDNRLEGNRGNSSSYRGPGQSRMEDTRDKGLVNRGRGQAISRGPGLVKQEDFRDKMMGRREDSREKMNRGEGSRDRGLVRPGSSREKVPGGLQGSQDRGAAGSRERGPPRGPGSRERGLGITLAGHQKKLLHHIQLLQQHLRQQGSVEV

SEQ ID NO: 2247 - protein, 102 aa, Homo sapiens
MMTKSPDRVDVQIYGLKLTDILIMPISRGTPDIISSCRKLKDTFSYIYPRMSVQSRWHHQKAPSFPMKRGKRVEKPHSHPCSATDKLCGIWHIMFSLYMRLK

SEQ ID NO: 2248 - protein, 267 aa, Homo sapiens
MLEQMQGVVRLELSGCNDFTEAGLWSSLSARITSLSVSDCINVADDAIAAISQLLPNLAELSLQAYHVTDTALAYFTARQGHSTHTLRLLSCWEITNHGVVNVVHSLPNLTALSLSGCSKVTDDGVELVAENLRKLRSLDLSWCPRITDMALEYVACDLHRLEELVLDRCVRITDTGLSYLSTMSSLRSLYLRWCCQVQDFGLKHLLALGSLRLLSLAGCPLLTTTGLSGLVQLQELEELELTNCPGATPELFKYFSQHLPRCLVIE

SEQ ID NO: 2249 - protein, 580 aa, Homo sapiens
MFAGLQDLGVANGEDLKETLTNCTEPLKAIEQFQTENGVLLPSLQSALPFLDLHGTPRLEFHQSVFDELRDKLLERVSAIASEGKAEERYKKLEDLLEKSFSLVKMPSLQPVVMCVMKHLPKVPEKKLKLVMADKELYRACAVEVKRQIWQDNQALFGDEVSPLLKQYILEKESALFSTELSVLHNFFSPSPKTRRQGEVVQRLTRMVGKNVKLYDMVLQFLRTLFLRTRNVHYCTLRAELLMSLHDLDVGEICTVDPCHKFTWCLDACIRERFVDSKRARELQGFLDGVKKGQEQVLGDLSMILCDPFAINTLALSTVRHLQELVGQETLPRDSPDLLLLLRLLALGQGAWDMIDSQVFKEPKMEVELITRFLPMLMSFLVDDYTFNVDQKLPAEEKAPVSYPNTLPESFTKFLQEQRMACEVGLYYVLHITKQRNKNALLRLLPGLVETFGDLAFGDIFLHLLTGNLALLADEFALEDFCSSLFDGFFLTASPRKENVHRHALRLLIHLHPRVAPSKLEALQKALEPTGQSGEAVKELYSQLGEKLEQLDHRKPSPAQAAETPALELPLPSVPAPAPL

SEQ ID NO: 2250 - protein, 284 aa, Homo sapiens
MPVFLHPALKLNIDSDLPLPQSPPCIPLEGPRLLALVSTFLSAAGNVLVCTVLLSLTCWLHVSMHRSAHFLPLTCRDHLSMHHSAHFLPLTCQDHVSVHRSPHFLPLTCRDHVSMHHSAHFLPLICQGHLSMHHSAHFTFFFSPAGIMLVCTVLHTFFLSPAGIMLVCTVLHTFFLSPAGIILACTILLTFFLSPAGIMLACTILHTFFLSPAGIMLACTVLHTCFPSPARNRLVFPILHTFFLSPAGIMLAYTILHTFFLCVRVCGFPFRNGSYSVDIFFHLK

SEQ ID NO: 2251 - protein, 167 aa, Homo sapiens [sequence omitted]

SEQ ID NO: 2252 - protein, 267 aa, Homo sapiens
MLRPAGLWRLCRRPWAARVPAENLGRREVTSGVSPRGSTSPRTLNIFDRDLKRKQKNWAARQPEPTKFDYLKEEVGSRIADRVYDIPRNFPLALDLGCGRGYIAQYLNKETIGKFFQADIAENALKNSSETEIPTVSVLADEEFLPFKENTFDLVVSSLSLHWVNDLPRALEQIHYILKPDGVFIGAMFGGDTLYELRCSLQLAETEREGGFSPHISPFTAVNDLGHLLGRAGFNTLTVDTDEIQVNYPGMFELMEDLQEQKSRMLT

SEQ ID NO: 2253 - protein, 204 aa, Homo sapiens
MPVYAIIVANFCRSWTFYLLLISQPAYFEEVFGFEISKVGLVSALPHLVMTIIVPIGGQIADFLRSRRIMSTTNVRKLMNCGGFNVNHLDIAPRYASILMGISNGVGTLSGMVCPIIVGAMTKHKTREEWQYVFLIASLVHYGGVIFYGVFASGEKQPWAEPEEMSEEKCGFVGHDQLAGSDDSEMEDEAEPPGAPPAPPVRDY

SEQ ID NO: 2254 - protein, 492 aa, Homo sapiens
MARAWQHPFLNVFRHFRVDEWKRSAKQGDVAVVTDKTLKGAVYRIRGSVSAANYIQLPKSSTQSLGLTGRYLYVLFRPLPSKHFVIHLDVSSKDNQVIRVSFSNLFKEFKSTATWLQFPLVLEARTPQRDLVGLAPSGARWTCLQLDLQDVLLVYLNRCYGHLKSIRLCASLLVRNLYTSDLCFEPAISGAQWAKLPVTPMPREMAFPVPKGESWHDRYIHVRFPSESLKVPSKPIEKSCSPPEAVLLGPGPQPLPCPVASSKPVRFSVSPVVQTPSPTASGRAALAPRPFPEVSLSQERSDASNADGPGFHSLEPWAQLEASDIHTAAAGTHVLTHESAEVPVARTGSCEGFLPDPVLRLKGVIGFGGHGTRQALWTPDGAAVVYPCHAVIVVLLVDTGEQRFFLGHTDKVSALALDGSSSLLASAQARAPSVMRLWDFQTGRCLCLFRSPMHVVCSLSFSDSGALLCGVGKDHHGRTVTGPWLRVGVGLS

SEQ ID NO: 2255 - protein, 248 aa, Homo sapiens
MSWPSCSHSPTPCASQKATEMGVRLMVDAEQTYFQPAISRLTLEMQRKFNVEKPLIFNTYQCYLKDAYDNVTLDVELARREGWCFGAKLVRGAYLAQERARAAEIGYEDPINPTYEATNAMYHRCLDYVLEELKHNAKAKVMVASHNEDTVRFALRRMEELGLHPADHQVYFGQLLGMCDQISFPLGQAGYPVYKYVPYGPVMEVLPYLSRRALENSSLMKGTHRERQLLWLELLRRLRTGNLFHRPA

SEQ ID NO: 2256 - protein, 445 aa, Homo sapiens
MNGRSLIGGAGDARHGPVWKDPFGTKAGDAARRGIARLSLALADGSQEQEPEEEIAMEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 2257 - protein, 146 aa, Homo sapiens
MVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGYGPSLRLLAPPGAVKGTGQEHQGQGCH

SEQ ID NO: 2258 - protein, 159 aa, Homo sapiens [sequence omitted]

SEQ ID NO: 2259 - protein, 111 aa, Homo sapiens [sequence omitted]

SEQ ID NO: 2260 - protein, 107 aa, Homo sapiens
MLCSFYFKLFVIYNFIFYNICGFLFLFFCFWGVFFETESGAVTRLECSDAISAHCNLRLPGSSDSPASASQVAGTTGMRHHAQLIFVFLVETRFHRVGQDGLDLLTS

SEQ ID NO: 2261 - protein, 175 aa, Homo sapiens
MNSSIKLLIIVREPTTRAISDYTQVLEGKERKNKTYYKFEKLAIDPNTCEVNTKYKAVRTSIYTKHLERWLKYFPIEQFHVVDGDRLITEPLPELQLVEKFLNLPPRISQYNLYFNATRGFYCLRFNIIFNKCLAGSKGRIHPEVDPSVITKLRKFFHPFNQKFYQITGRTLNWP

SEQ ID NO: 2262 - protein, 427 aa, Homo sapiens [sequence omitted]

SEQ ID NO: 2263 - protein, 1217 aa, Homo sapiens
MAAGRAQVPSSEQAWLEDAQVFIQKTLCPAVKEPNVQLTPLVIDCVKTVWLSQGRNQGSTLPLSYSFVSVQDLKTHQRLPCCSHLSWSSSAYQAWAQEAGPNGNPLPREQLLLLGTLTDLSADLEQECRNGSLYVRDNTGVLSCELIDLDLSWLGHLFLFPRWSYLPPARWNSSGEGHLELWDAPVPVFPLTISPGPVTPIPVLYPESASCLLRLRNKLRGVQRNLAGSLVRLSALVKSKQKAYFILSLGRSHPAVTHVSIIVQVPAQLVWHRALRPGTAYVLTELRVSKIRGQRQHVWMTSQSSRLLLLKPECVQELELELEGPLLEADPKPLPMPSNSEDKKDPESLVRYSRLLSYSGAVTGVLNEPAGLYELDGQLGLCLAYQQFRGLRRVMRPGVCLQLQDVHLLQSVGGGTRRPVLAPCLRGAVLLQSFSRQKPGAHSSRQAYGASLYEQLVWERQLGLPLYLWATKALEELACKLCPHVLRHHQFLQHSSPGSPSLGLQLLAPTLDLLAPPGSPVRNAHNEILEEPHHCPLQKYTRLQTPSSFPTLATLKEEGQRKAWASFDPKALLPLPEASYLPSCQLNRRLAWSWLCLLPSAFCPAQVLLGVLVASSHKGCLQLRDQSGSLPCLLLAKHSQPLSDPRLIGCLVRAERFQLIVERDVRSIFPSWKELSMPGFIQKQQARVYVQFFLADALILPVPRPCLHSATPSTPQTDPTGPEGPHLGQSRLFLLCHKEALMKRNFCVPPGASPEVPKPALSFYVLGSWLGGTQRKEGTGWGLPEPQGNDDNDQKVHLIFFGSSVRWFEFLHPGQVYRLVAPGPATPMLFEKDGSSCISRRPLELAGCASCLTVQDNWTLELESSQDIQDVLDANKSLPESSLTDLLSDNFTDSLVSFSAEILSRTLCEPLVASLWMKLGNTGAMRRCVKLTVALETAECEFPPHLDVYIEDPHLPPSLGLLPGARVHFSQLEKRVSRSHNVYCCFRSSTYVQVLSFPPETTISVPLPHIYLAELLQGGQSPFQATASCHIVSVFSLQLFWVCAYCTSICRQGKCTRLGSTCPTQTAISQAIIRLLVEDGTAEAVVTCRNHHVAAALGLCPREWASLLDFVQVPGRVVLQFAGPGAQLESSARVDEPMTMFLWTLCTSPSVLRPIVLSFELERKPSKIVPLEPPRLQRFQCGELPFLTHVNPRLRLSCLSIRESEYSSSLGILASSC

SEQ ID NO: 2264 - protein, 522 aa, Homo sapiens
MSFGASFVSFLNAMMTFEEEKMQLACDDLKTTEKLCESEEAGVIETIKNKIKKNVDVRKSAPSMVDRLQRQIIIADCQVYLAVLSFVKQELSAYIKGGWILRKAWKIYNKCYLDINALQELYQKKLTEESLTSDAANDNHIVAEGVSEGSLNRLKGAVSFGYGLFHLCISMVPPNLLKIINLLGFPGDRLQGLSSLMYASVSKDMKAPLATLALLWYHTVVRPFFALDGSDNKAGLDEAKEILLKKEAAYPNSSLFMFFKGRIQRLECQINSALTSFHTALELAVDQREIQHVCLYEIGWCSMIELNFKDAFDSFERLKNESRWSQCYYAYLTAVCQGATGDVDGAQIVFKEVQKLFKRKNNQIEQFSVKKAERFRKQTPTKALCVLASIEVLYLWKALPNCSFPNLQRMSQACHEVDDSSVVGLKYLLLGAIHKCLGNSEDAVQYFQRAVKDELCRQNNLYVQPYACYELGCLLLDKPETVGRGRALLLQAKEDFSGYDFENRLHVRIHAALASLRELVPQ

SEQ ID NO: 2265 - protein, 430 aa, Homo sapiens [sequence omitted]

SEQ ID NO: 2266 - protein, 102 aa, Homo sapiens
MQGRERRGIPRFVGMLLLPLTLLLSPSALLCGDQGHWPPDPLHVVTEELGSYSRRKVGAAASRGLMSRLLSLRSQDWHVMREMSRRQEGTPWEVLMLSWGGS

SEQ ID NO: 2267 - protein, 413 aa, Homo sapiens [sequence omitted]

SEQ ID NO: 2268 - protein, 123 aa, Homo sapiens
MACLSPEPAELRPQHLHPFSAAAHKGSVHSASRCAPPLLEDSFSGCPRDFAAQHPCSISSCNISAEALLLLATLPSILWFRCLLLLLKMEFVFLSLKSFLLLDYFQKMKGGLLTLCHLQTRRS

SEQ ID NO: 2269 - protein, 206 aa, Homo sapiens
MRYGLFYNTPLISGCQNTGLFRAFAQHVLHRLNITQEGPKDGKIRVTILARSTEYRKILNQNELVNALKTVSTFEVQIVDYKYRELGFLDQLRITHNTDIFIGMHGAGLTHLLFLPDWAAVFELYNCEDERCYLDLARLRGVHYITWRRQNKVFPQDKGHHPTLGEHPKFTNYSFDVEEFMYLVLQAADHVLQHPKWPFKKKHDEL

SEQ ID NO: 2270 - protein, 140 aa, Homo sapiens
MVVPAALMAQGSLVSRWSSRFLSSCDFHPGPRTQPSVGTAGALSAHWRSSITEAQRTSLAPQTFRGTAMAAPSSAVRKVLGVRFATHVTGQCPIQIFQGRVRAALGDSLSSPALQRPCSLSSLTLQLVFLLDSASPKQTV

SEQ ID NO: 2271 - protein, 145 aa, Homo sapiens
MLSFVSRGRWRDLAAGEAAFPSSGVALPLQCSPPVMPRRAGSHLAILAWATQGTSPPPLLLLPPCEKSVCCSCPRPFLYFLFCSVGLCVYLFFSMTHCLDYCSIIVNLKSGSVISPTLFFFRFILVIPVPLPFHINLRTGLFMYL

SEQ ID NO: 2272 - protein, 734 aa, Homo sapiens
MGCNLCTFQKREEHYKLLYEVSQVNGKDLSKATHEEAVEAFRNAKEPIVVQVLRRTPLSRPAYGMASEVQLMNASTHTYITFEHIMALAKLRPPTPPVPDICPFLLSDSCHSLHPMEHEFYEDNEYISSLPADADRTEDFEYEEVELCRVSSQEKLGLTVCYRTDDEEDTGIYVSEVDPNSIAAKDGRIREGDRILQINGEDVQNREEAVALLSNDECKRIVLLVARPEIQLDEGWLEDERNEFLEELNLEMLEEEHNEAMQPTANEVEQPKKQEEEEGTTDTATSSSNNHEKDSGVGRTDESLRNDESSEQENAAEDPNSTSLKSKRDLGQSQDTLGSVELQYNESLVSGEYIDSDCIGNPDEDCERFRQLLELKCKIRNHGEYDLYYSSSTIECNQGEQEGVEHELQLLNEELRNIELECQNIMQAHRLQKVTDQYGDIWTLHDGGFRNYNTSIDMQRGKLDDIMEHPEKSDKDSSSAYNTAESCRSTPLTVDRSPDSSLPRVINLTNKKNLRSTMAATQSSSGQSSKESTSTKAKTTEQGCSAESKEKVLEGSKLPDQEKAVSEHIPYLSPYHSSSYRYANIPAHARHYQSYMQLIQQKSAVEYAQSQLSLVSMCKESQKCSEPKMEWKVKIRSDGTRYITKRPVRDRILKERALKIKEERSGMTTDDDTMSEMKMGRYWSKEERKQHLVRAKEQRRRREFMMRSRLECLKESPQSGSEGKKEINIIELSP

SEQ ID NO: 2273 - protein, 149 aa, Homo sapiens
MRPTGGSGQRGPRYTTSLLFHCLLPCSDHSSGAVSQAWASFNIFYLALHGAAPAMVPQGFFSQVSSLERSPRFPVKQPCSLCLSQPHHPVASFTACLTICNHLSVCRLVDLLPPHCQLLGNRDWFVYCASLVPRTGHGILLVHNKYCGN

SEQ ID NO: 2274 - protein, 408 aa, Homo sapiens
MLPRPKAPASPRRPQTPTPSEQDADPGPASPRDTEAQRLRFRQFQYHVASGPHLALGQLWTLCRQWLRPEARSKEQMLELLVLEQFLGALPSKMRTWVQSQGPRSCREAASLVEDLTQMCQQEVLVSLDSVGPQDWSFGEEEDGKSPRSQKEPSQASELILDAVAAAPALPEESEWLETTQLQQSLHTRAEAEAPRAPGLLGSRARLPLKPSIWDEPEDLLAGPSSDLRAEGTVISSPKGPSAQRISPRRRNRNTDQSGRHQPSLKHTKGGTQEAVAGISVVPRGPRGGRPFQCADCGMVFTWVTHFIEHQKTHREEGPFPCPECGKVFLHNSVLTEHGKIHLLEPPRKKAPRSKGPRESVPPRDGAQGPVAPRSPKRPFQCSVCGKAFPWMVHLIDHQKLHTAHGHM

SEQ ID NO: 2275 - protein, 242 aa, Homo sapiens
MEEFKNDMLTEKDARYLAVKEVLCHLIECNKDVPGISQINWVIHVVDSPIINAFVLPNGQMFVFTGFLNSVTDIHQLSFLLGHEIAHAVLGHAAEKAGMVHLLDFLGMIFLTMIWAICPRDSLALLCQWIQSKLQEYMFNRPYSRKLEAEADKIGLLLAAKACADIRASSVFWQQMEFVDSLHGQPKMPEWLSTHPSHGNRVEYLDRLIPQLVREEKFIEQPEQIAELTLNSFIQNTEICRS

SEQ ID NO: 2276 - protein, 262 aa, Homo sapiens
MWVLAQNCPLFAFFPLLSPRCSCISVLHFLLGLGLAHAASHLLSPQTPAHIFQTFSSKSVDIWGCLDLAEGFQHLAPCPKWSFTDLGTWAGAGAERVCVSLLLKSSTGQAQCPLSEAEPAPSPVSPQACLLHSELFLLSCPSEGKEQQLLRVDSPGLAAGIWNGHKLRVWARVWEGPCAAVGEELPTHSPSPVTALFPRSRKQPRPLTPGCCVWHVVHTDGERRPVVMSTCSSLTQMAGPTGVSSAASLTVFGRKGSSQMTW

SEQ ID NO: 2277 - protein, 130 aa, Homo sapiens
MPRPASESWSPIQSRIPAYKAVSHLRLLPTANSPSGSNQPTNPNRAQHPEGPQSREGATSPVLASLEPPTPTDLPSARARPRVPAESGPGWLHKARRPTRGILRDVLRHRGVPAQPRPAPGAHQLSSPSS

SEQ ID NO: 2278 - protein, 207 aa, Homo sapiens
MRWVRHDAPARRGQLRRLLEHVRLPLLAPAYFLEKVEADELLQACGECRPLLLEARACFILGREAGALRTRPRRHWAYPHARFMDLAEVIVVIGGCDRKGLLKLPFADAYHPESQRWTPLPSLPGYTRSEFAACALRNDVYVSGGHINSHDVWMFSSHLHTWIKVASLHKGRWRHKMAVVQGQVGTSCSGCPGTQGTDLWMCWREVL

SEQ ID NO: 2279 - protein, 276 aa, Homo sapiens [sequence omitted]

SEQ ID NO: 2280 - protein, 146 aa, Homo sapiens [sequence omitted]

SEQ ID NO: 2281 - protein, 357 aa, Homo sapiens
MGSTCRTCVCGARVGTHTAARLAAASRGRPWRSSSSPALNHNSTSPLTLAVGSPLLPRSRPLLQFHRGAPALSRFPENGLPGSQEPSPLRGRWVPGTTLETVEEKEKKASPSQSRGQLDLLVPFPRAREVGDPDSGVTPNSGPLRPGEQAPEDRRLSPSQADSQLDLLSRALGTGGAPELGSLRPGDRALEDRRLSLNQSRGQSDLLMQYPKAQGSRVPLETNSSARPARRAPDERRQTLGHSQLDLITKFGPFRGEGPGPNGLPISSPARTAGAGSGDEKRLTLGHSKLDLITKYHQLHGAGQGTEPGGPKGGHLNGGNSDLVRDEKRLTLGHSKLDLITKYNKSKFKQLRSRFES

SEQ ID NO: 2282 - protein, 111 aa, Homo sapiens [sequence omitted]

SEQ ID NO: 2283 - protein, 1001 aa, Homo sapiens
MKRIFSCSSTQVAVERWNRHDQKLLEAVHRGDVGRVAALASRKSARPTKLDSNGQSPFHLAASKGLTECLTILLANGADINSKNEDGSTALHLATISCQPQCVKVLLQHGANEDAVDAENRSPLHWAASSGCASSVLLLCDHEAFLDVLDNDGRTPLMIASLGGHAAICSQLLQRGARVNVTDKNDKAALILACEKGSAEVAELLLSHGADAGAVDSTGHDALHYALHTQDKALWRHLQQALSRRRRGGQRLVQHPDLASQASPSEPQAGSPPKSSWRAEPEEEQEEKEDEDPCSEEWRWKYEEERRKVVRLEQELVQKTEECKTQAAAYLDLENQIREQAQELGVLLSWEPRASGKQGSSLRPGGDGMEQGCPKDLLAESTQELKKQQQAAATVNPVLAPKKAEDSAPGKIQYEVHGRSQPEEQGPSQSPASETIRKATGQQLTTNGAQTFGPDHADQLPAGQKESSQVLGVEPGGTVAEPVGPAAMNQLLLQLREELAAVWREKDAARGALSRPVMEGALGTPRAEAAAAAWEKMEARLERVLARLEWAKAGLQVKPEVPSQESREGALKAAPGSIKQDEEKEKRVPGARGEPLGALGGEKALGGLAKGQLEKEMSVLRLSNSNLLEELGELGRERQRLQRELQSLSQRLQREFVPKPEAQVQLQQLRQSVGLLTNELAMEKEATEKLRKLLASQSSGLRGLWDCLPADLVGERSAQSKAAESLEELRACISTLVDRHREAQQVLARLQEENQQLRGSLSPCREPGTSLKAPASPQVAALEQDLGKLEEELRAVQATMSGKSQEIGKLKQLLYQATEGVAELRAREAASLRQHEKTRGSLVAQAQAWGQELKALLEKYNTACREVGRLREAVAEERRRSGDLAAQAAEQERQASEMRGRSEQFEKTAELLKEKMEHLIGACRDKEAKIKELLKKLEQLSEEVLAIRGENARLALQLQDSQKNHEEIISTYRNHLLNAARGYMEHEVYNILLQILSMEEE

SEQ ID NO: 2284 - protein, 208 aa, Homo sapiens
MPSILQNETYGALLSGSPPPAQPAAPSTTSAPPLPPRNVGKDPLTPTPPPPVAKTPSVMEALSQPSKPAPPGISQIRPPPLPPQPPSRLPQKKPAPGADKSTPLTNKGQPRGPVDLSATEALGPLSNAMVLQPPAPMPRKSQATKLKPKRVKALYNCVADNPDELTFSEGDVIIVDGEEDQEWWIGHIDGDPGRKGAFPVSFVHFIAD

SEQ ID NO: 2285 - protein, 418 aa, Homo sapiens
MGELCRRDSALTALDEETLWEMMESHRHRIVRCICPSRLTPYLRQAKVLCQLDEEEVLHSPRLTNSAMRAGHLLDLLKTRGKNGAIAFLESLKFHNPDVYTLVTGLQPDVDFSNFSGLMETSKLTECLAGAIGSLQEELNQEKGQKEVLLRRCQQLQEHLGLAETRAEGLHQLEADHSRMKREVSAHFHEVLRLKDEMLSLSLHYSNALQEKELAASRCRSLQEELYLLKQELQRANMVSSCELELQEQSLRTASDQESGDEELNRLKEENEKLRSLTFSLAEKDILEQSLDEARGSRQELVERIHSLRERAVAAERQREQGEGECAAGPGVRAAEGARPGVLREGQCSEGDFPEPGGEGLPPQAGVRADGPGLRAAHTASPAAGRASGCAQAGSQDQGALSTGEAAAGADACHLPQR

SEQ ID NO: 2286 - protein, 158 aa, Homo sapiens [sequence omitted]

SEQ ID NO: 2287 - protein, 271 aa, Homo sapiens
MLVTVMMWPLAVYHRLWDRAYVRLKPALQRLDFSVRGYMMSKQRERQLRRRALHPERAMDNHSDSEEELAAFCPQLDDSTVARELAITDSEHSDAEVSCTDNGTFNLSRGQTPLTEGSEDLDGHSDPEESFARDLPDFPSINMDPAGLDDEDDTSIGMPSLMYRSPPGAEEPQAPPASRDEAALPELLLGALPVGSNLTSNLASLVSQGMIQLALSGASQPGPSGAPAQRATRGFLRSPSSDLDTDAEGDDFELLDQSELSQLDPASSRSH

SEQ ID NO: 2288 - protein, 246 aa, Homo sapiens
MRQKINKDIQDLNSALDLADLIDIYRTLHPKSTEYTFFSAPHHTYSKIDHIVGSKTRLSKCRRMEIITNSLSDHSTIKLELRIMKLTQKLTATWKLNNLLLDDYWVNNEIKAEINKLFETNENKDKVYWNLWDTAKAVFRGKFTALNAHRRKRERSKIDTLMSQLKELEKQEQINSKARRRQIITKIRAEMKQIETQKTLQKINGSRSCFSEKINKIDGLLARLIKKKREKNQIDTIKNDKGGYHH

SEQ ID NO: 2289 - protein, 629 aa, Homo sapiens [sequence omitted]

SEQ ID NO: 2290 - protein, 138 aa, Homo sapiens
MERFLNSKARRLGSCSHPAFYLLCVPDEDTSCSTIYLPLKRRADPDQLFSDLLGGTQRLWSNRFGNEESFPGRVRELVDTFCWIARAPPLGNPLRLEERIAWRIQRLKSGQTALIEKKKQKIEEDVRHQCQQTTCDRC

SEQ ID NO: 2291 - protein, 1077 aa, Homo sapiens
MPRRKQEQPKRLPSHVSRQEEAEGELSEGEHWYGNSSEAPSEASYGEVQENYKLSLEDRIQEQSTSPDTSLGSTTPSSHTLELVALDSEVLRDSLQCQDHLSPGVSSLCDDDPGSNKPLSSNLRRLLEAGSLKLDAAATANGRVESPVNVGSNLSFSPPSHHARQLSVLARKLAEKQEQNDQYTPSNRFIWNQGKWLPNSTTTCSLSPDSAILKLKAAANAVLQDKSLTRTEETMRFESLSSPFSSQSASSTLAALSKKVSERSLTPGQEHPPPASSFLSLASMTSSAALLKEVAARAAGSLLAEKSSLLPEDPLPPPPSEKKPEKVTPPPPPPPPPPPPPPPQSLELLLLPVPKGRVSKPSNSASEEESGKPFQCPICGLVIKRKSYWKRHMVIHTGLKSHQCPLCPFRCARKDNLKSHMKVHQHQDRGETFQCQLCPFTSSRHFSLKLHMRCHQHFLRTEAKVKEEIPDPDVKGSPHLSDSACLGQQREGGGTELVGTMMTSNTPERTSQGGAGVSPLLVKEEPKEDNGLPTSFTLNAADRPANHTKLKDPSEYVANSASALFSQDISVKMASDFLMKLSAANQKEPMNLNFKVKEEPKEGESLSTTLPRSSYVFSPESEVSAPGVSEDALKPQEGKGSVLRRDVSVKAASELLMKLSAESYKETQMVKIKEEPMEVDIQDSHVSISPSRNVGYSTLIGREKTEPLQKMPEGRVPPERNLFSQDISVKMASELLFQLSEKVSKEHNHTKENTIRTTTSPFFSEDTFRQSPFTSNSKELLPSDSVLHGRISAPETEKIVLEAGNGLPSWKFNDQLFPCDVCGKVFGRQQTLSRHLSLHTEERKYKCHLCPYAAKCRANLNQHLTVHSVKLVSTDTEDIVSAVTSEGSDGKKHPYYYSCHVCGFGTELNVQFVSHMSLHVDKEQWMFSICCTACDFVTMEEAEIKTHIGTKHTGEDRKTPSESNSPSSSSLSALSDSANSKDDSDGSQKNKGGNNLLVISVMPGSQPSLNSEEKPEKGFECVFCNFVCKTKNMFERHLQIHLITRMFECDVCHKFMKTPEQLLEHKKCHTVPTGGLK

SEQ ID NO: 2292 - protein, 279 aa, Homo sapiens [sequence omitted]

SEQ ID NO: 2293 - protein, 796 aa, Homo sapiens
MIPVAEFKQFTEQQPAFKVLKPWWDVLAEYLTVAMLMIGVFGCTLQVTQDKIICLPNHELQENLSEAPCQQLLPRGIPEQIGALQEVKGLKNNLDLQQYSFINQLCYETALHWYAKYFPYLVVIHTLIFMVCTSFWFKFPGTSSKIEHFISILGKCFDSPWTTRALSEVSGENQKGPAATERAAATIVAMAGTGPGKAGEGEKEKVLAEPEKVVTEPPVVTLLDKKEGEQAKALFEKVKKFRMHVEEGDILYTMYIRQTVLKVCKFLAILVYNLVYVEKISFLVACRVETSEVTGYASFCCNHTKAHLFSKLAFCYISFVCIYGLTCIYTLYWLFHRPLKEYSFRSVREETGMGDIPDVKNDFAFMLHLIDQYDSLYSKRFAVFLSEVSESRLKQLNLNHEWTPEKLRQKLQRNAAGRLELALCMLPGLPDTVFELSEVESLRLEAICDITFPPGLSQLVHLQELSLLHSPARLPFSLQVFLRDHLKVMRVKCEELREVPLWVFGLRGLEELHLEGLFPQELARAATLESLRELKQLKVLSLRSNAGKVPASVTDVAGHLQRLSLHNDGARLVALNSLKKLAALRELELVACGLERIPHAVFSLGALQELDLKDNHLRSIEEILSFQHCRKLVTLRLWHNQIAYVPEHVRKLRSLEQLYLSYNKLETLPSQLGLCSGLRLLDVSHNGLHSLPPEVGLLQNLQHLALSYNALEALPEELFFCRKLRTLLLGDNQLSQLSPHVGALRALSRLELKGNRLEALPEELGNCGGLKKAGLLVEDTLYQGLPAEVRDKMEEE

SEQ ID NO: 2294 - protein, 890 aa, Homo sapiens
MDGEPPASSGLGLPDYTSGVSFHDQADLPETEDFQAGLYVTESPQPQEAEAVSLGRLSDKSSTSETSLGEERAPDEGGAPVDKSSLRSGDSSQDLKQSEGSEEEEEEEDSCVVLEEEEGEQEEVTGASELTLSDTVLSMETVVAGGSGGDGEEEEEALPEQSEGKEQKILLDTACKMVRWLSAKLGPTVASRHVARNLLRLLTSCYVGPTRQQFTVSSGESPPLSAGNIYQKRPVLGDIVSGPVLSYLLHIARLYGEPVLTYQYLPYISYLVAPGSASGPSRLNSRKEAGLLAAVTLTQKIIVYLSDTTLMDILPRISHEVLLPVLSFLTSLVTGFPSGAQARTILCVKTISLIALICLRIGQEMVQQHLSEPVATFFQVFSQLHELRQQDLKLDPAGRGEGQLPQVVFSDGQQRPVDPALLDELQKVFTLEMAYTIYVPFSCLLGDIIRKIIPNHELVGELAALYLESISPSSRNPASVEPTMPGTGPEWDPHGGGCPQDDGHSGTFGSVLVGNRIQIPNDSRPENPGPLGPISGVGGGGLGSGSDDNALKQELPRSVHGLSGNWLAYWQYEIGVSQQDAHFHFHQIRLQSFPGHSGAVKCVAPLSSEDFFLSGSKDRTVRLWPLYNYGDGTSETAPRLVYTQHRKSVFFVGQLEAPQHVVSCDGAVHVWDPFTGKTLRTVEPLDSRVPLTAVAVMPAPHTSITMASTDSTLRFVDCRKPGLQYEFRLGGGLNPGLVRALAISPSGRSVVAGFSSGFMVLLDTRTGLVLRGWPAHEGDILQIKAVEGSVLVSSSSDHSLTVWKELEQKPTHHYKSASDPIHTFDLYGSEVVTGTVSNKIGVCSLLEPPSQATTKLSSENFRGTLTSLALLPTKRHLLLGSDNGVIRLLA

SEQ ID NO: 2295 - protein, 123 aa, Homo sapiens
MARGSPGSLRSWLSSHHSPIPHLVLCHVHEAVGAPCHCLYPLAINTVQAENQVNKNEGESGSMNVGPYLGAEDTEINKILSLPMQGSKSNWGTQSNNHSTVKFMCRVKVMFKEALLGHMTKYP

SEQ ID NO: 2296 - protein, 565 aa, Homo sapiens [sequence omitted]

SEQ ID NO: 2297 - protein, 916 aa, Homo sapiens
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLESRHMREDMEYIGLDSGRIRTRRQSSGSATNVASTPDNRGRSRAKVVSQSQPGSRSSSPGKLLGSGYGGLTGGSSRGPPVTPSSEKRSKIPRSQGCSRETSPNRIGLDRFGLGQPGRIPGSVNAMRVLSTSTDLEAAVADALEKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKRVFSMFLETLVDFIIIHKDDLQDWLFVLLTQLLQ

SEQ ID NO: 2298 - protein, 111 aa, Homo sapiens
MALALLQSPRSWQGPHRIPAPVAQPQARPPCTRHKHLLPGLPDRQRAPWHWRAGRRRVQVGAAQGQECRPAVDKAWFPALTLGRKRKMTSKPVLVKESSKHALRGHFQRPP

SEQ ID NO: 2299 - protein, 933 aa, Homo sapiens
MEENESQKCEPCLPYSADRRQMQEQGKGNLHVTSPEDAECRRTKERLSNGNSRGSVSKSSRNIPRRHTLGGPRSSKEILGMQTSEMDRKREAFLEHLKQKYPHHASAIMGHQERLRDQTRSPKLSHSPQPPSLGDPVEHLSETSADSLEAMSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNTAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQVRQLQLQNQELLRAMMKKAELEISGKVMETMKRLEDPVQRQRVLVEQERQKYLHEEEKIVKKLCELEDFVEDLKKDSTAASRLVTLKDVEDRAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKA

SEQ ID NO: 2300 - protein, 634 aa, Homo sapiens
MSWLFGINKGPKGEGAGPPPPLPPAQPGAEGGGDRGLGDRPAPKDKWSNFDPTGLERAAKAARELEHSRYAKDALNLAQMQEQTLQLEQQSKLKMRLEALSLLHTLVWAWSLCRAGAVQTQERLSGSASPEQVPAGECCALQEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADITREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 2301 - protein, 817 aa, Homo sapiens [sequence omitted]

SEQ ID NO: 2302 - protein, 112 aa, Homo sapiens
MVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKEVSLPALQSRALH

SEQ ID NO: 2303 - protein, 259 aa, Homo sapiens
MKNATFQITPDVIKESENIQLGQDLKLSCHVDAVPQEKVTYQWFKNGKPARMSKRLLVTRNDPELPAVTSSLELIDLHFSDYGTYLCMASFPGAPVPDLSVEVNISSETVPPTISVPKGRAVVTVREGSPAELQCEVRGKPRPPVLWSRVDKEAALLPSGLPLEETPDGKLRLERVSRDMSGTYRCQTARYNGFNVRPREAQVQLNVQCESTTPPGLPSQLSFWLPAGLSPLHPLTHPSPTKPHQLLLIPLMLLDSPML

SEQ ID NO: 2304 - protein, 118 aa, Homo sapiens [sequence omitted]

SEQ ID NO: 2305 - protein, 252 aa, Homo sapiens
MAPEGRMGIWQPLREESSQWLCMVLGAERWLPTLQARQWSGLLLPERFLVGSQRNEAARRGLGPRADSRARGPSTAPQTAARPCASSQTCVGLSLLFRKGAGRGAADSLSAFGPGGTGGLEGPQRRRAHLSASRWPTRWWRRARPWARWSRSCSRGKAGWQPWRPAWRSCERRGRSRPSRWRSGGRRMRCSGQPTRRCARTSGSGRRHCAGSRKRRATCWRGSCSARRAPRPSATCATSAGSGPSRRGCPRS

SEQ ID NO: 2306 - protein, 599 aa, Homo sapiens [sequence omitted]

SEQ ID NO: 2307 - protein, 791 aa, Homo sapiens
MPDMHFKAPKISMPDVDLHLKGPKVKGDVDVSVPKLEGDLTGPSVGVEVPDVELECPDAKLKGPKFKMPEMHFKTPKISMPDVDLHLKGPKVKGDMDVSVPKVEGEMKVPDVDIKGPKMDIDAPDVDVHGPDWHLKMPKMKMPKFSMPGFKAEGPEVDVNLPKADVVVSGPKVDVEVPDVSLEGPEGKLKGPKLKMPEMHFKAPKISMPDVDLHLKGPKVKGDVDVSLPKLEGDLTGPSVDVEVPDVELECPDAKLKGPKFKMPEMHFKTPKISMPDVNLNLKGPKVKGDMDVSVPKVEGEMKVPDVDIRGPKVDIDAPDVDVHGPDWHLKMPKMKMPKFSMPGFKGEGPEVDVNLPKADVDVSGPKVDVEVPDVSLEGPEGKLKGPKFKMPEMHFKTPKISMPDVDFNLKGPKIKGDVDVSAPKLEGELKGPELDVKGPKLDADMPEVAVEGPNGKWKTPKFKMPDMHFKAPKISMPDLDLHLKSPKAKGEVDVDVPKLEGDLKGPHVDVSGPDIDIEGPEGKLKGPKFKMPDMHFKAPNISMPDVDLNLKGPKIKGDVDVSVPEVEGKLEVPDMNIRGPKVDVNAPDVQAPDWHLKMPKMKMPKFSMPGFKAEGPEVDVNLPKADVDISGPKVDIEGPDVNIEGPEGKLKGPKLKMPEMNIKAPKISMPDFDLHLKGPKVKGDVDVSLPKVEGDLKGPEVDIKGPKVDINAPDVGVQGPDWHLKMPKVKMPKFSMPGFKGEGPDGDVKLPKADIDVSGPKVDIEGPDVNIEGPEGKLKGPKFKMAQRWW

SEQ ID NO: 2308 - protein, 668 aa, Homo sapiens
MNETGHYRDDNRDKDSEKTKRWSKPRKRSLMEMEGKEDAQKVLKCMYCGHSFESLQDLSVHMIKTKHYQKVPLKEPVPAITKLVPSTKKRALQDLAPPCSPEPAGMAAEVALSESAKDQKAANPYVTPNNRYGYQNGASYTWQFEARKAQILKCMECGSSHDTLQQLTAHMMVTGHFLKVTTSASKKGKQLVLDPVVEEKIQSIPLPPTTHTRLPASSIKKQPDSPAGSTTSEEKKEPEKEKPPVAGDAEKIKEESEDSLEKFEPSTLYPYLREEDLDDSPKGGLDILKSLENTVSTAISKAQNGAPSWGGYPSIHAAYQLPGTVKPLPAAVQSVQVQPSYAGGVKSLSSAEHNALLHSPGSLTPPPHKSNVSAMEELVEKVTGKVNIKKEERPPEKEKSSLAKAASPIAKENKDFPKTEEVSGKPQKKGPEAETGKAKKEGPLDVHTPNGTEPLKAKVTNGCNNLGIIMDHSPEPSFINPLSALQSIMNTHLGKVSKPVSPSLDPLAMLYKISNSMLDKPVYPATPVKQADAIDRYYYENSDQPIDLTKSKNKPLVSSVADSVASPLRESALMDISDMVKNLTGRLTPKSSTPSISPNLASPVPFTPHPLAFCLELGLLSVCPACTQPLPTKPQGQRSPQPALLRPCPQTCTVPEEVGRWRPSIPRR

SEQ ID NO: 2309 - protein, 845 aa, Homo sapiens [sequence omitted]

SEQ ID NO: 2310 - protein, 574 aa, Homo sapiens
MSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPEPPKCKDFVPFGKGIREDIARRFPLYPLDFTDGIIGKNKAVGKYITTTLFLYFACLLPTIAFGSLNDENTDGAIDVQKTIAGQSIGGLLYALFSGQPLVILLTTAPLALYIQVIRVICDDYDLDFNSFYAWTGLWNSFFLALYAFFNLSLVMSLFKRSTEEIIALFISITFVLDAVKGTVKTCQASAPASTPASTLPSMPASSPAPRSCPRPHTQARRPPCSASSSCWARSGWATPSTNSRRAPTCTPACERSCPTAPCPSRCSPSPSSAPMASGKSR

SEQ ID NO: 2311 - protein, 151 aa, Homo sapiens
MKKSKEGGTEEENRDGDVIGPLPPEPEAVPTPRPAAQSSKVEVIVQERKDTKPGVPHIREWDRGKEFSFGYWSKRQSDLRAERDPEFAPPSDYFVGQKRTGFSSSQAWSRPGPAQSDPGQCPDQCPDNPPQAPTVTFKTLDDMISYYKQVT

SEQ ID NO: 2312 - protein, 1017 aa, Homo sapiens
MAAMAPGGSGSGGGVNPFLSDSDEDDDEVAATEERRAVLRLGAGSGLDPGSAGSLSPQDPVALGSSARPGLPGEASAAAVALGGTGETPARLSIDAIAAQLLRDQYLLTALELHTELLESGRELPRLRDYFSNPGNFERQSGTPPGMGAPGVPGAAGVGGAGGREPSTASGGGQLNRAGSISTLDSLDFARYSDDGNRETDEKVAVLEFELRKAKETIQALRANLTKAAEHEVPLQERKNYKSSPEIQEPIKPLEKRALNFLVNEFLLKNNYKLTSITFSDENDDQDFELWDDVGLNIPKPPDLLQLYRDFGNHQVTGKDLVDVASGVEEDELEALTPIISNLPPTLETPQPAENSMLVQKLEDKISLLNSEKWSLMEQIRRLKSEMDFLKNEHFAIPAVCDSVQPPLDQLPHKDSEDSGQHPDVNSSDKGKNTDIHLSISDEADSTIPKENSPNSFPRREREGMPPSSLSSKKTVHFDKPNRKLSPAFHQALLSFCRMSADSRLGYEVSRIADSEKSVMLMLGRCLPHIVPNVLLAKREELIPLILCTACLHPEPKERDQLLHILFNLIKRPDDEQRQMILTGCVAFARHVGPTRVEAELLPQCWEQINHKYPERRLLVAESCGALAPYLPKEIRSSLVLSMLQQMLMEDKADLVREAVIKSLGIIMGYIDDPDKYHQGFELLLSALGDPSERVVSATHQVFLPAYAAWTTELGNLQSHLILTLLNKIEKLLREGEHGLDEHKLHMYLSALQSLIPSLFALVLQNAPFSSKAKLHGEVPQIEVTRFPRPMSPLQDVSTIIGSREQLAVLLQLYDYQLEQEGTTGWESLLWVVNQLLPQLIEIVGKINVTSTACVHEFSRFFWRLCRTFGKIFTNTKVKPQFQEILRLSEENIGNGVLTKATVPIYATGVLTCYIQEEDRKLLVGFLEDVMTLLSLSHAPLDSLKASFVELGANPAYHELLLTVLWYGVVHTSALVRCTAARMFEVCQHMPLLVSIIMIFFFFAKKKGIFLIKRLCI

SEQ ID NO: 2313 - protein, 143 aa, Homo sapiens [sequence omitted]

SEQ ID NO: 2314 - protein, 123 aa, Homo sapiens
MADPQSCFMTRQKPGNTFASEGSLNTAGRPGVGKRQVAPVAGVARKGRRIWGSRMIDIQTRMAGRALELLYLPENKPCYLLDIGCGTGLSGSYLSDEGHYWVGLDISPAMLGPGIPSCPAAVP

SEQ ID NO: 2315 - protein, 194 aa, Homo sapiens
MAVLVLVLTECLLGFFGLWRISTQLHVLVPISSEPPEEGEKEDLRVQLRRHHPSSPLPGSKTSKRPKIKVSLISQGDTAGGPCAPSQGSAPEGGKPITMTLGQASAGAKELTGLLTTAKSSSSEGGVSASPVPSVVSSSTAPSALHTLQSRLVATSPGSSLPGILWPSILPFQHRIFGLLLLGGPGKASLELNP

SEQ ID NO: 2316 - protein, 226 aa, Homo sapiens
MGPGSVMCPLGQVNEAEEERLRGEREHQRVTRLCQQAEARVQALQKTLRRAIGKSRPYFELKAQFSQILEEHKAKVTELEQQVAQAKTRYSVALRNLEQISEQIHARRRGGLPPHPLGPRRSSPVGAEAGPEDMEDGDSGIEGAEGAGLEEGSSLGPGPAPDTDTLSLLSLRTVASDLQKCDSVEHLRGLSDHVSLDGQELGTRSGGRRGSDGGARGGRHQRSVSL

SEQ ID NO: 2317 - protein, 241 aa, Homo sapiens [sequence omitted]

SEQ ID NO: 2318 - protein, 104 aa, Homo sapiens [sequence omitted]

SEQ ID NO: 2319 - protein, 246 aa, Homo sapiens [sequence omitted]

SEQ ID NO: 2320 - protein, 351 aa, Homo sapiens
MTWSATARGAHQPDNTAFTQQRLPAWQPLLSASIALPLFFCAGLAFIGLGLGLYYSSNGIKELEYDYTGDPGTGNCSVCAAAGQGRALPPPCSCAWYFSLPELFQGPVYLYYELTNFYQNNRRYGVSRDDAQLSGLPSALRHPVNECAPYQRSAAGLPIAPCGAIANSLFNDSFSLWHQRQPGGPYVEVPLDRSGIAWWTDYHVKFRNPPLVNGSLALAFQGTAPPPNWRRPVYELSPDPNNTGFINQDFVVWMRTAALPTFRKLYARIRQGNYSAGLPRGAYRVNITYNYPVRAFGGHKLLIFSSISWMGGKNPFLGIAYLVVGSLCILTGFVMLVVYIRYQDQDDDDEE

SEQ ID NO: 2321 - protein, 164 aa, Homo sapiens [sequence omitted]

SEQ ID NO: 2322 - protein, 119 aa, Homo sapiens
MKWVYCSVTGMGKGQHRMPSKDELVQRYNRMNTIPQTRSIQSRFLQSRNLNCIALCEVITSKDLQKHGNIWVCPVSDHVCTRFFFVYEDGQVGDANINTQDPKIQKEIMRVIGTQVYTN

SEQ ID NO: 2323 - protein, 834 aa, Homo sapiens
MKHTLALLAPLLGLGLGLALSQLAAGATDCKFLGPAEHLTFTPAARARWLAPRVRAPGLLDSLYGTVRRFLSVVQLNPFPSELVKALLNELASVKVNEVVRYEAGYVVCAVIAGLYLLLVPTAGLCFCCCRCHRRCGGRVKTEHKALACERAALMVFLLLTTLLLLIGVVCAFVTNQRTHEQMGPSIEAMPETLLSLWGLVSDVPQELQAVAQQFSLPQEQVSEELDGVGVSIGSAIHTQLRSSVYPLLAAVGSLGQVLQVSVHHLQTLNATVVELQAGQQDLEPAIREHRDRLLELLQEARCQGDCAGALSWARTLELGADFSQVPSVDHVLHQLKGVPEANFSSMVQEENSTFNALPALAAMQTSSVVQELKKAVAQQPEGVRTLAEGFPGLEAASRWAQALQEVEESSRPYLQEVQRYETYRWIVGCVLCSVVLFVVLCNLLGLNLGIWGLSARDDPSHPEAKGEAGARFLMAGVGLSFLFAAPLILLVFATFLVGGNVQTLVCQSWENGELFEFADTPGNLPPSMNLSQLLGLRKNISIHQAYQQCKEGAALWTVLQLNDSYDLEEHLDINQYTNKLRQELQSLKVDTQSLDLLSSAARRDLEALQSSGLQRIHYPDFLVQIQRPVVKTSMEQLAQELQGLAQAQDNSVLGQRLQEEAQGLRNLHQEKVVPQQSLVAKLNLSVRALESSAPNLQLETSDVLANVTYLKGELPAWAARILRNVSECFLAREMGYFSQYVAWVREEVTQRIATCQPLSGALDNSRVILCDMMADPWNAFWFCLAWCTFFLIPSIIFAVKTSKYFRPIRKRLSSTSSEETQLFHIPRVTSLKL

SEQ ID NO: 2324 - protein, 808 aa, Homo sapiens [sequence omitted]

SEQ ID NO: 2325 - protein, 197 aa, Homo sapiens
MQRRDARSAHSHLQRRRVAPLAGRGAVALHGEHVHALPARPQLAAAHHVHSVAQRDRAVPAPGCAEVRQLLPRVAGRVVGAHRARVGVGDVASGHQHAAVGDRASVAAARHLQGRLRLPLIGGGHVALQRGQASFCVAAARGVHEPVEHAQAEVRALLVHAGQVYPGVEAGIVSGNDREGVTALSAAAGDPMLLCKS

SEQ ID NO: 2326 - protein, 126 aa, Homo sapiens
MVALFQHSPYWQADGYGHSHRLKCQHFKQHRQYNDKLEISSNLGPQFNALLNILLNIVHPTLSHDTRRSKGLKIEGLLQSRELGNSWTVTMCIWVLKALQSSAPNKPLDWLDPMPCFQNLLARGTP

SEQ ID NO: 2327 - protein, 1031 aa, Homo sapiens [sequence omitted]

SEQ ID NO: 2328 - protein, 816 aa, Homo sapiens [sequence omitted]

SEQ ID NO: 2329 - protein, 116 aa, Homo sapiens
MSTGQGKWVPGLQAAVHAHVGRSASSLQNRFPHCLLSCKGFGSLVKPMGLSQNNFFFFFFMRWSLALSPRLECSGAILAHCNLCLPGSSDSPTSASQVVGTTDACHHACLIFLYFQ

SEQ ID NO: 2330 - protein, 142 aa, Homo sapiens
MVAQDKIRQPPMAPHRVERGCRHRPEPRVILCRADSPTQRPWPEWGTPHALYLIKFPLLLFQVGHELPLVVQINNQVVQLLLKPVLGLFQFIISGRLLLVLLGEVLDLLLEPLLPLFQSFHGAGKVLQLLLRVGELQGQRPG

SEQ ID NO: 2331 - protein, 616 aa, Homo sapiens
MALLGSRAELEADEDVFEDALETISISSHSDMATSSLHFASCDTQQAPRQRGASTVSSSSSTKVDLKSGLEECAVALNLFLSNKFTDALELLRPWAKESMYHALGYSTIVVLQAVLTFEQQDIQNGISAMKDALQTCQKYRKKYTVVESFSSLLSRGSLEQLSEEEMHAEICYAECLLQKAALTFVQDENMINFIKGGLKIRTSYQIYKECLSILHEIQKNKLQQEFFYEFEGGVKLGSGAFNLMLSLLPARIIRLLEFIGFSGNRELGLLQLREGASGRSMRSALCCLTILAFHTYISLILGTGEVNVAEAERLLAPFLQQFPNGSLVLFYHARIELLKGNLEEAQEVFQKCVSVQEEWKQFHHLCYWELMWINVFQQNWMQAYYYSDLLCKESKWSKATYVFLKAAILSMLPEEDVVATNENVVTLFRQVDSLKQRIAGKSIPTEKFAVRKARRYSASLPAPVKLILPALEMMYVWNGFSIVSKRKDLSENLLVTVEKAEAALQSQNFNSFSVDDECLVKLLKGCCLKNLQRPLQAELCYNHVVESEKLLKYDHYLVPFTLFELASLYKSQGEIDKAIKFLETARNNYKDYSLESRLHFRIQAALHLWRKPSSD

SEQ ID NO: 2332 - protein, 246 aa, Homo sapiens
MVKIYRHESLLGFFKGMSFPIASIAVVNSVLFGVYSNTLLVLTATSHQERRAQPPSYMHIFLAGCTGGFLQAYCLAPFDLIKVRLQNQTEPRAQPGSPPPRYQGPVHCAASIFREEGPRGLFRGAWALTLRDTPTVGIYFITYEGLCRQYTPEGQNPSSATVLVAGGFAGIASWVAATPLDVIKSRMQMDGLRRRVYQGMLDCMVSSIRQEGLGVFFRGVTINSARAFPVNAVTFLSYEYLLRWWG

SEQ ID NO: 2333 - protein, 131 aa, Homo sapiens
MQGSGSQFRACLLCLCFSCPCSPGGPRWNSRQGGRRFPKTCRAISQNLVFKYKTFCPVRYMQPHRSSLCLHFTSYVFILSTWGSLRTYSTDLKKKNCLAASQCQSEHGTGKARGDEGEVATVTGRQMRLCK

SEQ ID NO: 2334 - protein, 156 aa, Homo sapiens [sequence omitted]

SEQ ID NO: 2335 - protein, 799 aa, Homo sapiens
MSINNLTTDFDFASQSNWRYFTELILRPIEMSDEIPNQFQNIWLHLITLGKEFQKLVKGIYFNILENNSSSKTENLLNIFATSPKEKDVNSVGNSIYHLASYLAFSLSHDLQNSPKIIISPEIMKATGLGIQLIRDVFNSLMPVVHHTSPQNAGYMQALKKVTSVMRTLKKADIDLLVDQLEQVSVNLMDFFKNISSVGTGNLVVNLLVGLMEKFADSSHSWNVNHLLQLSRLFPKDVVDAVIDVYYVLPHAVRLLQGVPGKNITEGLKDVYSFTLLHGITISNITKEDFAIVIKILLDTIELVSDKPDIISEALACFPVVWCWNHTNSGFRQNSKIDPCNVHGLMSSSFYGKVASILDHFHLSPQGEDSPCSNESSRMEITRKVVCIIHELVDWNSILLELSEVFHVNISLVKAVQKFWHKILPFVPPSINQTRDSISELCPSGSIKQVALQIIEKLKNVNFTKVTSGENILDKLSSLNKILNINEDTETSVQNIISSNLERTVQLISEDWSLEKSTHNLLSLFMMLQNANVTGSSLEALSSFIEKSETPYNFEELWPKFQQIMKDLTQDFRIRHLLSEMNKGIKSINSMALQKITLQFAHFLEILDSPSLKTLEIIEDFLLVTKNWLQEYANEDYSRMIETLFIPVTNESSTEDIALLAKAIATFWGSLKNISREGNFDVAFLTHLLNQEQLTNFSVVQLLFENILINLINNLAGNSQEAAWNLNDTDLQIMNFINLILNHMQSETSRKTVLSLRSIVDFTEQFLKTFFSLFLKEDSENKISLLLKYFHKDVIAEMR

SEQ ID NO: 2336 - protein, 748 aa, Homo sapiens
MEENNDSTENPQQGQGRQNAIKCGWLRKQGGFVKTWHTRWFVLKGDQLYYFKDEDETKPLGTIFLPGNKVSEHPCNEENPGKFLFEVVPGGDRDRMTANHESYLLMASTQNDMEDWVKSIRRVIWGPFGGGIFGQKLEDAVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAERAKEDAEKRNDMLQKEVEQFFSTFGELTVEPRRTERGNTIWIQ

SEQ ID NO: 2337 - protein, 964 aa, Homo sapiens
MKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 2338 - protein, 436 aa, Homo sapiens
MADGGSERADGRIVKMEVDYSATVDQRLPECAKLAKASDMVSTSRILVAVVKMCYEAKEWDLLNENIMLLSKRRSQLKQAVAKMVQQCCTYVEEITDLPIKLRLIDTLRMVTEGKIYVEIERARLTKTLATIKEQNGDVKEAASILQELQVETYGSMEKKERVEFILEQMRLCLAVKDYIRTQIISKKINTKFFQEENTEKLKLKYYNLMIQLDQHEGSYLSICKHYRAIYDTPCIQAESEKWQQALKSVVLYVILAPFDNEQSDLVHRISGDKKLEEIPKYKDLLKLFTTMELMRWSTLVEDYGMELRKGSLESPATDVFGSTEEGEKRWKDLKNRVVEHNIRIMAKYYTRITMKRMAQLLDLSVDESEAFLSNLVVNKTIFAKVDRLAGIINFQRPKDPNNLLNDWSQKLNSLMSLVNKTTHLIAKEEMIHNLQ

SEQ ID NO: 2339 - protein, 511 aa, Homo sapiens
MKSLHPLQMGGLKVEMPMNLKVIIYEKPHFHGQAKEFSEHIDSVPNFLKNNGDFHRIGSIRVIGGVWVAYEKEHFKGQQFLLEEGDFEDSNACGALSSPILSFRYLQANFIESSVTLFESDLESGKFIDITNQEISDLEEIGFGSKTRSIHVKSGVWVAYQQKFFCGEQYILEKGKYKCFFDWGGSNNIIMSIRPIQLEPLGINEPPHLLKAFSKPGFQGECIDFTEETSDLTSLMPCSFKVLRGCWLLYYQEDMFVNHCVLEEGLYADLTSCGCPASKVKSLKPIDYVFEEPSISLFALEHCEGRELHLEEAVNSVLNKDLHFYTQSVWVKSGLWIAYEGSNFLGRQILLRPNEIPNWTAFSRWKTIGSLRPMKQPAVYIRIKNRAQGEYLTVTGSLADTRATSVCISPYSGKNTQIWYYCRGLFKSKASDTCLDVIGGRDTPGAKVALWTEHGQFRQKWRLNKNGTISSYLSDQLVLDVKGGNYCDKTHVIVNQPLEGEETQKWDIEIL

SEQ ID NO: 2340 - protein, 743 aa, Homo sapiens
MNSNLPAENLTIAVNMTKTLPTAVTHGFNSTNGPPSMSITRLFPALLECFGIVLCGYIAGRANVITSTQAKGLGNFVSRFALPALLFKNMVVLNFSNVDWSFLYSILIAKASVFFIVCVLTLLVASPDSRFSKAGLFPIFATQSNDFALGYPIVEALYQTTYPEYLQYIYLVAPISLMMLNPIGFIFCEIQKWKDTQNASQNKIKIVGLGLLRVLQNPIVFMVFIGIAFNFILDRKVPVYVENFLDGLGNSFSGSALFYLGLTMVGKIKRLKKSAFVVLILLITAKLLVLPLLCREMVELLDKGDSVVNHTSLSNYAFLYGVFPVAPGVAIFATQFNMEVEIITSGMVISTFVSAPIMYVSAWLLTFPTMDPKPLAYAIQNVSFDISIVSLISLIWSLAILLLSKKYKQLPHMLTTNLLIAQSIVCAGMMIWNFVKEKNFVGQILVFVLLYSSLYSTYLWTGLLAISLFLLKKRERVQIPVGIIIISGWGIPALLVGVLLITGKHNGDSIDSAFFYGKEQMITTAVTLFCSILIAGISLMCMNQTAQAGSYEGFDQSQSHKVVEPGNTAFEESPAPVNEPELFTSSIPETSCCSCSMGNGELHCPSIEPIANTSTSEPVIPSFEKNNHCVSRCNSQSCILAQEEEQYLQSGDQQLTRHVLLCLLLIIGLFANLSSCLWWLFNQEPGRLYVELQFFCAVFNFGQGFISFGIFGLDKHLIILPFKRRLEFLWNNKDTAENRDSPV

SEQ ID NO: 2341 - protein, 816 aa, Homo sapiens
MLENYFNLISVGCQVPKPEVIFSLEQEEPCMLDGEIPSQSRPDGDIGFGPLQQRMSEEVSFQSEININLFTRDDPYSILEELWKDDEHTRKCGENQNKPLSRVVFINKKTLANDSIFEYKDIGEIVHVNTHLVSSRKRPHNCNSCGKNLEPIITLYNRNNATENSDKTIGDGDIFTHLNSHTEVTACECNQCGKPLHHKQALIQQQKIHTRESLYLFSDYVNVFSPKSHAFAHESICAEEKQHECHECEAVFTQKSQLDGSQRVYAGICTEYEKDFSLKSNRQKTPYEGNYYKCSDYGRAFIQKSDLFRCQRIHSGEKPYEYSECEKNLPQNSNLNIHKKIHTGGKHFECTECGKAFTRKSTLSMHQKIHTGEKPYVCTECGKAFIRKSHFITHERIHTGEKPYECSDCGKSFIKKSQLHVHQRIHTGENPFICSECGKVFTHKTNLIIHQKIHTGERPYICTVCGKAFTDRSNLIKHQKIHTGEKPYKCSDCGKSFTWKSRLRIHQKCHTGERHYECSECGKAFIQKSTLSMHQRIHRGEKPYVCTECGKAFFHKSHFITHERIHTGEKPYECSICGKSFTKKSQLHVHQQIHTGEKPYRCAECGKAFTDRSNLFTHQKIHTGEKPYKCSDCGKAFTRKSGLHIHQQSHTGERHYECSECGKAFARKSTLIMHQRIHTGEKPYICNECGKSFIQKSHLNRHRRIHTGEKPYECSDCGKSFIKKSQLHEHHRIHTGEKPYICAECGKAFTIRSNLIKHQKIHTKQKPYKCSDLGKALNWKPQLSMPQKSDNGEVECSMPQLWCGDSEGDQGQLSSI

SEQ ID NO: 2342 - protein, 559 aa, Homo sapiens
MTKTHVIAASKEAFYTWQYRVAKKLTALEINQITRSRKEGRERIYHVDDTPSGSMDGVLDYSKTIQGTRDPICAITASDKILIVGRESGTIQRYSLPNVGLIQKYSLNCRAYQLSLNCNSSRLAIIDISGVLTFFDLDARVTDSTGQQVVGELLKLERRDVWDMKWAKDNPDLFAMMEKTRMYVFRNLDPEEPIQTSGYICNFEDLEIKSVLLDEILKDPEHPNKDYLINFEIRSLRDSRALIEKVGIKDASQFIEDNPHPRLWRLLAEAALQKLDLYTAEQAFVRCKDYQGIKFVKRLGKLLSESMKQAEVVGYFGRFEEAERTYLEMDRRDLAIGLRLKLGDWFRVLQLLKTGSGDADDSLLEQANNAIGDYFADRQKWLNAVQYYVQGRNQERLAECYYMLEDYEGLENLAISLPENHKLLPIADEEAKKGSKPLRVKKLYVLSALLIEQYHEQMKNAQRGKVKGKSSEATSALAGLLEEEVLSTTDRFTDNAWRGAEAYHFFILAQRQLYEGCVDTALKTVEKGNCQHALPQEAQSLSINSGCAVYANTVSLLRK

SEQ ID NO: 2343 - protein, 1034 aa, Homo sapiens
MPRRKQQAPKRAAGYAQEEQLKEEEEIKEEEEEEDSGSVAQLQGGNDTGTDEELETGPEQKGCFSYQNSPGSHLSNQDAENESLLSDASDQVSDIKSVCGRDASDKKAHTHVRLPNEAHNCMDKMTAVYANILSDSYWSGLGLGFKLSNSERRNCDTRNGSNKSDFDWHQDALSKSLQQNLPSRSVSKPSLFSSVQLYRQSSKMCGTVFTGASRFRCRQCSAAYDTLVELTVHMNETGHYQDDNRKKDKLRPTSYSKPRKRAFQDMDKEDAQKVLKCMFCGDSFDSLQDLSVHMIKTKHYQKVPLKEPVPTISSKMVTPAKKRVFDVNRPCSPDSTTGSFADSFSSQKNANLQLSSNNRYGYQNGASYTWQFEACKSQILKCMECGSSHDTLQQLTTHMMVTGHFLKVTSSASKKGKQLVLDPLAVEKMQSLSEAPNSDSLAPKPSSNSASDCTASTTELKKESKKERPEETSKDEKVVKSEDYEDPLQKPLDPTIKYQYLREEDLEDGSKGGGDILKSLENTVTTAINKAQNGAPSWSAYPSIHAAYQLSEGTKPPLPMGSRVLQIRPNLTNKLRPIAPKWKVMPLVSMPTHLAPYTQVKKESEDKDEAVKECGKESPHEEASSFSHSEGDSFRKSETPPEAKKTELGPLKEEEKLMKEGSEKEKPQPLEPTSALSNGCALANHAPALPCINPLSALQSVLNNHLGKATEPLRSPSCSSPSSSTISMFHKSNLNVMDKPVLSPASTRSASVSRRYLFENSDQPIDLTKSKSKKAESSQAQSCMSPPQKHALSDIADMVKVLPKATTPKPASSSRVPPMKLEMDVRRFEDVSSEVSTLHKRKGRQSNWNPQHLLILQAQFASSLFQTSEGKYLLSDLGPQERMQISKFTGLSMTTISHWLANVKYQLRKTGGTKFLKNMDKGHPIFYCSDCASQFRTPSTYISHLESHLGFQMKDMTRLSVDQQSKVEQEISRVSSAQRSPETIAAEEDTDSKFKCKLCCRTFVSKHAVKLHLSKTHSKSPEHHSQFVTDVDEE

SEQ ID NO: 2344 - protein, 352 aa, Homo sapiens
MDCRTKANPDRTFDLVLKVKCHASENEDPVVLWKFPEDFGDQEILQSVPKFCFPFDVERVSQNQVGQHFTFVLTDIESKQRFGFCRLTSGGTICLCILSYLPWFEVYYKLLNTLADYLAKELENDLNETLRSLYNHPVPKANTPVNLSVHSYFIAPDVTGLPTIPESRNLTEYFVAVDVNNMLQLYASMLHERRIVIISSKLSTLTACIHGSAALLYPMYWQHIYIPVLPPHLLDYCCAPMPYLIGIHSSLIERVKNKSLEDVVMLNVDTNTLESPFSDLNNLPSDVVSALKNKLKKQSTATGDGVARAFLRAQAALFGSYRDALRYKPGTRGHINNGCIQSRKEVHCSTQQ

SEQ ID NO: 2345 - protein, 110 aa, Homo sapiens
MAGPSCPYCLSTTLFDFSLSVGGQRKSPVALGTWDPELKTLQLVLPCQCHRVPWPRKTGFLPSRPGHPVAILRVLPPPPGVTSENQEFVPVDFFCAMDHCPLTHSINLET

SEQ ID NO: 2346 - protein, 122 aa, Homo sapiens
MLVLTSAIPQAKHSFYQAHCLAGGRKFHRLSLGSFCRNNPYSSGQGANVSIQLAAKNVYPNKQGRPTDPLDPLEMDLGHSAFHDFSKQRGVVILSKSWRQCQCPATHHVPVLEKPLCTPLCW

SEQ ID NO: 2347 - protein, 497 aa, Homo sapiens
MALVGLPGHLHFCDQESGFLGRHCSGPCHDHCGFPSRDRVKKWCRTDFNSKLPIKVKIIPTPPRSKRVLWDQYHNLRYPPGYFPRDNLRMKNDPLDWNGDHIHTNFRDMYQHLRSMGYFVEVLGAPFTCFDASQYGTLLMVDSEEEYFPEEIAKLRRDVDNGLSLVIFSDWYNTSVMRKVKFYDENTRQWWMPDTGGANIPALNELLSVWNMGFSDGLYEGEFTLANHDMYYASGCSIAKFPEDGVVITQTFKDQGLEVLKQETAVVENVPILGLYQIPAEGGGRIVLYGDSNCLDDSHRQKDCFWLLDALLQYTSYGVTPPSLSHSGNRQRPPSGAGSVTPERMEGNHLHRYSKVLEAHLGDPKPRPLPACPRLSWAKPQPLNETAPSNLWKHQKLLSIDLDKVVLPNFRSNRPQVRPLSPGESGAWDIPGGIMPGRYNQEVGQTIPVFAFLGAMVVLAFFVVQINKAKSRPKRRKPRVKRPQLMQQVHPPKTPSV

SEQ ID NO: 2348 - protein, 217 aa, Homo sapiens
MASAGPNRPEISLARNSTCVGCPNNHSFSRTVAHGGRALASAWPPQAQFLPVGGRSRPGSCPSASSPGPELVPVGLSRPSSPGHLHGPSSCLTTTTFGPAPAQLLAAVVGPRLPCVQASRTHLRLSGGPERPGSCLPAASPGPAAASRRPPQATFPPASRQPRQARLPPAGGLLRRLISCPAAASPGQAPACRQAPQAQLLRPEGFSRPGSCLAAAS

SEQ ID NO: 2349 - protein, 709 aa, Homo sapiens
MTSLYGRHAEKTTDMPKPSAPKVHVQRSVSRDTIAIHFSASGEEEEEEEEEFREYFEEGLDDQSIVTGLEAKEDLYLEPQVGHDPAGPAASPVLADGLSVSQAPAILPVSKNTVKLLESPVPAAQVLSTVPLAVSPGSSSSGPLASSPSVSSLSEQKTSSSSPLSSPSKSPILSSSASTSTLSSAKPFMSLVKSLSTEVEPKESPHPARHRHLMKTLVKSLSTDTSRQESDTVSYKPPDSKLNLHLFKQFTQPRNTGGDSKTAPSSSLTSPSDTRSFFKVPEMEAKIEDTKRRLSEVIYEPFQLLSKIIGEESGSHRPKALSSSASELSNLSSLNGHLESNNNYSIKEEECDSEGDGYGSDSNIPRSDHPKSTGEPTREIELKSSQGSSLKDLGLKTSSLVLEKCSLSALVSKEDEEFCELYTEDFDLETEGESKVDKLSDIPLKPEVLAEDGVVLDSEDEVDSAVQHPELPVKTLGFFIMCVYVYLILPLPHYVSGLFLGIGLGFMTAVCVIWFFTPPSAHKYHKLHKNLRHWNTRSLDIKEPEILKGWMNEIYNYDPETYHATLTHSVFVRLEGGTLRLSKPNKIYPGGPATMNPSQRSPTSARKSMTSQTARFILYLKLWLESESGIKSTPFVSSLVSKMTLCLKLRLIRRLQKRSRQLREVRTLRSHPALRREQDLASEIRYSISLGELAEKKRNGLGDLFWHLS

SEQ ID NO: 2350 - protein, 305 aa, Homo sapiens
MACILKRKSVIAVSFIAAFLFLLVVRLVNEVNFPLLLNCFGQPGTKWIPFSYTYRRPLRTHYGYINVKTQEPLQLDCDLCAIVSNSGQMVGQKVGNEIDRSSCIWRMNNAPTKGYEEDVGRMTMIRVVSHTSVPLLLKNPDYFFKEANTTIYVIWGPFRNMRKDGNGIIYNMLKKTVGIYPNAQIYVTTEKRMSYCDGVFKKETGKDRVQSGSYLSTGWFTFLLAMDACYGIHVYGMINDTYCKTEGYRKVPYHYYEQGRDECDEYFLHEHAPYGGHRFITEKKVFAKWAKKHRIIFTHPNWTLS

SEQ ID NO: 2351 - protein, 175 aa, Homo sapiens
MKAINSLGAGIIEKIALQFPYRFWDSKVQGADFFGHVPPSASKRGLFAVFYDMDPQKKHSVLMSVIAGEAVASVRTLDDKQVLQQCMATLRELFKEQEVPDPTKYFVTRWSTDPWIQMAYSFVKTGGSGEAYDIIAEDIQGTVFFAGEATNRHFPQTVTGAYLSGVREASKIAAF

SEQ ID NO: 2352 - protein, 103 aa, Homo sapiens [sequence omitted]

SEQ ID NO: 2353 - protein, 388 aa, Homo sapiens
MSDEASAITSYEKFLTPEEPFPLLGPPRGVGTCPSEEPGCLDISDFGCQLSSCHRTDPLHRFHTNRWNLTSCGTSVASSEGSEELFSSVSVGDQDDCYSLLDDQDFTSFDLFPEGSVCSDVSSSISTYWDWSDSEFEWQLPGSDIASGSDVLSDVIPSIPSSPCLLPKKKNKHRNLDELPWSAMTNDEQVEYIEYLSRKVSTEMGLREQLDIIKIIDPSAQISPTDSEFIIELNCLTDEKLKQVRNYIKEHSPRQRPAREAWKRSNFSCASTSGVSGASASASSSSASMVSSASSSGSSVGNSASNSSANMSRAHSDSNLSASAAERIRDSKKRSKQRKLQQKAFRKRQLKEQRQARKERLSGLFLNEEVLSLKVTEEDHEADVDVLM

SEQ ID NO: 2354 - protein, 444 aa, Homo sapiens
MSEETATSDNDNSYARVRAVVMTRDDSSGGWLPLGGSGLSSVTVFKVPHQEENGCADFFIRGERLRDKMVVLECMLKKDLIYNKVTPTFHHWKIDDKKFGLTFQSPADARAFDRGIRRAIEDISQGCPESKNEAEGADDLQANEEDSSSSLVKDHLFQQETVVTSEPYRSSNIRPSPFEDLNARRVYMQSQANQITFGQPGLDIQSRSMEYVQRQISKECGSLKSQNRVPLKSIRHVSFQDEDEIVRINPRDILIRRYADYRHPDMWKNDLERDDADSSIQFSKPDSKKSDYLYSCGDETKLSSPKDSVVFKTQPSSLKIKKSKRRKEDGERSRCVYCQERFNHEENVRGKCQDAPDPIKRCIYQVSCMLCAESMLYHCMSDSEGDFSDPCSCDTSDDKFCLRWLALVALSFIVPCMCCYVPLRMCHRCGEACGCCGGKHKAAG

SEQ ID NO: 2355 - protein, 121 aa, Homo sapiens
MISAHRDLRLPGSSDSPASVFPSGWDYRHAPLCLANFVFLVEAGFLHVGQSGLELPASGDPPASASQSAGITGVSHRDGLLCFNFLTSPLTHGLVTHVLFSFYILDSSNFLILLLCNLSPS

SEQ ID NO: 2356 - protein, 178 aa, Homo sapiens
MARELSESTALDAQSTEDQMELLVIKVEEEEAGFPSSPDLGSEGSRERFRGFRYPEAAGPREALSRLRELCRQWLQPEMHSKEQILELLVLEQFLTILPGNLQSWVREQHPESGEEVVVLLEYLERQLDEPAPQVERTGLVSERCGLFPPEIPDQSEGHSFNIQEFFISFLYREPPWQ

SEQ ID NO: 2357 - protein, 369 aa, Homo sapiens [sequence omitted]

SEQ ID NO: 2358 - protein, 111 aa, Homo sapiens
MYIMEEDPSQPSQSPSSKCLSSSICSQIPWHSRQACPWEGPWDGEAGFAALHACPLGFQLTHPRVSGALQDGKCWGGGRQTTLCPTGTDPPCHRLPKGAPQPLPSPPWCCY

SEQ ID NO: 2359 - protein, 107 aa, Homo sapiens
MTGRMATLEKSHSSACWRKRSSRTCVEPDRTQDAIHEPRGLSRSHTVLRHRHFVFLPLSSGAHPSVPPRRKNCAMKNGKLLRSCSSVRRAADKLDWGRFFLQDLQSV

SEQ ID NO: 2360 - protein, 579 aa, Homo sapiens [sequence omitted]

SEQ ID NO: 2361 - protein, 430 aa, Homo sapiens
MQHVSSSQSSQRHVQWPGACPGAGEEQPACSQPSLPLTLPSPSHQLQQLMQVQTQSPTQPSPGPGQALQNVRAGAPGPGLGLCSSSPTGDFVDASVLVRQISLSPSSGGHFVFQDGSGLTQIAQGAQVQLQHPGTPITVRERRPSQPHTQSGGTIHHLGPQSPAAAGGAGLQPLAGPSHITTANLPPQISSIIQGQLVQQQQVLQGPPLPRPLGFERTPGVLLPGAGGAAGFGMTSPPPPTSPSRTAVPPGLSSLPLTSVGNTGMKKVPKKLEEIPPASPEMAQMRKQCLDYHHQEMQALKEVFKEYLIELFFLQHFQGNMMDFLAFKERLYGPLQAYLRQNDLDIEEEEEEHFEVINDEVKVVARKHGQPGTPVAIATQLPPWTSAAFPAQQQPLQPLAPTTVLSVSADWNALLQRPNKYIWGLQYLEM

SEQ ID NO: 2362 - protein, 100 aa, Homo sapiens
MILELFSRVLAGYFVECLSVSICLVILFVCLFVLRWSLTLSPRLDFSGELSWLTLQPLPPRFKRFTCLSLPSSWNYRHPPPCLANFCVFSRGGVSPCWPG

SEQ ID NO: 2363 - protein, 121 aa, Homo sapiens
MLLFAIRTLNISILSSWQFFFFFSCVAQADLQLLGPSNPASACQVARTTGVHHCARKVFLLFFFLSWYSQITTSVILTSSISYSLYLLSHICVNIELTFYILTSRINGPMWFFFSLIAGVL

SEQ ID NO: 2364 - protein, 100 aa, Homo sapiens
MKRAGLQRHCLWAYGPFLTVWGQRRSPEGSLSWNISAFFCFCFCFCFETKSPVPQAGVQWRNLSSLQPPPPRLKRFCCLSLLSSWDYRRLPPRPADFLYF

SEQ ID NO: 2365 - protein, 251 aa, Homo sapiens
MTGTRSRPQPAQNATTANTSRPLKSSGTRYENELALRQGVEADINGLRRVLDELTLARTDLEMQIEGLNEELAYLKKNHEEEMKEFSSQLAGQVNVEMDAAPGVDLTRVLAEMREQYEAMAEKNRRDVEAWFFSKTEELNKEVASNTEMIQTSKTEITDLRRTMQELEIELQSQLSMKAGLENSLAETECRYATQLQQIQGLIGGLEAQLSELRCEMEAQNQEYKMLLDIKTRLEQEIATYRSLLEGQDAK

SEQ ID NO: 2366 - protein, 107 aa, Homo sapiens
MATSLGLGPSVLQLQQHLSDCIWQRSPSSDSSPFLLTRSTWDDIHPLDDPGESLVSRPPMSNHHPLPWNLTQARIPGIQTWMSLGPLFPRPQGTTAWVSTGQDRNVA

SEQ ID NO: 2367 - protein, 461 aa, Homo sapiens [sequence omitted]

SEQ ID NO: 2368 - protein, 576 aa, Homo sapiens
MKARRNKKQIPSFRKLIKTSKVKLENKLKNKQFKQQSTLKKYRKEQRKLRQAVKDAVSKKPIPLENPKEKRPGKRIEREEEEEEEALPLDMMDEDDLQLMKDLGQRVSFLTRDLSSSEPVHAKKRKHERIIDKYEKIPRTLQTAPEKELIHLLPIKDKSGIIPQTREKPVTDSNKDEEDQEEERELEEEIIEDPIQELTIEEHLIERKKKLQEKKMHIAALASAILSDPENNIKKLKELRSMLMEQDPDVAVTVRKLVIVSLMELFKDITPSYKIRPLTEAEKSTKTRKETQKLREFEEGLVSQYKFYLENLEQMVKDWKQRKLKKSNVVSLKAYKGLAEVAVKSLCELLVALPHFNFHNNIIVLIVPLMNDMSKLISEMCCEAVKKLFKQDKLGQASLGVIKVISGFVKGRNYEVRPEMLKTFLCLRIKEVEVKKDTEDINKPKKFMTFKEKRKSLSRMQRKWKKAEEKLERELREAEASESTEKKLKLHTETLNIVFVTYFRILKKAQRSPLLPAVLEGLAKFAHLINVEFFDDLLVVLHTLIESGDLSYQESLHCVQTAFHILSGQGDVLLIH

SEQ ID NO: 2369 - protein, 125 aa, Homo sapiens [sequence omitted]

SEQ ID NO: 2370 - protein, 340 aa, Homo sapiens [sequence omitted]

SEQ ID NO: 2371 - protein, 196 aa, Homo sapiens
MGSVNSRGHKAEAQVVMMGLDSAGKTTLLYKLKGHQLVETLPTVGFNVEPLKAPGHVSLTLWDVGGQAPLRASWKDYLEGTDILVYVLDSTDEARLPESAAELTEVLNDPNMAGVPFLVLANKQEAPDALPLLKIRNRLSLERFQDHCWELRGCSALTGEGLPEALQSLWSLLKSRSCMCLQARAHGAERGDSKRS

SEQ ID NO: 2372 - protein, 152 aa, Homo sapiens
MHLNAKILVSSVSFLPKCWDYRHEPLRPASLELLSLAIGNRSKWNSFPLFLASPQIRPRLWRASEVERLLCVFVFVFVFRQGSCSVTQAGVQWRDLSSLQPPSPGFKRFSCLSLPSSWDYRHLPPHLASFCIFSRDNVSQCCPGWSRTPGFK

SEQ ID NO: 2373 - protein, 669 aa, Homo sapiens
MGSNSSRIGDLPKNEYLKKLSGTESISENDPFWNQLLSFSFPAPTSSSELKLLEEATISVCRSLVENNPRTGNLGALIKVFLSRTKELKLSAECQNHIFIWQTHNALFIICCLLKVFICQMSEEELQLHFTYEEKSPGNYSSDSEDLLEELLCCLMQLITDIPLLDITYEISVEAISTMVVFLSCQLFHKEVLRQSISHKYLMRGPCLPYTSKLVKTLLYNFIRQEKPPPPGAHVFPQQSDGGGLLYGLASGVATGLWTVFTLGGVGSKAAASPELSSPLANQSLLLLLVLANLTDASDAPNPYRQAIMSFKNTQDSSPFPSSIPHAFQINFNSLYTALCEQQTSDQATLLLYTLLHQNSNIRTYMLARTDMENLVLPILEILYHVEERNSHHVYMALIILLILTEDDGFNRSIHEVILKNITWYSERVLTEISLGSLLILVVIRTIQYNMTRTRDKYLHTNCLAALANMSAQFRSLHQYAAQRIISLFSLLSKKHNKVLEQATQSLRGSLSSNDVPLPDYAQDLNVIEEVIRMMLEIINSCLTNSLHHNPNLVYALLYKRDLFEQFRTHPSFQDIMQNIDLVISFFSSRLLQAGAELSVERVLEIIKQGVVALPKDRLKKFPELKFKYVEEEQPEEFFIPYVWSLVYNSAVGLYWNPQDIQLFTMDSD

SEQ ID NO: 2374 - protein, 129 aa, Homo sapiens [sequence omitted]

SEQ ID NO: 2375 - protein, 119 aa, Homo sapiens [sequence omitted]

SEQ ID NO: 2376 - protein, 358 aa, Homo sapiens
MPQTGCPGQPPPLPLLGAPRTRGSPSPFGQPQSPADLPARDVVGESGSRSHTAEKGQLASRRPSRAVTPRPPDLPLNYQLQPRAGHGASRRPYPAPLAPPDPGARVTYSSAVATCLGPGLLPAWPRRVLPVLAVLRFCASPLQQQPQPLLFGRDVVLFPPGPAIPASGLASGFGAAGRAGHDSGGSACTWGRGRTRRERPLGGAGASERGLGGSARRGAGHPGGRGLLRGPLLALWRPLLAACAHRGHAGYWPARLSPAQAQAVAVPCLWPGPLWPSPAPSPRPSQVAPDGLPAQGGEKRKDAPRWWTSATTTLSLLLPCVFHDLEVVGNPRLLKTRGEFRLQDDMNAPSHCLPTDLF

SEQ ID NO: 2377 - protein, 146 aa, Homo sapiens [sequence omitted]

SEQ ID NO: 2378 - protein, 795 aa, Homo sapiens
MSDLKCVQDAKGGSFYRDHCPVLGEQNGNRNPGGLQIGDLVNIDLDLEIVQSLQHGHGGWTDGMFETLTTTGTVCGIDEDHDIVVQYPSGNRWTFNPAVLTKANIVRSGDAAQGAEGGTSQFQVGDLVQVCYDLERIKLLQRGHGEWAEAMLPTLGKVGRVQQIYSDSDLKVEVCGTSWTYNPAAVSKVASAGSAISNASGERLSQLLKKLFETQESGDLNEELVKAAANGDVAKVEDLLKRPDVDVNGQCAGHTAMQAASQNGHVDILKLLLKQNVDVEAEDKDGDRAVHHAAFGDEGAVIEVLHRGSADLNARNKRRQTPLHIAVNKGHLQVVKTLLDFGCHPSLQDSEGDTPLHDAISKKRDDILAVLLEAGADVTITNNNGFNALHHAALRGNPSAMRVLLSKLPRPWIVDEKKDDGYTALHLAALNNHVEVAELLVHQGNANLDIQNVNQQTALHLAVERQHTQIVRLLVRAGAKLDIQDKDGDTPLHEALRHHTLSQLRQLQDMQDVGKVDAAWEPSKNTLIMGLGTQGAEKKSAASIACFLAANGADLSIRNKKGQSPLDLCPDPNLCKALAKCHKEKVSGQVGSRSPSMISNDSETLEECMVCSDMKRDTLFGPCGHIATCSLCSPRVKKCLICKEQVQSRTKIEECVVCSDKKAAVLFQPCGHMCACENCANLMKKCVQCRAVVERRVPFIMCCGGKSSEDATDDISSGNIPVLQKDKDNTNVNADVQKLQQQLQDIKEQTMCPVCLDRLKNMIFLCGHGTCQLCGDRMSECPICRKAIERRILLY

SEQ ID NO: 2379 - protein, 764 aa, Homo sapiens
MMIHLLMVLTIWQIKWILLLFFDLEDLDSETDVSKAGCVATQNPKRIQRMNSSFSVKPFEKTDVATGFDPLSLLVAETEQQQKEEEEEDEDDSKSISTPSARRDLAEEIVMYMNNMSSPLTSRTPSIDLQRACDDKLNKKSPPLVKACRRSSLPPNSPKPVRLTKSKSYTKSEEKPRDRLWSSPAFSPTCPFREESQDTLTHSSPSFNLDTLLVPKLDVLRNSMFTAGKGVAEKASKWYSRFTMYTTSSKDQSSDRTSLSSVGAQDSESTSLTDEDVCHELEGPISSQETSATSGTKRIDLSRISLESSASLEGSLSKFALPGKSEVTSSFNASNTNIFQNYAMEVLISSCSRCRTCDCLVHDEEIMAGWTADDSNLNTTCPFCGNIFLPFLNIEIRDLRRPGRYFLKSSPSTENMHFPSSISSQTRQSCISTSASGLDTSALSVQGNFDLNSKSKLQENFCTRSIQIPANRSKTAMSKCPISPMARSISTSGPLDKEDTGRQKLISTGSLPATLQGATDSLGLEWHLPSPDPVTVPYLSPLVVWKELESLLENEGDHAITVADFVDHHPIVFWNLVWYFRRLDLPSNLPGLILSSEHCNKYSKIPRHCMSEDSKYVLIQMLWDNMKLHQDPGQPLYILWNAHTQKYPMVHLLQKSDNSFNQELLKSMVKSIKMNDVYGPMSQILETLNKCPHFKRQRSLYREILFLSLVALGRENIDIDAFDKEYKMAYDRLTPSQVKSTHNCDRPPSTGVMECRKTFGEPYL

SEQ ID NO: 2380 - protein, 188 aa, Homo sapiens
MCRATDPRCPPCSSDHGQHGVMGVHTGADTRGQYLTYLLYRWEQGGSGGHSQNYTAFNRWQNWGSDPDLGSSHSWCDCGSSFPHLGLAISLSEWTWRGRGPSSWMAAGIKSSLGLARRRACGWWTGMPGSSPGSLLPSNRLSLVPLVPSASMTRLMRSRTASGSCTTALYFSFWLTVDFLIGSLVRVN

SEQ ID NO: 2381 - protein, 293 aa, Homo sapiens
MLNGEVSLTSGHAIIRTPMGDAVDLSSAGTAGVLIGYCPQQDALDELLTGWEHLYYYCSLRGIPRQCIPEVAGDLIRRLHLEAHADKPVATYSGGTKRKLSTALALVGKPDILLLDEPSSGMDPCSKRYLWQTIMKEVREGCAAVLTSHSMEECEALCTRLAIMVNGSFKCLGSPQHIKNRFGDGYTVKVWLCKEANQHCTVSDHLKLYFPGIQFKGQHLNLLEYHVPKRWGCLADLFKVIENNKTFLNIKHYSINQTTLEQVFINFASEQQQTLQSTLDPSTDSHHTHHLPI

SEQ ID NO: 2382 - protein, 140 aa, Homo sapiens [sequence omitted]

SEQ ID NO: 2383 - protein, 213 aa, Homo sapiens
MASADQRAQGSAKRDATPGEPFGFSPVWDSHRRIAWGKFMNSGQTCVAPDYILCDPSIQNQIVEKLKKSLKEFYGEDAKKSRDYGRIISARHFQRVMGLIEGQKVAYGGTGDAATRYIAPTILTDVDPQSPVMQEEIFGPVLPIVCVRSLEEAIQFINQREKPLALYMFSSNDKVGGGPGVPSARVLGPTDLGSNCSFTVLWLCDLGQVTGSF

SEQ ID NO: 2384 - protein, 362 aa, Homo sapiens
MPAPVGRRSPPSPRSSMAAVALRDSAQGMTFEDVAIYFSQEEWELLDESQRFLYCDVMLENFAHVTSLGYCHGMENEAIASEQSVSIQVRTSKGNTPTQKTHLSEIKMCVPVLKDILPAAEHQTTSPVQKSYLGSTSMRGFCFSADLHQHQKHYNEEEPWKRKVDEATFVTGCRFHVLNYFTCGEAFPAPTDLLQHEATPSGEEPHSSSSKHIQAFFNAKSYYKWGEYRKASSHKHTLVQHQSVCSEGGLYECSKCEKAFTCKNTLVQHQQIHTGQKMFECSECEESFSKKCHLILHKIIHTGERPYECSDREKAFIHKSEFIHHQRRHTGGVRHECGECRKTFSYKSNLIRHRRVHTEERP

SEQ ID NO: 2385 - protein, 641 aa, Homo sapiens
MVHGSVTFRDVAIDFSQEEWECLQPDQRTLYRDVMLENYSHLISLGSSISKPDVITLLEQEKEPWMVVRKETSRRYPDLELKYGPEKVSPENDTSEVNLPKQVLKQISTTLGIEAFYFRNDSEYRQFEGLQGYQEGNINQKMISYEKLPTHTPHASLICNTHKPYECKECGKYFSRSANLIQHQSIHTGEKPFECKECGKAFRLHIQFTRHQKFHTGEKPFECNECGKAFSLLTLLNRHKNIHTGEKLFECKECGKSFNRSSNLVQHQSIHSGVKPYECKECGKGFNRGAHLIQHQKIHSNEKPFVCKECGMAFRYHYQLIEHCQIHTGEKPFECKECGKAFTLLTKLVRHQKIHTGEKPFECRECGKAFSLLNQLNRHKNIHTGEKPFECKECGKSFNRSSNLVQHQSIHAGIKPYECKECGKGFNRGAHLIQHQKIHSNEKPFVCRECEMAFRYHCQLIEHSRIHTGDKPFECQDCGKAFNRGSSLVQHQSIHTGEKPYECKECGKAFRLYLQLSQHQKTHTGEKPFECKECGKFFRRGSNLNQHRSIHTGKKPFECKECGKAFRLHMHLIRHQKLHTGEKPFECKECGKAFRLHMQLIRHQKLHTGEKPFECKECGKVFSLPTQLNRHKNIHTGEKAS

SEQ ID NO: 2386 - protein, 183 aa, Homo sapiens
MSDVTFLVEGRPFYAHKVLLFTASPRFKALLSSKPTNDGTCIEIGYVKYSIFQLVMQYLYYGGPESLLIKNNEIMELLSAAKFFQLEALQRHCEIICAKSINTDNCVDIYNHAKFLGVTELPAYCEGYFLKNMMVLIENEAFKQLLYDKNGEGTGQDVLQDLQRTLAIRIQSIHLSSSKGSVV

SEQ ID NO: 2387 - protein, 855 aa, Homo sapiens
MLLNELLCISKVPPGTKHVDMDLATLPPTTAMAVLLYNRWAIRTIVQSSFPVKQAKPGPPQLSVMNQMQQEKELTENILKVLKEQAADSILVLEAALKLNKDLYVHTMRTLDLLAMEPGMVNGETESSTAGLKVKTEEMQCQVCYDLGAAYFQQGSTNSAVYENAREKFFRTKELIAEIGSLSLHCTIDEKRLAGYCQACDVLVPSSDSTSQQLTPYSQVHICLRSGNYQEVIQIFIEDNLTLSLPVQFRQSVLRELFKKAQQGNEALDEICFKVCACNTVRDILEGRTISVQFNQLFLRPNKEKIDFLLEVCSRSVNLEKASESLKGNMAAFLKNVCLGLEDLQYVFMISSHELFITLLKDEERKLLVDQMRKRSPRVNLCIKPVTSFYDIPASASVNIGQLEHQLILSVDPWRIRQILIELHGMTSERQFWTVSNKWEVPSVYSGVILGIKDNLTRDLVYILMAKGLHCSTVKDFSHAKQLFAACLELVTEFSPKLRQVMLNEMLLLDIHTHEAGTGQAGERPPSDLISRVRGYLEMRLPDIPLRQVIAEECVAFMLNWRENEYLTLQVPAFLLQSNPYVKLGQLLAATCKELPGPKESRRTAKDLWEVVVQICSVSSQHKRGNDGRVSLIKQRESTLGIMYRSELLSFIKKLREPLVLTIILSLFVKLHNVREDIVNDITAEHISIWPSSIPNLQSVDFEAVAITVKELVRYTLSINPNNHSWLIIQADIYFATNQYSAALHYYLQAGAVCSDFFNKAVPPDVYTDQVIKRMIKCCSLLNCHTQVAILCQFLREIDYKTAFKSLQEQNSHDAMDSYYDYIWDVTILEYLTYLHHKRGETDKRQIAIKAIGQT

SEQ ID NO: 2388 - protein, 502 aa, Homo sapiens
MDCGPPATLQPHLTGPPGTAHHPVAVCQQESLSFAELPALKPPSPVCLDLFPVAPEELRAPGSRWSLGTPAPLQGLLWPLSPGGSDTEITSGGMRPSRAGSWPHCPGAQPPALEGPWSPRHTQPQRRASHGSEKKSAWRKMRVYQREEVPGCPEAHAVFLEPRQVVQEQALSTEEPRVELSGSTRVSLEGPERRRFSASELMTRLHSSLRLGRNSAARALISGSGTGAAREGKASGMQARSVEMSGDRVSRPAPGDSREGDWSEPRLDTQEEPPLGSRSTNERRQSRFLLNSVLYQEYSDVASARELRRQQREEEGPGDEAEGAEEGPGPPRANLSPSSSFRAQRSARGSTFSLWQDIPDVRGSGVLATLSLRDCKLQEAKFELITSEASYIHSLSVAVGHFLGSAELSECLGAQDKQWLFSKLPEVKSTSERFLQDLEQRLEADVLRFSVCDVVLDHCPAFRRVYLPYVTNQAYQERTYQRLLRENKRVTSATSKLGEAPV

SEQ ID NO: 2389 - protein, 661 aa, Homo sapiens [sequence omitted]

SEQ ID NO: 2390 - protein, 682 aa, Homo sapiens
MADSGLLLKWGSCRSTWLRVRKARPQLILSRRPRRRLGSLRWCGRRRLRRRLLQAQAAGVDWREGARQVSRAAAARRPNTATPSPIPSPTPASEPESEPELESASSCHRPLLIPPVRPVGPGRALLLLPVEQGFTFSGICRVTCLYGQVQVFGFTISQGQPAQDIFSVYTHPCLSIHALHYSQPEKSKKELKREARNLLKSHLNLDDRRWSMQNFSPQCSIVLLEHLKTATVNFITSYPGSSYIFVQESPTPQIKPEYLALRSVGIRREKKRKGLQLTESTLSALEELVNVSCEEVDGCPVILVCGSRDVGKSTFNRYLINHLLNSLPCVDYLECDLGQTEFTPPGCISLLNITEPVLGPPFTHLRTPQKMVYYGKPSCKNNYENYIDIVKYVFSAYKRESPLIVNTMGWVSDQGLLLLIDLIRLLSPSHVVQFRSDHSKYMPDLTPQYVDDMDGLYTKSKTKMRNRRFRLAAFADALEFADEEKESPVEFTGHKLIGVYTDFAFRITPRNRESHNKILRDLSILSYLSQLQPPMPKPLSPLHSLTPYQVPFNAVALRITHSDVAPTHILYAVNASWVGLCKIQDDVRGYTNGPILLAQTPICDCLGFGICRGIDMEKRLYHILTPVPPEELRTVNCLLVGAIAIPHCVLKCQRGIEGTVPYVTTDYNKTSWSIRENWSKRT

SEQ ID NO: 2391 - protein, 187 aa, Homo sapiens
MDHMTSHPVLSQYEGFQHFLSCLDDKQWKMGKRRAERDEMVGASFLLTFQIPTEHQDLQDVEDRVDTFKAFSKKMDDSVLQLSTVASELGLLSNFPDIIHLQKGAFAKVKESQRMSDEGRMVQDEADGIRRRCRVVGFALQAEMNHFHQRRELDFKHMMQNYLRQQILFYQRVGQQLEKTLRMYDNL

SEQ ID NO: 2392 - protein, 518 aa, Homo sapiens
MVVACLGVLCPQGKVCKAGSPAGHVCVLSQGPEEISLPLWAVPAIVGSCATVLALLVLSLILCNQCRGKKAKNPKEEKKPKEKKKKGSENVAFDDPDNIPPYGDDMTVRKQPEGNPKPDIIERENPYLIYDETDIPHNSETIPSAPLASPEQEIEHYDIDNASSIAPSDADIIQHYKQFRSHTPKFSIQRHSPLGFARQSPMPLGASSLTYQPSYGQGLRTSSLSHSACPTPNPLSRHSPAPFSKSSTFYRNSPARELHLPIRDGNTLEMHGDTCQPGIFNYATRLGRRSKSPQAMASHGSRPGSRLKQPIGQIPLESSPPVGLSIEEVERLNTPRPRNPSICSADHGRSSSEEDCRRPLSRTRNPADGIPAPESSSDSDSHESFTCSEMEYDREKPMVYTSRMPKLSQVNESDADDEDNYGARLKPRRYHGRRAEGGPVGTQAAAPGTADNTLPMKLGQQAGTFNWDNLLNWGPGFGHYVDVFKDLASLPEKAAANEEGKAGTTKPVPKDGEAEQYV

SEQ ID NO: 2393 - protein, 122 aa, Homo sapiens
MEFVNFLKNPKQYQDLGAKIPKGAMLTGPPGTGKTLLAKATAGEATVPFITVNGSEFLEMFIGVGPARGSTLPPTSWCWLAPTALTSWTRPSCGLAGFIARFTLVPLTLKAGPPSLRSTCAH

SEQ ID NO: 2394 - protein, 481 aa, Homo sapiens [sequence omitted]

SEQ ID NO: 2395 - protein, 695 aa, Homo sapiens
MSGAALGLEIVFVFFLALFLLHRYGDFKKQHRLVIIGTLLAWYLCFLIVFILPLDVSTTIYNRCKHAAANSSPPENSNITGLYATANPVPSQHPCFKPWSYIPDGIMPIFWRVVYWTSQFLTWILLPFMQSYARSGGFSITGKIKTALIENAIYYGTYLLIFGAFLIYVAVNPHLHLEWNQLQTIGIAAANTWGLFLLVLLLGYGLVEIPRSYWNGAKRGYLLMKTYFKAAKLMTEKADAEENLEDAMEEVRKVNESIKYNHPLRKCVDTILKKCPTEYQEKMGRNMDDYEDFDEKHSIYPSEKSLVKLHKQVIYSVQRHRRTQVQWQILLEQAFYLEDVAKNETSATHQFVHTFQSPEPENRFIQYFYNPTFEWYWECLLRPWFYKILAVVLSIFSVIVVWSECTFFSTTPVLSLFAVFIQLAEKTYNYIYIEIACFLSIFFLSICVYSTVFRIRVFNYYYLASHHQTDAYSLLFSGMLFCRLTPPLCLNFLGLTHMDSSISHKNTQPTAYTSIMGSMKVLSFIADGFYIYYPMLVVILCIATYFSLGTRCLNLLGFQQFMGDDDMTSDLVNEGKELIRKEKRKRQRQEEGENRRREWKERYGHNREDSTRNRNIHTDPKESNFSDVNTNRSAFKYTRANNRTERDRIELLQDAEPLDFNAETFTDDPLESESGRYQPGGRYLSMSRSDIFNDV

SEQ ID NO: 2396 - protein, 298 aa, Homo sapiens
MESQKEARTLQEPVARPSGASSSQTPNDKERREGGAVPAAAALGAEADDDSADGLWELPVEPAERRPECTRCSRPQKVCLCPFLPAHPLHISTHLYIIQHPAEENKVLRTVPLLAACLPQDKCKVKIGRRFSEERDPELSTVCRKSGTLILYPGAEAANLEEFILDSPVYPSTIIIIDGTWSQAKDIFYKNSLFRHPKQVQLKTSISSQYVIRMQPTNRCLSTLECAAVALSILEKNNYIQETLLRPLQALCSFQLQHGAQIRLSKEHLLKNGLYPKPMPKNKRKLRKMELLMNSVKI

SEQ ID NO: 2397 - protein, 273 aa, Homo sapiens
MLRYPYFCRMYKECLSCWLESGIPNLGVWPKRIHTTAEKYREYEAREQTDQTQAQELHRSQDRDFETMAKLHIPVMVDEVVHCLSPQKGQIFLDMTFGSGGHTKAILQKESDIVLYALDRDPTAYALAEHLSELYPKQIRAMLGQFSQAEALLMKAGVQPGTFDGVLMDLGCSSMQLDTPERGFSLRKDGPLDVRMDGGRYPDMPTAADVVNALDQQALASILRTYGEEKHAKKIASAIVQARSIYPITRTQQLASIVAEYSETYFPVAQTLY

SEQ ID NO: 2398 - protein, 174 aa, Homo sapiens [sequence omitted]

SEQ ID NO: 2399 - protein, 413 aa, Homo sapiens
MFILGDTAYGSCCVDVLGAEQAGAQALIHFGPACLSPPARPLPVAFVLRQRSVALELCVKAFEAQNPDPKAPVVLLSEPACAHALEALATLLRPRYLDLLVSSPAFPQPVGSLSPEPMPLERFGRRFPLAPGRRLEEYGAFYVGGSKASPDPDLDPDLSRLLLGWAPGQPFSSCCPDTGKTQDEGARAGRLRARRRYLVERARDARVVGLLAGTLGVAQHREALAHLRNLTQAAGKRSYVLALGRPTPAKLANFPEVDVFVLLACPLGALAPQLSGSFFQPILAPCELEAACNPAWPPPGLAPHLTHYADLLPGSPFHVALPPPESELWETPDVSLITGDLRPPPAWKSSNDHGSLALTPRPQLELAESSPAASFLSSRSWQGLEPRLGQTPVTEAVSGRRGIAIAYEDEGSG

SEQ ID NO: 2400 - protein, 256 aa, Homo sapiens
MATWRRDGRLTGGQRLLCAGLAGTLSLSLTAPLELATVLAQVGVVRGHARGPWATGHRVWRAEGLRALWKGNAVACLRLFPCSAVQLAAYRKFVVLFTDDLGHISQWSSIMAGSLAGMVSTIVTYPTDLIKTRLIMQNILEPSYRGLLHAFSTIYQQEGFLALYRGVSLTVVGALPFSAGSLLVYMNLEKIWNGPRDQFSLPQNFANVCLAAAVTQTLSFPFETVKRKMQSCCLFAYDGCVPLEAVMGRLAQWVTV

SEQ ID NO: 2401 - protein, 126 aa, Homo sapiens
MRNDVIEEDLAKEVQNGRLFRLLAKLGTINEGPEFQKDPTWSETGDRYLLKLFRDHLFHQVTEAGAPWIDLSHIISCLNKLDAGVPEKISLISRDEKSVLVVTYSDLKRCFENTFQELIAAANGQL

SEQ ID NO: 2402 - protein, 364 aa, Homo sapiens
MRPQDSTGVAELQEPGLPLTDDAPPGATEEPAAAEAAGAPDRGRCWLCLSSPCCSRTEPAKKKAPCPGLGLFYTLLSAFLFSVGSLFVKKVQDVHAVEISAFRCVFQMLVVIPCLIYRKTGFIGPKGQRIFLILRGVLGSTAMMLIYYAYQTMSLADATVITFSSPVFTSIFAWICLKEKYSPWDALFTVFTITGVILIVRPPFLFGSDTSGMEESYSGHLKGTFAAIGSAVFAASTLVILRKMGKSVDYFLSIWYYVVLGLVESVIILSVLGEWSLPYCGLDRLFLIFIGLFGLGGQIFITKALQIEKAGPVAIMKTMDVVFAFIFQIIFFNNVPTWWTVGGALCVVASNVGAAIRKWYQSSK

SEQ ID NO: 2403 - protein, 452 aa, Homo sapiens
MSASLNYKSFSKEQQTMDNLEKQLICPICLEMFTKPVVILPCQHNLCRKCASDIFQASNPYLPTRGGTTMASGGRFRCPSCRHEVVLDRHGVYGLQRNLLVENIIDIYKQESTRPEKKSDQPMCEEHEEERINIYCLNCEVPTCSLCKVFGAHKDCQVAPLTHVFQRQKSELSDGIAILVGSNDRVQGVISQLEDTCKTIEECCRKQKQELCEKFDYLYGILEERKNEMTQVITRTQEEKLEHVRALIKKYSDHLENVSKLVESGIQFMDEPEMAVFLQNAKTLLKKISEASKAFQMEKIEHGYENMNHFTVNLNREEKIIREIDFYREDEDEEEEEGGEGEKEGEGEVGGEAVEVEEVENVQTEFPGEDENPEKASELSQVELQAAPGALPVSSPEPPPALPPAADAPVTQIGFEAPPLQGQAAAPASGSGADSEPARHIFSFSWLNSLNE

SEQ ID NO: 2404 - protein, 243 aa, Homo sapiens
MTGIAAASFFSNTCRFGGCGLHFPTLADLIEHIEDNHIDTDPRVLEKQELQQPTYVALSYINRFMTDAARREQESLKKKIQPKLSLTLSSSVSRGNVSTPPRHSSGSLTPPVTPPITPSSSFRSSTPTGSEYDEEEVDYEESDSDESWTTESAISSEAILSSMCMNGGEEKPFACPVPGCKKRYKNVNGIKYHAKNGHRTQIRVRKPFKCRCGKSYKTAQGLRHHTINFHPPVSAEIIRKMQQ

SEQ ID NO: 2405 - protein, 552 aa, Homo sapiens
MRRLTRRLVLPVFGVLWITVLLFFWVTKRKLEVPTGPEVQTPKPSDADWDDLWDQFDERRYLNAKKWRVGDDPYKLYAFNQRESERISSNRAIPDTRHLRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 2406 - protein, 125 aa, Homo sapiens
MGLGIWHPSASLIGKKPPPLYLKFHFLKKKCFPPFYPSPTVLPPAHSLTLSPILLHTSLVVNDTITSSLHPQLTGIELKESVMTFLCIFAEWVSGNALPNINEANQRAAQPQYHCTYIYRYINII

SEQ ID NO: 2407 - protein, 566 aa, Homo sapiens
MDAADRSCTVSVHCSNHRVKMLVKFPAQYPNNAAPSFQFINPTTITSTMKAKLLKILKDTALQKVKRGQSCLEPCLRQLVSCLESFVNQEDSASSNPFALPNSVTPPLPTFARVTTAYGSYQDANIPFPRTSGARFCGAGYLVYFTRPMTMHRAVSPTEPTPRSLSALSAYHTGLIAPMKIRTEAPGNLRLYSGSPTRSEKEQVSISSFYYKERKSRRWKSKREGSDSGNRQIKAAGKVIIQDIACLLPVHKSLGELYILNVNDIQETCQKNAASALLVGRKDLVQVWSLATVATDLCLGPKSDPDLETPWARHPFGRQLLESLLAHYCRLRDVQTLAMLCSVFEAQSRPQGLPNPFGPFPNRSSNLVVSHSRYPSFTSSGSCSSMSDPGLNTGGWNIAGREAEHLSSPWGESSPEELRFGSLTYSDPRERERDQHDKNKRLLDPANTQQFDDFKKCYGEILYRWGLREKRAEVLKFVSCPPDPHKGIEFGVYCSHCRSEVRGTQCAICKGFTFQCAICHVAVRGSSNFCLTCGHGGHTSHMMEWFRTQEVCPTGCGCHCLLESTF

SEQ ID NO: 2408 - protein, 1047 aa, Homo sapiens [sequence omitted]

SEQ ID NO: 2409 - protein, 100 aa, Homo sapiens [sequence omitted]

SEQ ID NO: 2410 - protein, 466 aa, Homo sapiens
MKIQEHPSLSDTKQQRNQDAGDQEESFVSEVPQSDLTALCDEKNWEEPIPAFSSWQRENSDSDEAHLSPQAGRLIRQLLDEDSDPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDMTKDQIANEKVALQKALLYYESIHGRPVTKNERQVMKPLYDRYRLVKQILSRANTIPIIEEEEGSEDDSNVKPDFMVTLKTDFSARCFLDQFEDDADGFISPMDDKIPSKCSQDTGLSNLHAASIPELLEHLQEMREEKKRIRKKLRDFEDNFFRQNGRNVQKEDRTPMAEEYSEYKHIKAKLRLLEVLISKRDTDSKSM

SEQ ID NO: 2411 - protein, 515 aa, Homo sapiens
MDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 2412 - protein, 167 aa, Homo sapiens
MLVGRSSFPMQYFPINNTSLPQEYFLFQKMQWHVYNPVLQLPYYEMTAPLPNSASVSSSLNHVPDLEAGPSSYKWTHQQPSDSDLYQMTAPLPNSASVSSSLNHVPDLEAGPSSYKWTHQQPSDSDLYQMNKRKRQKQTSDSDSSTDNNRGNECSQKFRKSKKKKRY

SEQ ID NO: 2413 - protein, 119 aa, Homo sapiens [sequence omitted]

SEQ ID NO: 2414 - protein, 571 aa, Homo sapiens [sequence omitted]

SEQ ID NO: 2415 - protein, 106 aa, Homo sapiens [sequence omitted]

SEQ ID NO: 2416 - protein, 113 aa, Homo sapiens
MCVYAYLICTHIFTTYVCMIYSYIHAVCLIISKMVSLYQIVSSCGVHLHVALTLKPLPDLEPQSVCLPVHLSPRERPFKYVTFPFSFNHGLCEPERALRKMAASTRVEASRSA

SEQ ID NO: 2417 - protein, 120 aa, Homo sapiens
MPKTLVKFTLSSLPPVRGPLIRNEISKRWAVLQGRPKLRGGIQTLLAGCLLHPTQNLFNMKAEGMCSQLPIKGNQYKPAPTNQKKKKKENSPFLMSSSPGSWYFVSNILLSFLKVSLAVK

SEQ ID NO: 2418 - protein, 684 aa, Homo sapiens [sequence omitted]

SEQ ID NO: 2419 - protein, 176 aa, Homo sapiens
MEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSR

SEQ ID NO: 2420 - protein, 418 aa, Homo sapiens
MQRRDDPAARMSRSSGRSGSMDPSGAHPSVRQTPSRQPPPLLPPSATGPDATVGGPAPTPLLPPSATASVKMEPENKYLPELMAEKDSLDPSFTHAMQLLTAEIEKIQKGDSKKDDEENYLDLFSHKNMKLKERVLIPVKQYPKFNFVGKILGPQGNTIKRLQEETGAKISVLGKGSMRDKAKEEELRKGGDPKYAHLNMDLHVFIEVFGPPCEAYALMAHAMEEVKKFLVPDMMDDICQEQFLELSYLNGVPEPSRGRGVPVRGRGAAPPPPPVPRGRGVGPPRGALVRGTPVRGAITRGATVTRGVPPPPTVRGAPAPRARTAGIQRIPLPPPPAPETYEEYGYDDTYAEQSYEGYEGYYSQSQGDSEYYDYGHGEVQDSYEAYGQDDWNGTRPSLKAPPARPVKGAYREHPYGRY

SEQ ID NO: 2421 - protein, 116 aa, Homo sapiens [sequence omitted]

SEQ ID NO: 2422 - protein, 146 aa, Homo sapiens [sequence omitted]

SEQ ID NO: 2423 - protein, 114 aa, Homo sapiens
MSFFSFFFFFFEAEPRPVAQAGVQWHNLGSRQPLPPRFKRFSCLSLLSSWDYRHMPPHPANFCIFSRDGVSPCWPGWSRTPDLVICWPQPPKVLGLQVSHHVQRNACLLKGHPQ

SEQ ID NO: 2424 - protein, 520 aa, Homo sapiens
METWSVEQVCSWLVEKNLGELVHRFQEEEVSGAALLALNDRMVQQLVKKIGHQAVLMDLIKKYKQNTQGLKSPENPKKAALVMQTEAARDYRDEESSSPARHGEQMPSFYPAENLDNGLIDQRVLKQRRNVKQILARSKALQWTKSYVLPEFPYDVKCMLAEQKCPDHSMRIRIIEFLQADMTKYLEGSLYPSTQQYNDVVNALLQAHPFLDEDGCGFFLWKRALKDRFKYVRRPIEDDEQVIRNKCKFGHRRGQTRKSLADIRFDEIKLVQIKEEAVCFDSELDEHIKWFQQEYVKTEKDWREIDKRMSQTLEIRRKMIGSRTPLKDILKLFPFLKCPYQMFREFQLLTRTDIYKKTRHILESYSENILTSFSVVDNPINIVLQEKMKHYTDEDMLKYMKMTATCLLLPDVFGDDPSLFVIMNEQVQVSTPVLEVKNPFNMEVCEFSLYLERERLTKVDDCVTALAALVAAFHVFRIECPRRLSQTFNFLETLIFDMHSPYFPSLKEKENEVGFQHPLT

SEQ ID NO: 2425 - protein, 673 aa, Homo sapiens
MAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKR

SEQ ID NO: 2426 - protein, 129 aa, Homo sapiens
MLLLTRNSLLHLNSWFYFLILIDELLANAAGDYLLKGKEKFGINSEGNRSRLDVLAAHTHKQKPGHIYIKGGILSAASILDDHSSVLPERIRTWSLARGRQRPVWEASCYLWLSSCMSVLVFIKLDNRK

SEQ ID NO: 2427 - protein, 771 aa, Homo sapiens
MGCTKSAEPGTETPQVNLSDLRASTLVHKPQSDFTNDALSPKFNLSSSISSENSLIKGGAANQALLHSKSKQAKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKCYEAGHLENGITESCATSYSKDFGGGTTKIFDKPRKRKRQRHAAAKMQC

SEQ ID NO: 2428 - protein, 184 aa, Homo sapiens
MAAISFPRKRLRRNFTAETIARRSRAFEQFLGHLQAVPELRHAPDLQDFFVLPELRRAQSLTCTGLYREALALWANAWQLQAQLGTPSGPDRPLLTLAGLAVCHQELEDPGEARACCEKALQLLGDKSLHPLLAPFLEAHVRLSWRLGLDKRQSEARLQALQEAGLTPTPPPSLKELLIKEVLD

SEQ ID NO: 2429 - protein, 132 aa, Homo sapiens [sequence omitted]

SEQ ID NO: 2430 - protein, 302 aa, Homo sapiens [sequence omitted]

SEQ ID NO: 2431 - protein, 159 aa, Homo sapiens
MSLITCKFKNLGNLHAGGCGYIPLSSTREERVKNGSRVVSTALLSSYHKGIAFVIFPSHHHTPTRPPSPKPSGSGGYLLNLRRRDPPQAFLSGCPPLPPRGSVLLGCTPPRTQFFVFHVVSYPLVLQKLLQTRDQKSIGSNSSCDTSEMSDCWQVTLSI

SEQ ID NO: 2432 - protein, 750 aa, Homo sapiens
MADVLGDGGNSSLTISEGPIVSERRLNQEVALNLKEDHEVEVGVLKESVDLPEEKLPISDSPPDTQEIHVIEQEKLEAQDSGEEARNLSFNELYPSGTLKLQYNFDTIDQQFCDLADNKDTAECDIAEVDGELFVAQSNFTLILEGEEGEVEPGDFASSDVLPKAANTATEEKLVCSGENDNHGQIANLPSAVTSDQKSQKVDTLPYVPEPIKVAIAENLLDVIKDTRSKEITSDTMEQSIHETIPLVSQNIMCPTKLVKSAFKTAQETSTMTMNVSQVDDVVSSKARTRGQRIQNVNVKSAQQEASADVATPKMPRQSVRKKTRKAKEISEASENIYSDVRGLSQNQQIPQNSVTPRRGRRKKEVNQDILENTSSVEQELQITTGRESKRLKSSQLLEPAVEETTKKEVKVSSVTKRTPRRIKRSVENQESVEIINDLKVSTVTSPSRMIRKLRSTNLDASENTGNKQDDKSSDKQLRIKHVRRVRGREVSPSDVREDSNLESSQLTVQAEFDMSAIPRKRGRPRKINPSEDVGSKAVKEERSPKKKEAPSIRRRSTRNTPAKSENVDVGKPALGKSILVPNEELSMVMSSKKKLTKKTESQSQKRSLHSVSEERTDEMTHKETNEQEERLLATASFTKSSRSSRTRSSKAILLPDLSEPNNEPLFSPASEVPRKAKAKKIEVPAQLKELVSDLSSQFVISPPALRSRQKNTSNKNKLEDELKDDAQSVETLGKPKAKRIRTSKTKQAS

SEQ ID NO: 2433 - protein, 189 aa, Homo sapiens
MTPPGTSYPSQTPVQPAPDVDYDSATSAGSEVGVSPSCRRVWAAPLQTSCAPWAAPHLHPHPRGSAPKAAASGEARSPRSSWWGERRRPSEDALGTWERKEGREEGKGAVDVFDVCALMEATNIEKTGLAEAARTLLLASARVKARANRGLSGCPKGADTWFSTGTQNSHRGRKMRSLCLPVGKRDIQK

SEQ ID NO: 2434 - protein, 110 aa, Homo sapiens
MDWGKTLSSEQPKAADLAFLPPVSRPTQVKAAKQRQRSPGAWFRPGQQVGGPDWGPGTEEGRPARTGVQGPGFRVPGLEEVAGSPPFQRLEIGWTRPEDPLGLDPDFRSA

SEQ ID NO: 2435 - protein, 928 aa, Homo sapiens
MIEDKGPRVADYFVVAGLTDVSKPLEEEIHFNDACHKVAKPKEPITDVSVIIKSLGEEVPQDYICIDVTPTGLSADLNNGSLVGPQIYLCYRRGRDKPPLTDLGVLYDWKERLKQGCEIIQSTPYGRPANISGSTSSQRIYITYRRASENMTQNTLAVTDICIIIPSKGESPPHTFCKVDKNLNNSMWGSAVYLCYKKSVAKTNTVSYKAGLICRYPQEDYESFSLPESVPLFCLPMGATIECWPSNSKYPLPVFSTFVLTGASAEKVYGAAIQFYEPYSEENLTEKQRLLLGLTSADGKSDSSKTIHTNKCICLLSHWPFFDAFRKFLTFLYRYSISGPHVLPIEKHISHFMHKVPFPSPQRPRILVQLSPHDNLILSQPVSSPLPLSGGKFSTLLQNLGPENAVTLLVFAVTEHKILIHSLRPSVLTSVTEALVSMIFPFHWPCPYVPLCPLALADVLSAPCPFIVGIDSRYFDLYDPPPDVSCVDVDTNTISQIGDKKNVAWKILPKKPCKNLMNTLNNLHQQLAKLQQRPRDDGLMDLAINDYDFNSGKRLHMIDLEIQEAFLFFMASILKGYRSYLRPITQAPSETATDAASLFALQAFLRSRDRSHQKFYNMMTKTQMFIRFIEECSFVSDKDASLAFFDDCVDKVDMDKSGEVRLIELDESFKSEHTVFVTPPEIPHLPNGEEPPLQYSYNGFPVLRNNLFERPEGFLQAKKNKLPSKSSSPNSPLPMFRRTKQEIKSAHKIAKRYSSIPQMWSRCLLRHCYGLWFICLPAYVKVCHSKVRALKTAYDVLKKMQSKKMDPPDEVCYRILMQLCGQYDQPVLAVRVLFEMQKAGIDPNAITYGYYNKAVLESTWPSRSRSGYFLWTKVRNVVLGVTQFKRALKKHAHLSQTTLSGGQSDLGYNSLSKDEVRRGDTSTEDIQE

SEQ ID NO: 2436 - protein, 140 aa, Homo sapiens [sequence omitted]

SEQ ID NO: 2437 - protein, 202 aa, Homo sapiens
MIVAAIQAEKNRAGSSRQSIQKYIKSHYKVGENADSQIKLSIKRLVTTGVLKQTKGVGASGSFRLAKSDGPKKSVAFKKTKKEIKKVATPKKASKPKKAASKAPTKKPKATPVKKAKKKLAATPKKAKKTQDCQSQAGQGIQAQKGQTSETQSKVQCQEGRQEEVTMKSFLADTPSCLLFSVNNFLLFSLLMLTTTFCPLLF

SEQ ID NO: 2438 - protein, 1307 aa, Homo sapiens
MKAFQRNRSRLKKDYDDFRRQPDHDTFNRELWTTDEGEGDLGKDSPKGEISKSIDSTEPLDILEKDHFDSDDMKLSEIDFPMARSKLLKKELPSKDLPKTLLKTLKRQSKQTDYVDDSTKELSPRKKAKLSTNETTVENLESDVQIDCFSESKHTEPSFPESFASLDSVPVSTLQKGTKPIQALLAKNIGNKVTLTNQLPPSTGRNALAVEKPVLSPPEASPIKPALTCHTNTKGPLQMVYKMPCGQWLPIDLQNSSVKIQVQPMVDPKTGEKIMQQVLILPKNFVIQHKEGKAVAKEVPPLQQKGTEQHCSSFPQTTNINSSLASVFVNSPGTVSTQLPNTAFNKTITPLSSISSARPQPLSPVTSVSNLLTPSVKTSQSEAGKAKNAVSAATFSLPSASPTISSTGQPLSSTTTLNGSTNPGSSFNCFAQQTADSSEAKQELKTVCIRDSQSILVRTRGGNTGVVKVQTNPDQNSPNTVSSSSVFTFAPQLQAFLVPKSTTSSSAFSPVAGTTTTSSLSPFSQTPTSVSIPASFAPSMGKNLKLTLGHTTGSGDLGHVIDKTSHMPSSPLKSSICSSTLLPSTTSSSVSVISISAANFGQNNANIIHTPTKQQQVDYITKSYPVTRSEATAATNGDVISGTPVQKLMLVSAPSILSSGNGTAINMTPALTSTGVSAQKLVFINAPVPSGTSTPTLVAESLKQTLPPPLHKAYVKTPEQPQMVLIPSTVGTPIKINSSPAVSQIKDVKIGLDIGQAIVNTSGTVPAIPSINILQNVTPKGEDKSSKGYILPLSTSGNSVPVSSNFVSQNITPVNESVVSSARAVNVLSVTGANLSLGSFPVTSASASAGAQPPVLVSGNDTSSRIMPILSNRLCSSSLGNTVAISTVKTGHLASSVLISTTQPVVSPKCLTSALQIPVTVALPTPATTSPKIINTVPHSAAVPGATRSVSISKRQSRTSLQFHSPGVSTTVPTNVNTNKPQTELSSLSTSPGKITNTSNFASLPNQQALVKTPSYSSAPGGTTIHTASAPSNVTSLVGSQFSEPCIQQKIVINTSTPLAPGTQIMINGTRFIVPPQGLGAGSHVLLISTNPKYGAPLVLNSGQGIQSTPIDNSAQKITLASNNSLSGQPLQHPLRSPTKFINSFGNASSIPTVHTSPQLINTTAKVPVPPPVPTVSLTSVIKSPATLLAKTSLVSAICPSNPPLPSSTSVFHLDPPVKKLLVSPEGAILNTINTPASKVSSLSPSLSQITVNDLPVGRSVDETLRLVQAFQFTDKHGEVCPAGWKPGSDTIKPDVQKSKEYFSKQK

SEQ ID NO: 2439 - protein, 201 aa, Homo sapiens [sequence omitted]

SEQ ID NO: 2440 - protein, 334 aa, Homo sapiens
MKEDKSSIREAISKAKSTANIKTEQEGEASEKSLHLSPQHITHQTMPIGQRGSEQGKRVENINGTSYPSLQQKTNAVKKLHKCDECGKSFKYNSRLVQHKIMHTGEKRYECDDCGGTFRSSSSLRVHKRIHTGEKPYKCEECGKAYMSYSSLINHKSTHSGEKNCKCDECGKSFNYSSVLDQHKRIHTGEKPYECGECGKAFRNSSGLRVHKRIHTGEKPYECDICGKTFSNSSGLRVHKRIHTGEKPYECDECGKAFITCRTLLNHKSIHFGDKPYKCDECEKSFNYSSLLIQHKVIHTGEKPYVCDRCGKAFRNSSGLTVHKRIHTVSDELP

SEQ ID NO: 2441 - protein, 297 aa, Homo sapiens
MYISPPKDWWDAGDPSLPIRTPAMIGCSFVVNRKFFGEIGLLDPGMDVYGGENIELGIKVWLCGGSMEVLPCSRVAHIERKKKPYNSNIGFYTKRNALRVAEVWMDDYKSHVYIAWNLPLENPGIDIGDVSERRALRKSLKCKNFQWYLDHVYPEMRRYNNTVAYGELRNNKAKDVCLDQGPLENHTAILYPCHGWGPQLARYTKEGFLHLGALGTTTLLPDTRCLVDNSKSRLPQLLDCDKVKSSLYKRWNFIQNGAIMNKGTGRCLEVENRGLAGIDLILRSCTGQRWTIKNSIK

SEQ ID NO: 2442 - protein, 219 aa, Homo sapiens [sequence omitted]

SEQ ID NO: 2443 - protein, 859 aa, Homo sapiens
MTSKQAMSSNEQERLLCYNGEVLVFQLSKGNFADKEPTKTPILHVRRMVFDRGTKVFVQKSTGFFTIKEENSHLKIMCCNCVSDFRTGINLPYIVIEKNKKNNVFEYFLLILHSTNKFEMRLSFKLGYEMKDGLRVLNGPLILWRHVKAFFFISSQTGKVVSVSGNFSSIQWAGEIENLGMVLLGLKECCLSEEECTQEPSKSDYAIWNTKFCVYSLESQEVLSDIYIIPPAYSSVVTYVHICATEIIKNQLRISLIALTRKNQLISFQNGTPKNVCQLPFGDPCAVQLMDSGGGNLFFVVSFISNNACAVWKESFQVAAKWEKLSLVLIDDFIGSGTEQVLLLFKDSLNSDCLTSFKITDLGKINYSSEPSDCNEDDLFEDKQENRYLVVPPLETGLKVCFSSFRELRQHLLLKEKIISKSYKALINLVQGKDDNTSSAEEKECLVPLCGEEENSVHILDEKLSDNFQDSEQLVEKIWYRVIDDSLVVGVKTTSSLKLSLNDVTLSLLMDQAHDSRFRLLKCQNRVIKLSTNPFPAPYLMPCEIGLEAKRVTLTPDSKKEESFVCEHPSKKECVQIITAVTSLSPLLTFSKFCCTVLLQIMERESGNCPKDRYVVCGRVFLSLEDLSTGKYLLTFPKKKPIEHMEDLFALLAAFHKSCFQITSPGYALNSMKVWLLEHMKCEIIKEFPEVYFCERPGSFYGTLFTWKQRTPFEGILIIYSRNQTVMFQCLHNLIRILPINCFLKNLKSGSENFLIDNMAFTLEKELVTLSSLSSAIAKHESNFMQRCEVSKGKSSVVAAALSDRRENIHPYRKELQREKKKMLQTNLKVSGALYREITLKVAEVQLKSDFAAQKLSNL

SEQ ID NO: 2444 - protein, 893 aa, Homo sapiens [sequence omitted]

SEQ ID NO: 2445 - protein, 747 aa, Homo sapiens
MEPSPSPAPQAQPPKPVPKPRTVFGGLSGPATTQRPGLSPALGGPGVSRSPEPSPRPPPLPTSSSEQSSALNTVEMMPNSIYFGLDSRGRAQAAQDKAPDSSQISAPTPALRPTTGTVHIMDPGCLYYGVQPVGTPGAPHRRESRGVCQGRAEHRLSRQDLEAREDAGYASLELPGDSTLLSPTLETEETSDDLISPYASFSFTADRLTPLLSGWLDKLSPQGNYVFQRRFVQFNGRSLMYFGSDKDPFPKGVIPLTAIEMTRSSKDNKFQVITGQRVFVFRTESEAQRDMWCSTLQSCLKEQRLLGHPRPPQPPRPLRTGMLELRGHKAKVFAALSPGELALYKSEQAFSLGIGICFIELQGCSVRETKSRSFDLLTPHRCFSFTAESGGARQSWAAALQEAVTETLSDYEVAEKIWSNRANRQCADCGSSRPDWAAVNLGVVICKQCAGQHRALGSGISKVQSLKLDTSVWSNEIVQLFIVLGNDRANRFWAGTLPPGEGLHPDATPGPRGEFISRKYRLGLFRKPHPQYPDHSQLLQALCAAVARPNLLKNMTQLLCVEAFEDPSPGVYNEVVVRATYSGFLYCSPVSNKAGPSPPRRGRDAPPRLWCVLGAALEMFASENSPEPLSLIQPQDIVCLGVSPPPTDPGDRFPFSFELILAGGRIQHFGTDGADSLEAWTSAVGKWFSPLSCHQLLGPGLLRLGRLWLRSPSHTAPAPGLWLSGFGLLRGDHLFLCSAPGPGPPSP

SEQ ID NO: 2446 - protein, 979 aa, Homo sapiens [sequence omitted]

SEQ ID NO: 2447 - protein, 509 aa, Homo sapiens
MRTFSFASTASRSCPPSPWPLGLKGPEVSFCLSLQIPSMMKMRSSWPWQNSWEPSLPWWEAQSTCTACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 2448 - protein, 351 aa, Homo sapiens
MVQCSQLSTGEPMIALTTIFQKYLREYAWKILSGNLPKTTTSSGGLTISSLLKEKEGSEVAKFTLEELYLICNILSTAEYCLATTQQLEEKLKEKVDVSLIERINLTGEMDTFSTVISSSIQLLVQDLDAACDPALTATSKMQWQNVEHVGDQSPYVTSVILHIKQNVPIIRDNLASTRKYFTQFCVKFANSFIPKFITHLFKCKPISMVGAEQLLLDTHSLKMVLLDLPSISSQVVRKAPASYTKIVVKGMTRAEMILKVVMAPHEPLVVFVDNYIKLLTDCNTETFQKILDMKGLKRSEQSSMLELLRQRLPAPPSGAESSGSLSLTAPTPEQESSRIRKLEKLIKKRL

SEQ ID NO: 2449 - protein, 636 aa, Homo sapiens
MMKEVLSTGQGNTEVIHTGTLQRHESHHIGDFCFQEIEKEIHDIEFQCQEDERNGLEAPMTKIKKLTGSTDQHDHRHAGNKPIKDQLGSSFYSHLPELHIFQIKGEIGNQLEKSTNDAPSVSTFQRISCRPQTQISNNYGNNPLNSSLLPQKQEVHMREKSFQCNKSGKAFNCSSLLRKHQIPHLGDKQYKCDVCGKLFNHEQYLACHDRCHTVEKPYKCKECGKTFSQESSLTCHRRLHTGVKRYNCNECGKIFGQNSALLIDKAIDTGENPYKCNECDKAFNQQSQLSHHRIHTGEKPYKCEECDKVFSRKSTIETHKRIHTGEKPYRCKVCDTAFTWHSQLARHRRIHTAKKTYKCNECGKTFSHKSSLVCHHRLHGGEKSYKCKVCDKAFVWSSQLAKHTRIDCGEKPYKCNECGKTFGQNSDLLIHKSIHTGEQPYKCDECEKVFSRKSSLETHKIGHTGEKPYKCKVCDKAFACHSYLAKHTRIHSGEKPYKCNECSKTFSHRSYLVCHHRVHSGEKPYKCNECSKTFSRRSSLHCHRRLHSGEKPYKCNECGNTFRHCSSLIYHRRLHTGEKSYKCTICDKAFVRNSLLSRHTRIHTAEKPYKCNECGKAFNQQSHLSRHHRIHTGEKP

SEQ ID NO: 2450 - protein, 390 aa, Homo sapiens
MDLLLPEERLPAAVAVELRRFRLQGRATEADSRLEVKDMKDRYYQLPIPRENVHLLASWEDLTRHEGALLQCHQVVGVDVEWTPVFVAGGRPRPSLLQVAVEGHVFLLDVLVLSQPPTGQGAQAFSRLVAQLLSDPSITKLGYGMVGDLQKLGTSCPALAHVEKQILGGMDLLLVHRQMRVASMPAPAVDRARELRGLSLLVQQVLGTALDKTQQLSNWDRRPLCEEQVIYAAADAYCLLEVHQALCREPARFHLSEDLAGSRRPRHRERPGARKPPGLQKASAPAAPRQVPVAVAVSEGAAPQIPARAFRVVCDNMLQGLARSLRCLGVDARMLGNGEDHRRAAEVFCSKLLVNSVFLGLALQIVQLYFHPHLFSAASRIVCLCLSRMF

SEQ ID NO: 2451 - protein, 851 aa, Homo sapiens
MQVSAEMPLILTDHPGRTGRPTLPGKVTEEIVSSEHDEGLSFSGKVQCYGRELNQPAKCTGDFSPSPEKLVKSGNPLQPVSIENRNLDLKHLVLESSEPPFGPRNVIENKSLSDTLVSTTAPSGIVNVSVKQQTSPKSSQNHLFPGDLKTDEGIYLQVKSLTAASVDGAYSTQGCMCSVVPTLCSSSDNATLTHYVRPINAEPAFQAQEIPAGRMASLLKNGEPEAELHKETTGPGTAGPQSNTTSSLKGERKAIHTLQDVSTCETKELLNVGVSSLCAGPYQNTADTKENLSKEPLASFVSESFDTSVCGIATEHVEIENSGEGLRAEAGSETLGRDGEVGVNSDMHYELSGDSDLDLLGDCRNPRLDLEDSYTLRGSYTRKKDVPTDGYESSLNFHNNNQEDWGCSSWVPGMETSLPPGHWTAAVKKEEKCVPPYVQIRDLHGILRTYANFSITKELKDTMRTSHGLRRHPSFSANCGLPSSWTSTWQVADDLTQNTLDLEYLRFAHKLKQTIKNGDSQHSASSANVFPKESPTQISIGAFPSTKISEAPFLHPAPRSRSPLLVTVVESDPRPQGQPRRGYTASSLDSSSSWRERCSHYRDLRNSQRNHTVSFHLNKLKYNSTVKESRNDISLILNEYAEFNKVMKNSNQFIFQDKELNDVSGEATAQEMYLPFPGRSASYEDIIIDVCTNLHVKLRSVVKEACKSTFLFYLVETEDKSFFVRTKNLLRKGGHTEIEPQHFCQAFHRENDTLIIIIRNEDISSHLHQIPSLLKLKHFPSVIFAGVDSPGDVLDHTYQELFRAGGFVISDDKILEAVTLVQLKEIIKILEKLNGNGRWKWLLHYRENKKL

SEQ ID NO: 2452 - protein, 1344 aa, Homo sapiens [sequence omitted]

SEQ ID NO: 2453 - protein, 750 aa, Homo sapiens
MVTTQHREDVGIQTFNLPLTPRIENRKELRNQSSGLLDVGLRYRRSPRTAEGVLAARTVSISVQIIRACGLQAAAKALAEREPALQFSATVGVNASVTTHLSFLPQGEQRRTHPVACSFCPEFSHHVEFTCNLVTQHCSGEACFLAELLEFAEVIFAVYHENTKSASDIISIESCKEYLLGVVKVPTKELLIKRSGITGWYPIILPEDGGLPHGLELMQKIVGGLEHLGWSFENSLKDFVRMDEGEPATVTISTPRLWLPIHCVLLAGHNHIHKNTYCYLRYKFYDHEAFWTPLKKPKESVNKKQIMVTFKASKRAEVTRGPSLLWYFREERLEIQVWRAYGNDSVERPHQTDSWIGSAYVDLARLGERSARTLTVSGVYPLFGRNASNLSGAALRVHVVLSSLSSHLEPTHELDSMDCSSHSESEQLPRRNDEVQLSPPEVISCHQKSPASTQVPCSSTTAEVRLTQEGPADLDGTFAVSILVERAMHLSLKGSPLTERKVSIPSCCVSFATADESSPVYTQVVENTDSPIWNFQQQSRLSKELLLDPQQTLVFKVWHKGDEERVIGFASVDLSPLLSGFQFVCGWYNITDFSGECQGQIKVAVSPLESLIHFKEERQARRGVETSKSLIPIYSPFSFPASDTYAAFSSHMARQTLDQLAHASSKELDFSSPGRSDTTRSQASRHEEHVQNIRRFHESLHLQGEAPLPCDDKLTTSPLSSQTPEAWRRGDCLMWYRGSQWRASGFGKKK

SEQ ID NO: 2454 - protein, 403 aa, Homo sapiens [sequence omitted]

SEQ ID NO: 2455 - protein, 316 aa, Homo sapiens
MFPVLKISVTGLDPNAMYSLLLDFVPTDSHRWKYVNGEWVPAGKPEVSSHSCVYIHPDSPNFGAHWMKAPISFSKVKLTNKLNGGGQIMLNSLHKYEPQVHIVRVGSAHRMVTNCSFPETQFIAVTAYQNEEITALKIKYNPFAKAFLDAKERNHLRDVPEAISESQHVTYSHLNLIESSSNNLQVFSGPDSWTSLSSTPHASILSVPHTNGPINPGPSPYPCLWTISNGAGGPSGPGPEVHASTPGAFLLGNPAVTSPPSVLSTQAPTSAGVEVLGEPSLTSIAVSTWTAVASHPFAGWGGPGAGGHHSPSSLDG

SEQ ID NO: 2456 - protein, 706 aa, Homo sapiens [sequence omitted]

SEQ ID NO: 2457 - protein, 105 aa, Homo sapiens [sequence omitted]

SEQ ID NO: 2458 - protein, 311 aa, Homo sapiens [sequence omitted]

SEQ ID NO: 2459 - protein, 192 aa, Homo sapiens
MHELSVSCAKHRSVVYSSNVSTNRLDTTQMAMIRYTLTSTSAASRTSTPAKARDGTFLAWLLSASDATTVTVAVSASSQWSFTSTSRRWRVAFASSRVLVVLISPVQSPTWNGCCQLTDAAVATTRRHSWSPPCAPSPPSGLHPLNTAPAHSQRRQPTQGASSADKVVVPALIPGSVTLLLRGGMPASRALT

SEQ ID NO: 2460 - protein, 903 aa, Homo sapiens
MTRSCSAVGCSTRDTVLSRERGLSFHQFPTDTIQRSKWIRAVNRVDPRSKKIWIPGPGAILCSKHFQESDFESYGIRRKLKKGAVPSVSLYKIPQGVHLKGKARQKILKQPLPDNSQEVATEDHNYSLKTPLTIGAEKLAEVQQMLQVSKKRLISVKNYRMIKKRKGLRLIDALVEEKLLSEETECLLRAQFSDFKWELYNWRETDEYSAEMKQFACTLYLCSSKVYDYVRKILKLPHSSILRTWLSKCQPSPGFNSNIFSFLQRRVENGDQLYQYCSLLIKSIPLKQQLQWDPSSHSLQGFMDFGLGKLDADETPLASETVLLMAVGIFGHWRTPLGYFFVNRASGYLQAQLLRLTIGKLSDIGITVLAVTSDATAHSVQMAKALGIHIDGDDMKCTFQHPSSSSQQIAYFFDSCHLLRLIRNAFQNFQSIQFINGIAHWQHLVELVALEEQELSNMERIPSTLANLKNHVLKVNSATQLFSESVASALEYLLSLDLPPFQNCIGTIHFLRLINNLFDIFNSRNCYGKGLKGPLLPETYSKINHVLIEAKTIFVTLSDTSNNQIIKGKQKLGFLGFLLNAESLKWLYQNYVFPKVMPFPYLLTYKFSHDHLELFLKMLRQVLVTSSSPTCMAFQKAYYNLETRYKFQDEVFLSKVSIFDISIARRKDLALWTVQRQYGVSVTKTVFHEEGICQDWSHCSLSEALLDLSDHRRNLICYAGYVANKLSALLTCEDCITALYASDLKASKIGSLLFVKKKNGLHFPSESLCRVINICERVVRTHSRMAIFELVSKQRELYLQQKILCELSGHIDLFVDVNKHLFDGEVCAINHFVKLLKDIIICFLNIRAKNVAQNPLKHHSERTDMKTLSRKHWSPVQDYKCSSFANTSSKFRHLLSNDGYPFK

SEQ ID NO: 2461 - protein, 890 aa, Homo sapiens
MERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKDPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQEEGNSILPERRGRPEISLDERGEGGHVHTSDDSEVVFSSCDLNLTMEDSDGVTYALKCDSSGHAPEIVSTVHEDYSGSSESSNDESDSKDTDSDDSSIPRNRLQSVVVVPKNSTLPIEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKKL

SEQ ID NO: 2462 - protein, 126 aa, Homo sapiens
MGSLSVTQAGVQWYDHSITAHCSLHLLGSSDTPTSASQLAGTTGAPHPTRLIFVSFFVEMDFAQAGLKLLGSSNLPTSASQSAKITGTSHHTRLCSLFFRGSHSVTRVGVQWCHHCSLQPGTPPRL

SEQ ID NO: 2463 - protein, 152 aa, Homo sapiens
MWEPLGLSHHLAVVFTVVPSSVKTHRATSHILYPRWSPGSASQLHHLCLSAGRQLCWGLLKQPLSVLPFFSHCSHVKISTRFEDTKFLPRIIGEWNIWLEIDEFLFLKNDNKGWTRWLMPVIPGLWEVEAGGSLEARSSRPAWPTWRKLVCA

SEQ ID NO: 2464 - protein, 133 aa, Homo sapiens
MGGGPVAPGAGHAATPPFTSASVARSSAWGKEGRLIGGISMSWNDLLKNNIEFPSLPLFSTRASSLCKGNHSDLFTSFLPNCPLLCALLSQSLYKPPPLFLVPQRSQSPSDTINVPQVAKSLFIFIFSFFFFF

SEQ ID NO: 2465 - protein, 158 aa, Homo sapiens
MEKGLRRTQQCGSATAGNHETETARWRQPDTKLGTQTPRFPPWPHPWAKSNSEPSSSSISFNPHRGCLLFTAVEVRVGVGGMLFSCRLSSWDEETSSLLGLAGPAKQMHTLTTAQGLRQVCSLSKTCPGFSKGKSIRKRMENLYSFILLPSNGHSPMY

SEQ ID NO: 2466 - protein, 104 aa, Homo sapiens [sequence omitted]

SEQ ID NO: 2467 - protein, 321 aa, Homo sapiens
MSARKSSDASACSSSEISVKEFLAKAKEDFLKKWENPTQNNAGLEDFERKKTLGTGSFGRVMLVKHKATEQYYAMKILDKQKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 2468 - protein, 428 aa, Homo sapiens
MARLCRRVPCTLLLGLAVVLLKARLVPAAARAELSRSDLSLIQQQQQQQQQQQQQQQKQLEEAEEERTEVPGATSTLTVPVSVFMLKVQVNDIISRQYLSQAVVEVFVNYTKTNSTVTKSNGAVLIKVPYKLGLSLTIIAYKDGYVLTPLPWKTRRMPIYSSVTLSLFPQSQANIWLFEDTVLITGKLADAKSQPSVQFSKALIKLPDNHHISNVTGYLTVLQQFLKVDNFLHTTGITLNKPGFENIELTPLAAICVKIYSGGKELKVNGSIQVSLPLLRLNDISAGDRIPAWTFDMNTGAWVNHGRGMVKEHNNHLIWTYDAPHLGYWIAAPLPGTRGSGINEDSKDITAYHTVFLTAILGGTIVIVIGFFAVLLCYCRDKCGTPQKRERNITKLEVLKRDQTTSTTHINHIRNRRKSFHGKNSGRF

SEQ ID NO: 2469 - protein, 694 aa, Homo sapiens [sequence omitted]

SEQ ID NO: 2470 - protein, 137 aa, Homo sapiens
MSRYGRYGGETKVYVGNLGTGAGKGELERAFSYYGPLRTVWIARNPPRFAFVEFEDPRDAEDAVRGLDGKVICGSRVRVELSTGMPRRSRFDRPPARRPFDPNDRCYECGEKGHYAYDCHRYSRRRRSRFLRLSQSP

SEQ ID NO: 2471 - protein, 132 aa, Homo sapiens [sequence omitted]

SEQ ID NO: 2472 - protein, 619 aa, Homo sapiens
MLILPPLLKDSVAAPLLSAYYPDCVGMSPSCTSTNRAAATGNASPGKLEHSKAALSVHVPGMNRYFQPFYQPNECGKALCVRPDVMELDELYEFPEYSRDPTMYLALRNLILALWYTNCKEALTPQKCIPHIIVRGLVRIRCVQEVERILYFMTRKGLINTGVLSVGADQYLLPKDYHNKSVIIIGAGPAGLAAARQLHNFGIKVTVLEAKDRIGGRVWDDKSFKGVTVGRGAQIVNGCINNPVALMCEQLGISMHKFGERCDLIQEGGRITDPTIDKRMDFHFNALLDVVSEWRKDKTQLQDVPLGEKIEEIYKAFIKESGIQFSELEGQVLQFHLSNLEYACGSNLHQVSARSWDHNEFFAQFAGDHTLLTPGYSVIIEKLAEGLDIQLKSPVQCIDYSGDEVQVTTTDGTGYSAQKVLVTVPLALLQKGAIQFNPPLSEKKMKAINSLGAGIIEKIALQFPYRFWDSKVQGADFFGHVPPSASKRGLFAVFYDMDPQKKHSVLMSVIAGEAVASVRTLDDKQVLQQCMATLRELFKEQEVPDPTKYFVTRWSTDPWIQMAYSFVKTGGSGEAYDIIAEDIQGTVFFAGEATNRHFPQTVTGAYLSGVREASKIAAF

SEQ ID NO: 2473 - protein, 992 aa, Homo sapiens
MQRFGAFYMDYLYTVENTSGKGSTNQQDFSSGKSEDLGTVQEKSTKSLVIGPLDFRLDSSAVHRILKMIVCALEHEYEPYSRLKSDIKNENETILNPEEVALLEEYIPTRHTSVTLLKCTCTISMAEFNLLDHLLPVIMGEKNSSNFMNTTNFQSLRPLPSIRILVDKINLEHSVPMYAEQLVHVVSSLTQPSDNLLHYCYVHCYLKIFGFQAGLTSLDCSGSYCLPVPVIPSFSTALYGKLLKLPTCWTKRSQIAITEGIFELPNLTIQATRAQTLLLQAIYQSWSHLGNVSSSAVIEALINEIFLSIGVKSKNPLPTLEGSIQNVELKYCSTSLVKCASGTMGSIKICAKAPVDSGKEKLIPLLQGPSDTKDLHSTKWLNESRKPESLLAPDLMAFTIQVPQYIDYCHNSGAVLLCSIQGLAVNIDPILYTWLIYQPQKRTSRHMQQPVVAVPLVMPVCRRKEDEVSIGSAPLAKQQSYQASEYASSPVKTKTVTESRPLSVPVKAMLNISESCRSPEERMKEFIGIVWNAVKHLTLQLEVQSCCVFIPNDSLPSPSTIVSGDIPGTVRSWYHGQTSMPGTLVLCLPQIKIISAGHKYMEPLQEIPFVIPRPILEEGDAFPWTISLHNFSIYTLLGKQVTLCLVEPMGCTSTLAVTSQKLLATGPDTRHSFVVCLHVDLESLEIKCSNPQVQLFYELTDIMNKVWNKIQKRGNLNLSPTSPETMAGPVPTSPVRSSIGTAPPDTSTCSPSADIGTTTEGDSIQAGEESPFSDSVTLEQTTSNIGGTSGRVSLWMQWVLPKITIKLFAPDPENKGTEVCMVSELEDLSASIDVQDVYTKVKCKIESFNIDHYRSSLGEECWSLGQCGGVFLSCTDKLNRRTLLVRPISKQDPFSNCSGFFPSTTTKLLDGTHQQHGFLSLTYTKAVTKNVRHKLTSRNERRSFHKLSEGLMDGSPHFLHEILLSAQAFDIVLYFPLLNAIASIFQAKLPKT

SEQ ID NO: 2474 - protein, 897 aa, Homo sapiens [sequence omitted]

SEQ ID NO: 2475 - protein, 1098 aa, Homo sapiens
MSEIQGTVEFSVELHEFYNVDLFQRGYYQIRVTLKVSSRIPHRLSASIAGQTESSSLHSACVHDSTVHSRVFQILYRNEEVPINDAVVFRVHLLLGGERMEDALSEVDFQLKVDLHFTDSEQQLRDVAGAPMVSSRTLGLHFHPRNGLHHQVPVMFDYFHLSVISVTVHAALVALQQPLISFTRPGRGSWLGKGGPDTGQEQSIISLENLVFGAGYCKPTSSEGSFYITSENCMQHAHKWHRDLCLLLLHAYRGLRLHFLVIMRDIPELPHTELEALAVEETLSQLCSELQMLNNPEKIAEQISKDLAWLTSHMMTLWTQFLDTVTLHSQVTTYLTQEHHTLRVRRFSEAFFYMEHQKLAVLTFQENLIQTHSQLSLDIRNSEYLTSMPPLPAECLDIDGDWNTLPVIFEDRYVDCPATGHNLSVYPNFDVPVTSPTIMNLKDKEDNCMVNSNLSFREDLVLSTIKPSQMDSDEEVVRCPELGENVATQNHMDMCSESQVYISIGEFQNKAGVPEDECWTGQTSDAGTYPVADVDTSRRSPGPEDGQAPVLTYIDVKSSNKNPSRAEPLVAFNAQHESRSSRDKYGLDRTGLSKVVVGGSHQNAISSDKTTLHELSTLGKGIDQEGKMVLLSLKLTPSEPCDPLSSTLREPLDIRSSLKDSHTEEQEELSVLSGVIKRSSSIISDSGIESEPSSVAWSEARSRALELPSDREVLHPFVRRHALHRNSLEGGHTESNTSLPSGIQASLTSISSLPFEEDEREVALTKLTKSVSAPHISSPEEAAEDADTKQQDGGFAEPSDMHSKSQGSPGSCSQLCGDSGTDAGADHPLVEIVLDADNQQGPGYIDIPKGKGKQFDAQGHCLPDGRTENTPGVETKGLNLKIPRVIALENPRTRSLHRALEETPKGMPKDLNVGQQALSNSGISEVEGLSQHQVPELSCTSAADAINRNSTGQQSQSGSPCIMDDTAFNRGVNAFPEAKHKAGTVCPTVTHSVHSQVLKNQELKAGTSIMGSHLTSAETFTLDSLKAVEVVNLSVSCTATCLPFSSVPKETPARAGFSSKQTLFPITHQPLGSFGVVSTHSSTLDEEVSERMFSFYQA

SEQ ID NO: 2476 - protein, 742 aa, Homo sapiens
MDDDDDSCLLDLIGDPQALNYFLHGPSNKSSNDDLTNAGYSAANSNSIFANSSNADPKSSLKGVSNQLGEGPSDGLPLSSSLQFLEDELESSPLPDLTEDQPFDILQKSLQEANITEQTLAEEAYLDASIGSSQQFAQAQLHPSSSASFTQASNVSNYSGQTLQPIGVTHVPVGASFASNTVGVQHGFMQHVGISVPSQHLSNSSQISGSGQIQLIGSFGNHPSMMTINNLDGSQIILKGSGQQAPSNVSGGLLVHRQTPNGNSLFGNSSSSPVAQPVTVPFNSTNFQTSLPVHNIIIQRGLAPNSNKVPINIQPKPIQMGQQNTYNVNNLGIQQHHVQQGISFASASSPQGSVVGPHMSVNIVNQQNTRKPVTSQAVSSTGGSIVIHSPMGQPHAPQSQFLIPTSLSVSSNSVHHVQTINGQLLQTQPSQLISGQVASEHVMLNRNSSNMLRTNQPYTGPMLNNQNTAVHLVSGQTFAASGSPVIANHASPQLVGGQMPLQQASPTVLHLSPGQSSVSQGRPGFATMPSVTSMSGPSRFPAVSSASTAHPSLGSAVQSGSSGSNFTGDQLTQPNRTPVPVSVSHRLPVSSSKSTSTFSNTPGTGTQQQFFCQAQKKCLNQTSPISAPKTTDGLRQAQIPGLLSTTLPGQELPQFVPVLPTPRDALLTFLPHSARKLSGLISSPLRLFLSFCILSANNILCCINSKIALGRARWLTPVMPALWEAKESGSPEIRSSRPARPT

SEQ ID NO: 2477 - protein, 184 aa, Homo sapiens
MIHCEATHCGKILSHKQSLIHYVNVETGEKTYVCVECGKSFLKKSQIIIHQRIHTGEKPYDCGACGKAFSEKSHLIAHQRTHTGEKPYDCSECGKGFSQKSSLIIHQRVHSGEKPYECSECEKAFSQKSPLIIHQRIHTGEKPYECRVWESLFPESQLIIHHRAHTGEKPCKCTECGKAFCFIH

SEQ ID NO: 2478 - protein, 312 aa, Homo sapiens
MNLHIDEQVHRPLDTVSGLLNLSLLYHVWLCGVFLLTTWYVSWILFKIYATEAHVFPVQPPFAEGSDECLPKVLNSNPPPIIKYLALQDLMLLSQYSPSRRQEVFSLSQPGGHPHNWTAISRECLNLLNGMTEFSNPSPSTSISAEGKTMRQPSVIYSWIQNKREQIKNFLSKRVLIMYFFSKHPEASIQAVFSDAQMHIWALEGLSHLVAASFTEDRFGVVQTTLPAILNTLLTLQEAVDKYFKLPHASSKPPRISGSLVDTSYKTLRFAFRASLKTAIYRITTTFGEHLNAVQASAEHQKRLQQFLEFKE

SEQ ID NO: 2479 - protein, 105 aa, Homo sapiens
MAATSSWAACSLSSASLSLRPNSPKAMPACCRMGSWPRSSLSSPTRALCCAPTLFLRTGGYPATGLYTHPRLLQCKNVHKPSPGVFYTLPETLQLQSLHEMKKTF

SEQ ID NO: 2480 - protein, 139 aa, Homo sapiens
MMEAFAQRYCLCNPGVFQSTDTCYVLSFAVIMLNTSLHNPNVRDKPGLERFVAMNRGINEGGDLPEELLRNLYDSIRNEPFKIPEDDGNDLTHTFFNPDREGWLLKLGTCPPDPAGPSAGGHLWAWALDSASAHTCCLN

SEQ ID NO: 2481 - protein, 765 aa, Homo sapiens
MCVVQKPEEQYKVMLQVNGKELSKLSQEQTLQALRSSKEPLVIQVLRRSPRLRGDSSCHDLQLVDSGTQTDITFEHIMALGKLRPPTPPMVILEPPPISHEYYDPAEFMEGGPQEADRLDELEYEEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQPGNEEEKGAPDAGPGLSNSQELDSGVGRTDESTRNEESSEHDLLGDEPPSSTNTPGSLRKFGLQGDALQSRDFHFSMDSLLAEGAGLGGGDVPGLTDEEYERYRELLEIKCHLENGNQLDLLFPRASGGNSALDVNRNESLGHEMAMLEEELRHLEFKCRNILRAQKMQQLRERCMKAWLLEEESLYDLAASEPKKHELSDISELPEKSDKDSTSAYNTGESCRSTPLLVEPLPESPLRRAMAGNSNLNRTPPGPAVATPAKAAPPPGSPAKFRSLSRDPEAGRRQHAEERGRRNPKTGLTLERVGPESSPYLSRRHRGQGQEGEHYHSCVQLAPTRGLEELGHGPLSLAGGPRVGGVAAAATEAPRMEWKVKVRSDGTRYVAKRPVRDRLLKARALKIREERSGMTTDDDAVSEMKMGRYWSKEERKQHLIRAREQRKRREFMMQSRLECLREQQNGDSKPELNIIALSHRKTMKKRNKKILDNWITIQEMLAHGARSADGKRVYNPLLSVTTV

SEQ ID NO: 2482 - protein, 417 aa, Homo sapiens
MSGRSRGRKSSRAKNRGKGRAKARVRPAPDDAPRDPDPSQYQSLGEDTQAAQVQAGAGWGGLEAAASAQLLRLGEEAACRLPLDCGLALRARAAGDHGQAAARPGPGKAASLSERLAADTVFVGTAGTVGRPKNAPRVGNRRGPAGKKAPETCSTAGRGPQVIAGGRQKKGAAGENTSVSAGEEKKEERDAGSGPPATEGSMDTLENVQLKLENMNAQADRAYLRLSRKFGQLRLQHLERRNHLIQNIPGFWGQAFQNHPQLASFLNSQEKEVLSYLNSLEVEELGLARLGYKIKFYFDRNPYFQNKVLIKEYGCGPSGQVVSRSTPIQWLPGHDLQSLSQGNPENNRSFFGWFSNHSSIESDKIVEIINEELWPNPLQFYLLSEGARVEKGKEKEGRQGPGKQPMETTQPGVSQSN

SEQ ID NO: 2483 - protein, 228 aa, Homo sapiens
MPTSEYVGSRTDLTQPASRPFHNSWPTPVATSTSLAPMVSNFRLAPSHHSPRPASDSRLVFVTQHPTNSGPSCALADPGYRPTSLDPVARLAIMDKVSRTISEDSGSRSAPVYQDPRPISPDSGSSPAPVPGQSPWTQMPGLSQQTQTLCSFQNLASPCRHRLNARLRAMLAPVDPCSVQHLLLTGSVPALIEIGFTFIPTYPMKRSTPVDPGFRPNSTDPGNRPTIC

SEQ ID NO: 2484 - protein, 204 aa, Homo sapiens
MSVPGKTHRAIADHLFWSEETKSRFTEYSMTSSVMRRNEQLTLHDERFEKFYEQYDDDEIGALDNAELEGSIQVDSNRLQEVLNDYYKEKAENCVKLNTLEPLEDQDLPMNELDESEEEEMITVVLEEAKEKWDCESICSTYSNLYNHPQLIKYQPKPKQIRISSKTGIPLNVLPKKGLTAKQTERIQMINGSDLPKVSTQPRS

SEQ ID NO: 2485 - protein, 287 aa, Homo sapiens [sequence omitted]

SEQ ID NO: 2486 - protein, 228 aa, Homo sapiens [sequence omitted]

SEQ ID NO: 2487 - protein, 723 aa, Homo sapiens
MEPRSMEYFCAQVQQKDVGGRLQVGQELLLYLGAPGAISDLEEDLGRLGKTVDALTGWVGSSNYRVSLMGLEILSAFVDRLSTRFKSYVAMVIVALIDRMGDAKDKVRDEAQTLILKLMDQVAPPMYIWEQLASGFKHKNFRSREGVCLCLIETLNIFGAQPLVISKLIPHLCILFGDSNSQVRDAAILAIVEIYRHVGEKVRMDLYKRGIPPARLEMIFAKFDEVQSSGGMILSVCKDKSFDDEESVDGNRPSSAASAFKVPAPKTSGNPANSARKPGSAGGPKVGGASKEGGAGAVDEDDFIKAFTDVPSIQIYSSRELEETLNKIREILSDDKHDWDQRANALKKIRSLLVAGAAQYDCFFQHLRLLDGALKLSAKDLRSQVVREACITVAHLSTVLGNKFDHGAEAIVPTLFNLVPNSAKVMATSGCAAIRFIIRHTHVPRLIPLITSNCTSKSVPVRRRSFEFLDLLLQEWQTHSLERHAAVLVETIKKGIHDADAEARVEARKTYMGLRNHFPGEAETLYNSLEPSYQKSLQTYLNSSGSVASLPQSDRSSSSSQESLNRPFSSKWSTANPSTVAGRVSAGSSKASSLPGSLQRSRSDIDVNAAAGAKAHHAAGQSVRSGRLGAGALNAGSYASLEDTSDKLDGTASEDGRVRAKLSAPLAGMGNAKADSRGRSRTKMVSQSQPGSRSGSPGRVLTTTALSTVSSGVQRVLVNSASA

SEQ ID NO: 2488 - protein, 250 aa, Homo sapiens
MSAAASPASERGWKSEKLDEAQALARSCAARRPDFQPCDGLSICATHSHGKCFKLHWCCHLGWCHCKYMYQPMTPVEQLPSTEIPARPREPTNTIQISVSLTEHFLKFASVFQPPLPPDSPRYCMISDLFIDNYQVKCINGKMCYVQKQPAPHSHRMSPEEVSAHDALISKESNTPKIDHCSSPSSSEDSGINAIGAHYVESCDEDAEEGAELSSEEDYSPESSWEPDECTLLSPSQSDLEVIETIETTV

SEQ ID NO: 2489 - protein, 202 aa, Homo sapiens
MVLAGVGVEHEHLVDCARKYLLGVQPAWGSAEAVDIDRSVAQYTGGIAKLERDMSNVSLGPTPIPELTHIMVGLESCSFLEEDFIPFAVLNMMMGGGGSFSAGGPGKGMFSRLYLNVLNRHHWMYNATSYHHSYEDTGLLCIHASADPRQVREMVEIITKEFILMGGTVDTVSAVWRHFQAYLWCLTGDSHVVGVATCGPGP

SEQ ID NO: 2490 - protein, 122 aa, Homo sapiens [sequence omitted]

SEQ ID NO: 2491 - protein, 170 aa, Homo sapiens [sequence omitted]

SEQ ID NO: 2492 - protein, 244 aa, Homo sapiens
MNVARVLIEKHTLHVIIDFILERNLTSVMNVARFLIEKHTLHIIIDFILEINLTSVMNVARFLIKKHTLHVTIDFILERNLTSVMNVARFLIKKQTLHVIIDFILERNLTSLMSVAKLLIEKQSLHIIIQFILERNKCNECGKTFCHNSVLVIHKNSYWRETSVMNVAKFLINKHTFHVIIDFIVERNLRNVKHVTKFTVANRASKDRRIHTGEKAYKGEEYHRVFSHKSNLERHKINHTAEKP

SEQ ID NO: 2493 - protein, 112 aa, Homo sapiens [sequence omitted]

SEQ ID NO: 2494 - protein, 419 aa, Homo sapiens
MSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 2495 - protein, 638 aa, Homo sapiens [sequence omitted]

SEQ ID NO: 2496 - protein, 815 aa, Homo sapiens
MATQVEPLLPGGATLLQAEEHGGLVRKKPPPAPEGKGEPGPNDVRGGEPDGSARRPRPPCAKPHKEGTGQQERESPRPLQLPGAEGPAISDGEEGGGEPGAGGGAAGAAGAGRRDFVEAPPPKVNPWTKNALPPVLTTVNGQSPPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMP

SEQ ID NO: 2497 - protein, 619 aa, Homo sapiens
MGGEKFDSTHPEGYLFGENSDLNFLGNRPVVFPYAAPPPQEPVKTLRSLVNIRKDTLRLVKCAEEVKSPGEEASKAKVHYNVEFTFDTDARVAITIYYQATEEFQNGIASYIPKDNSLQSETVQYKRGVCQQFCLPSHTVDPSEWAEEELGFDLDREVYPLVVHAVVDEGDEYFGHCHVLLGTFEKHTDGTFCVKPLKQKQVVDGVSYLLQEIYGIENKYNTQDSKVAEDEVSDNSAECVVCLSDVRDTLILPCRHLCLCNTCADTLRYQANNCPICRLPFRALLQIRAMRKKLGPLSPTSFNPIISSQTSDSEEHPSSENIPPGYEVVSLLEALNGPLTPSPAVPPLHVLGDGHLSGMLPSYGSDGHLPPVRTISPLDRLSDSSSQGLKLKKSLSKSTSQNSSVLHEEEDEHSCSESETQLSQRPSVQHLGEECGVTPESENLTLSSSGAIDQSSCTGTPLSSTISSPEGPASSSLAQSVMSMASSQISTDTVSSMSGSYIAPGTEEEGEALSSPQPASRAPSEEGEGNDVIEEEDGSPTQEGQRTCAFLGMECDNNNDFDIASVKALDNKLCSEVCLPGAWQADDNAVSRNAQRRRLSSSSLEDSETRPCVWGPLAV

SEQ ID NO: 2498 - protein, 161 aa, Homo sapiens [sequence omitted]

SEQ ID NO: 2499 - protein, 113 aa, Homo sapiens
MVNPKTGRGSLSTQASGAAGWRRMGPPPSAQGPSASTWEAPLHPPVGPTPPTCRPHTTYLEAPHHPPRGPTIMALASSTERDLLLRNRCLMPPSALSPELTSRGPNLDSSHSI

SEQ ID NO: 2500 - protein, 350 aa, Homo sapiens
MASALFTADSQAMVKIEDMAVSLILEEWGCQNLARRNLSRDNRQENYGSAFPQGGENRNENEESTSKAETSEDSASRGETTGRSQKEFGEKRDQEGKTGERQQKNPEEKTRKEKRDSGPAIGKDKKTITGERGPREKGKGLGRSFSLSSNFTTPEEVPTGTKSHRCDECGKCFTRSSSLIRHKIIHTGEKPYECSECGKAFSLNSNLVLHQRIHTGEKPHECNECGKAFSHSSNLILHQRIHSGEKPYECNECGKAFSQSSDLTKHQRIHTGEKPYECSECGKAFNRNSYLILHRRIHTREKPYKCTKCGKAFTRSSTLTLHHRIHARERASEYSPASLDAFGAFLKSCV

SEQ ID NO: 2501 - protein, 241 aa, Homo sapiens
MNYRHRVLLNIQLKTLCNFRRKTASSRSILPDLLSPYQMAIRAKRLEESRAAALRELQEKQALMEQQRREKRALQEWRERAQRMRKRKEELSKLLPPRRSMVASKIPSATDLIDNRKVPLNPPGKMKPSKEKSPQASKEMSALQERNLEEKIKQHVLQMREQRRFHGQAPLEEMRKAAEDLEIATELQDEVLKLKLGLTLNKDRRRAALTGNLSLGLPAAQPQNTFFNTKYGESGNVRRYQ

SEQ ID NO: 2502 - protein, 655 aa, Homo sapiens
MCIHQLNLLATNPNLPITSVLGKQHPIEAHHLSSICDIMEKAMVNGDTCIIRCILVVFQVVFKFFFSPQTERNRDIIRRSGLLLWQLLMAPKDQICPEIQKEVCLAISSGLNILYPGETEINNLLKLVLTEGERNSGLSQLRDVILTNLAEQLQNNRFGSDEDDHYRLNDELLHYILKIVVRESCILITKCQTVSKDDFQKLLSTVPAASSCLRYLMAVQNHLLSNTILIKPDENDDSDSSLQGETLKVQELKVSILALATQILTGCDEVLEMLQQVTTALINSDIADREQRLKGLEQVTKATMLGHLLPVLLTSLMHPNLQTLIMADALMPQLVQLVLYTSQTALLLKTQCPVFAEVGCSPCGAPDQKCRLFPDERMLEEKEEPGFLTGLKIPAPWAAGKTVETVHPVRDNYKFKETVHIPGARCLYLRFDSRCSSQYDYDKLVICAGPNTNSRKVAEYGGNTLGYGSRSVLGTGWPKDLVKVEGDTVTFSFEMRSGREHNTPDKAMWGFACTVRAQESSEDVSGGLPFLVDLALGLSVLACSMLRILYNGPEITKEEEACQELLRSKLLQRCQWQVEANGVISPALTPSPSPLPLTIEEDREFTYPSDVLVPPVGNYFDLPRIRLPPGIMIKLREISGRARPQFRPSIKYVAV

SEQ ID NO: 2503 - protein, 378 aa, Homo sapiens [sequence omitted]

SEQ ID NO: 2504 - protein, 321 aa, Homo sapiens
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSSPLSDVNLSHNQLREVSVSAFTTHSQGRALHVDLSHNLIHRLVPHPTRAGLPAPTIQSLNLAWNRLHAVPNLRDLPLRYLSLDGNPLAVIGPGAFAGLGGLTHLSLASLQRLPELAPSGFRELPGLQVLDLSGNPKLNWAGAEVFSGLSSLQELDLSGTNLVPLPEALLLHLPALQSVSVGQDVRCRRLVREGTYPRRPGSSPKVALHCVDTRESAARGPTIL

SEQ ID NO: 2505 - protein, 756 aa, Homo sapiens
MLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQAQDPIKLFEPSLQPPVMQQQP

SEQ ID NO: 2506 - protein, 1104 aa, Homo sapiens [sequence omitted]

SEQ ID NO: 2507 - protein, 751 aa, Homo sapiens [sequence omitted]

SEQ ID NO: 2508 - protein, 327 aa, Homo sapiens
MAPSTAVSVVSDSIKVQPLLISADNKVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANEDPCWKNEITHDEHCAACKRGANLQPCGTCPGAYHLSCLEPPLKTAPKGVWVCPRCQQKALKKDEGVPWTGMLAIVHSYVTHKTVKEEEKQKLLQRGSELQNEHQQLEERDRRLASAVQKCLELKTSLLARQRGTQSSLDRLRALLRLIQGEQLLQVTMTTTSPAPLLAGPWTKPSVAATHPTVQHPQGHN

SEQ ID NO: 2509 - protein, 1026 aa, Homo sapiens [sequence omitted]

SEQ ID NO: 2510 - protein, 115 aa, Homo sapiens [sequence omitted]

SEQ ID NO: 2511 - protein, 112 aa, Homo sapiens [sequence omitted]

SEQ ID NO: 2512 - protein, 763 aa, Homo sapiens
MAAVDLEKLRASGAGKAIGVLTSGGDAQGMNAAVRAVTRMGIYVGAKVFLIYEGYEGLVEGGENIKQANWLSVSNIIQLGGTIIGSARCKAFTTNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDLAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVEAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 2513 - protein, 1073 aa, Homo sapiens
MESNLSRGDQILEVNSVNVRHAALSKVHAILSKCPPGPVRLVIGRHPNPKVSEQEMDEVIARSTYQESKEANSSPGLGTPLKSPSLAKKDSLISESELSQYFAHDVPGPLSDFMVAGSEDEDHPGSGCSTSEEGSLPPSTSTHKEPGKPRANSLVTLGSHRASGLFHKQVTVARQASLPGSPQALQNPLLRQRKVGCYDANDASDEEEFDREGDCISLPGALLGPIRPLSEDDPRRVSISSSKGMDVHNQEERPRKTLVSKAISAPLLGSSVDLEESIPEGMVDAASYAANLTDSAEAPKGSPGSWWKKELSGSSSAPKLEYTVRTDTQSPTNTGSPSSPQQKSEGLGSRHRPVARVSPHCKRSEAEAKPSGSQTVNLTGRANDPCDLDSRVQATSVKVTVAGFQPGGAVEKESLGKLTTGDACVSTSCELASALSHLDASHLTENLPKAASELGQQPMTELDSSSDLISSPGKKGAAHPDPSKTSVDTGQVSRPENPSQPASPRVTKCKARSPVRLPHEGSPSPGEKAAAPPDYSKTRSASETSTPHNTRRVAALRGAGPGAEGMTPAGAVLPGDPLTSQEQRQGAPGNHSKALEMTGIHAPESSQEPSLLEGADSVSSRAPQASLSMLPSTDNTKEACGHVSGHCCPGGSRESPVTDIDSFIKELDASAARSPSSQTGDSGSQEGSAQGHPPAGAGGGSSCRAEPVPGGQTSSPRRAWAAGAPAYPQWASQPSVLDSINPDKHFTVNKNFLSNYSRNFSSFHEDSTSLSGLGDSTEPSLSSMYGDAEDSSSDPESLTEAPRASARDGWSPPRSRVSLHKEDPSESEEEQIEICSTRGCPNPPSSPAHLPTQAAICPASAKVLSLKYSTPRESVASPREKAACLPGSYTSGPDSSQPSSLLEMSSQEHETHADISTSQNHRPSCAEETTEVTSASSAMENSPLSKVARHFHSPPIILSSPNMVNGLEHDLLDDETLNQYETSINAAASLSSFSVDVPKNGESVLENLHISESQDLDDLLQKPKMIARRPIMAWFKEINKHNQGTHLRSKTEKEQPLMPARSPDSKIQMVSSS

SEQ ID NO: 2514 - protein, 212 aa, Homo sapiens
MALPDAAYQQCAQAVKCTWAAIPEEGVPVQSFLHMQGSQEPYVQFLTRSQEAVKRQIPHTTAAEMLTLTLAFEDANADCKHALALVRCIKNLGSFLRACQDVGTELHHFAILAQAVANLAVDKSKRSQGSNPKVGKCYNCEKPGHFKKECRQISVQKGPYNAVPHPVEKMPGLCPCVTEEITGLISAAQNFIRMAPPCWEMRWGPGPRPHKQ

SEQ ID NO: 2515 - protein, 824 aa, Homo sapiens [sequence omitted]

SEQ ID NO: 2516 - protein, 101 aa, Homo sapiens [sequence omitted]

SEQ ID NO: 2517 - protein, 261 aa, Homo sapiens
MAATAREDGASGQERGQRGCEHYDRGCLLKAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSRQNCPICLEDIHTSRVVAHVLPCGHLLHRTCYEEMLKEGYRCPLCMHSALDMTRYWRQLDDEVAQTPMPSEYQNMTVDILCNDCNGRSTVQFHILGMKCKICESYNTAQAGGRRISLDQQ

SEQ ID NO: 2518 - protein, 101 aa, Homo sapiens [sequence omitted]

SEQ ID NO: 2519 - protein, 124 aa, Homo sapiens [sequence omitted]

SEQ ID NO: 2520 - protein, 208 aa, Homo sapiens
MVHGHPPLNLRVHRDSKILQEVCVLSNISLNHCASLPLSPCLLPLPSCSLLPVSSLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPS

SEQ ID NO: 2521 - protein, 151 aa, Homo sapiens [sequence omitted]

SEQ ID NO: 2522 - protein, 1141 aa, Homo sapiens
MGDAKEAGAEGPPAGAAARGGLSLLSQGESEESSAQGSALFLGGNEVKSRAVVKYSSAPPRTAFARLEEKTDLKLPPANWLRESAKLGPAGTTILGNSKKSKPFSSFGMAYDFIDSVGNDVDVVSDSENIKKLLKIPYSKSHVSMAVHRIGRTLLLDELDIQELFMRSSQTGDWTWLKEFYQRLIDQKWQRKKKSKEHWYQKAILSKFLYYSINGDGAAQPVSSTAEQQESSSSDQTNDSEGASWPAPFEMPSSVSEDPSASSQGLKNDFVRNILWTFEDIHMLVGSNMPIFGGGRYPAVSLRLRDNNKPINVLTGIDYWLDNLICNVPELVMCFHVNGIVQKYEMIKTEEIPNLENSNFSTKVIKDIAQNILSFLKSNCTKEGHTYWLFKASGSDIVKLYDLTTLCEETEDKYQNPFTMPVAILLYKVACNMMMKKNQNKKHYGTIRTLLLNCLKLLDKSRHPQIIASANYMLSELFQLDEPKKEENSESPLNENSDESYSEEEEEMPDSDENGSYSTSSDPSDDSKAVAIIKSVGELSVPEKYKSIHQIRPSCAFPVCHDTEERCRLVLSYVLEGLKSVDSSIKKESDLPAADPSTPIPLKYEDESSRGGPEGLEKQMALFLDKMGSLQKGNYSSQSGMIPGSWQHKMKLQLILKSSKAYYVLSDAAMSLQKYGRALRYIKLALQSHDTYCCLCTNMLSEVLLFLSQYLTLCGDIQLMLAQNANNRAAHLEEFHYQTKEDQEILHSLHRESSCQGFAWATDLSTDLESQLSVSCKCYEAANEILQFSDLKSQNPEHYVQVLKRMGNIRNEIGVFYMNQAAALQSERLVSKSVSAAEQQLWKKSFSCFEKGIHNFESIEDATNAALLLCNTGRLMRICAQAHCGAGDELKREFSPEEGLYYNKAIDYYLKALRSLGTRDIHPAVWDSVNWELSTTYFTMATLQQDYAPLSRKAQEQIEKEVSEAMMKSLKYCDVDSVSARQPLCQYRAATIHHRLASMYHSCLRNQVGDEHLRKQHRVLADLHYSKAAKLFQLLKDAPCELLRVQLERVAFAEFQMTSQNSNVGKLKTLSGALDIMVRTEHAFQLIQKELIEEFGQPKSGDAAAAADASPSLNREEVMKLLSIFESRLSFLLLQSIKLLS

SEQ ID NO: 2523 - protein, 239 aa, Homo sapiens [sequence omitted]

SEQ ID NO: 2524 - protein, 181 aa, Homo sapiens
MADPTILVYKWFLLIYKLSYAFGVVGYLAIMFTMCGFNLFFKIKARDSMDFGIVSLFYGLYYGVMGRDFAEICSDYMASTIGFYSVSRLPTRSLSDNICAVCGQKIIVELDEEGLIENTYQLSCNHVYPFQRKLFGLHQASFFPPSPPPPPVPISSILLTFHAQTPVLYPPAQSSLPVCPC

SEQ ID NO: 2525 - protein, 357 aa, Homo sapiens
MEQSIHETIPLVSQNIMCPTKLVKSAFKTAQETSTMTMNVSQVDDVVSSKTRTRGQRIQNVNVKSAQQGASADVATPKMPGQSVRKKTRKAKEISEASENIYSDVRGLSQNQQIPQNSVTPRRGRRKKEVNQDILENTSSVEQELQITTGRESKRLKSSQLLEPAVEETTKKEVKVSSVTKRTPRRIKRSVENQESVEIINDLKVSTVTSPSRMIRKLRSTNLDASENTGNKQDDKSSDKQLRIKHVRRVRGREVSPSDVREDSNLESSQLTVQAEFDMSAIPRKRGRPRKINPSEDVGSKAVKEERSPKKKEAPSIRRRSTRNTPAKSENVDVGKPALGKSILVPNEELSMVMSSK

SEQ ID NO: 2526 - protein, 140 aa, Homo sapiens [sequence omitted]

SEQ ID NO: 2527 - protein, 102 aa, Homo sapiens [sequence omitted]

SEQ ID NO: 2528 - protein, 119 aa, Homo sapiens [sequence omitted]

SEQ ID NO: 2529 - protein, 657 aa, Homo sapiens
MLREIRDIPGTLNGLYLWLCQRLFVRKQFAKVQPILNVILAACRHLTITELYHAVWTKNMSLTLEDFQRKLDILSKLLVDGLGNTKILFHYSFAEWLLDVKHCTQKYLCNAAEGHRMLAMSYTCQAKNLTPLEAQEFALHLINSNLQLETAELALWMIWNGTPVRDSLSTLIPKEQEVLQLLVKAGAHVNSEDDRTSCIVRQALEREDSIRTLLDNGASVNQCDSNGRTLLANAAYSGSLDVVNLLVSRGADLEIEDAHGHTPLTLAARQGHTKVVNCLIGCGANINHTDQDGWTALRSAAWGGHTEVVSALLYAGVKVDCADADSRTALRAAAWGGHEDIVLNLLQHGAEVNKADNEGRTALIAAAYMGHREIVEHLLDHGAEVNHEDVDGRTALSVAALCVPASKGHASVVSLLIDRGAEVDHCDKDGMTPLLVAAYEGHVDVVDLLLEGGADVDHTENNGRTPLLAAASMGHASVVNTLLFWGAAVDSIDSEGRTVLSIASAQGNVEVVRTLLDRGLDENHREDAGWTPLHMAAFEGHRLICEALIEQGARTNEIDNDGRIPFILASQEGHYDCVQILLENKSNIDQRGYDGRNALRVAALEGHRDIVELLFSHGADVNCKDADGRPTLYILALENQLTMAEYFFRKWCKRRSK

SEQ ID NO: 2530 - protein, 555 aa, Homo sapiens
MAIEGGERTCGVHELICIRKVSPEAVGFLSAVGVFIILMLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPNTYVKLTLLNSMGQEMSKCKTSIRRGQPNPVYKETFVFQVALFQLSDVTLILSVYNKRSMKREEMIGWISLGLNSSGEEELNHWTEMKESKGQQVCRWHALLES

SEQ ID NO: 2531 - protein, 120 aa, Homo sapiens
MLRIFSHVSRPLGFLLRKLSLFQEESYFRNPADRGTAHQTTICCLNNFFPYQLDSFWYPVFELSLRTSHLKSYGLLEDPPLSKGKSRLICLKGYDIYGIGLLVSSQRSGQKLLIAHATLS

SEQ ID NO: 2532 - protein, 869 aa, Homo sapiens
MAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGFYNSRSLDVAKAPAASSTLDAAHIAAAIFLPLVAMVLLVGGVYFYFSRLQGKSSLQLPRPRPRPYNRITIESAFDNPTYETGSLSFAGDERI

SEQ ID NO: 2533 - protein, 770 aa, Homo sapiens [sequence omitted]

SEQ ID NO: 2534 - protein, 384 aa, Homo sapiens [sequence omitted]

SEQ ID NO: 2535 - protein, 277 aa, Homo sapiens
MWTSRTVREWWPLSRTRARSPLQMNTMGTSMSSPPSGNGPPCDRCGVRGEQWRIGLCYLQSPDLSPRYLKAVPDVVSCGSRAVPRKLRTKARDHTPEVLVRSCLVPCEKTKTIREGVLAIINYVSKVGSRPWVPQVPIQFHQQRLGHGLIISCPGARPEHAVAWDKDRQHLYRTQYLKGVNRSMRVFIDHGNQLHIRFTQLDDRGIYYCWRQGVLVAGFRLGVTSHGHYPASFSDPETRSAVELTLIGYLLITAVFVTIHFCRCCCYLFHCCPSFSP

SEQ ID NO: 2536 - protein, 270 aa, Homo sapiens
MMRTFGHGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQPGYIRDLITARILEAHQNVAQMSLIEAKMRFIQAWQSLPEFGITHFIARFQGGEKEELIGIAYNRLIRMDASTGDAIKTWRFSNMKQWNVNWEIKMVTVEFADEVRLSFICTEVDCKVVHEFIGGYIFLSTRAKDQNESLDEEMFYKLTSGWV

SEQ ID NO: 2537 - protein, 191 aa, Homo sapiens
MIQQLVAAQLQCNKRSFSDQPKVTLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 2538 - protein, 165 aa, Homo sapiens
MDENSWFNKCKRVKQKYQLTLEQKGYLEELLRLRENQLSESVSQNKILLQRIEDSDLAHKLEKEQLEYIIVELQDQLKSYQSLDQLSAEVSLSQTSLDPGQSQEGDGKQDTLNVMSEGKEDTPSLLGLCGSLTSVASYKSLTSLKSNDYLASPTTEMTSPGLTPS

SEQ ID NO: 2539 - protein, 160 aa, Homo sapiens [sequence omitted]

SEQ ID NO: 2540 - protein, 179 aa, Homo sapiens
MFDFLDEQADKHGIHDPHVRHTWKSNCLPLRFWVNMIKNPQFVFDIHKNSITDACLSVVAQTFMDSCSTSEHRLGKDSPSNKLLYAKDIPSYRNWVERYYSDIGKMPAISDQDMNAYLAEQSRMHMNEFNTMSALSEIFSYVGKYSEEILGPLDHDDQCGKQKLAYKLEQVITLMSLDS

SEQ ID NO: 2541 - protein, 596 aa, Homo sapiens
MLFPAAFIGLFVFLYGVTTLDHSQVSKEVCQATDIIMCPVCDKYCPFMRLSDSCVYAKVTHLFDNGATVFFAVFMAVWATVFLEFWKRRRAVIAYDWDLIDWEEEEEEIRPQFEAKYSKKERMNPISGKPEPYQAFTDKCSRLIVSASGIFFMICVVIAAVFGIVIYRVVTVSTFAAFKWALIRNNSQVATTGTAVCINFCIIMLLNVLYEKVALLLTNLEQPRTESEWENSFTLKMFLFQFVNLNSSTFYIAFFLGRFTGHPGAYLRLINRWRLEECHPSGCLIDLCMQMGIIMVLKQTWNNFMELGYPLIQNWWTRRKVRQEHGPERKISFPQWEKDYNLQPMNAYGLFDEYLEMILQFGFTTIFVAAFPLAPLLALLNNIIEIRLDAYKFVTQWRRPLASRAKDIGIWYGILEGIGILSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 2542 - protein, 124 aa, Homo sapiens
MALIFAPTRGCTQERNPTLVVNVGRVSDMAQVSLVIRECTLARSHTDATCVGRAIVRAHIFKVIRGSTLVRNPINVRSVGRALAATPVFMFIKESTLERSPIRVVCVGKASVIPQVCGTTKECI

SEQ ID NO: 2543 - protein, 113 aa, Homo sapiens
MESVKCCVKLAAAESHGRRNGRRAADEAEPASPAPVLLLPFPSGRLELQTIKAGRGPWTSPGQPLHPTDKKPQSDLGDKWPWHRDSSRPHPGAVAGPCLSLQLACLSYFLFRL

SEQ ID NO: 2544 - protein, 276 aa, Homo sapiens
MIGIAFTGSGKTLVFTLPVIMFCLEQEKRLPFSKREGPYGLIICPSRELARQTHGILEYYCRLLQEDSSPLLRCALCIGGMSVKEQMETIRHGVHMMVATPGRLMDLLQKKMVSLDICRYLALDEADRMIDMGFEGDIRTIFSYFKGQRQTLLFSATMPKKIQNFAKSALVKPVTINVGRAGAASLDVIQEVEYVKEEAKMVYLLECLQKTPPPVLIFAEKKADVDAIHEYLLLKGVEAVAIHGGKGQGGASTGLDPAARSQAEGAARAAGAALRG

SEQ ID NO: 2545 - protein, 766 aa, Homo sapiens
MHCEYPKELYSCSLDGTIKLWDYIDGILIKTFIVGCKLHALFTLAQAEDSVFVIVNKEKPDIFQLVSVKLPKSSSQEVEAKELSFVLDYINQSPKCIAFGNEGVYVAAVREFYLSVYFFKKKTTSRFTLSSSRNKKHAKNNFTCVACHPTEDCIASGHMDGKIRLWRNFYDDKKYTYTCLHWHHDMVMDLAFSVTGTSLLSGGRESVLVEWRDATEKNKEFLPRLGATIEHISVSPAGDLFCTSHSDNKIIIIHRNLEASAVIQGLVKDRSIFTGLMIDPRTKALVLNGKPGHLQFYSLQSDKQLYNLDIIQQEYINDYGLIQIELTKAAFGCFGNWLATVEQRQEKETELELQMKLWMYNKKTQGFILNTKINMPHEDCITALCFCNAEKSEQPTLVTASKDGYFKVWILTDDSDIYKKAVGWTCDFVGSYHKYQATNCCFSEDGSLLAVSFEEIVTIWDSVTWELKCTFCQRAGKIRHLCFGRLTCSKYLLGATENGILCCWNLLSCALEWNAKLNVRVMEPDPNSENIAAISQSSVGSDLFVFKPSEPRPLYIQKGISREKVQWGVFVPRDVPESFTSEAYQWLNRSQFYFLTKSQSLLTFSTKSPEEKLTPTSKQLLAEESLPTTPFYFILGKHRQQQDEKLNETLENELVQLPLTENIPAISELLHTPAHVLPSAAFLCSMFVNSLLLSKETKSAKEIPEDVDMEEEKESEDSDEENDFTEKVQDTSNTGLGEDIIHQLSKSEEKELRKFRKIDYSWIAAL

SEQ ID NO: 2546 - protein, 818 aa, Homo sapiens
MATDGASCEPDLSRAPEDAAGAAAEAAKKEFDVDTLSKSELRMLLSVMEGELEARDLVIEALRARRKEVFIQERYGRFNLNDPFLALQRDYEAGAGDKEKKPVCTNPLSILEAVMAHCKKMQERMSAQLAAAESRQKKLEMEKLQLQALEQEHKKLAARLEEERGKNKQVVLMLVKECKQLSGKVIEEAQKLEDVMAKLEEEKKKTNELEEELSAEKRRSTEMEAQMEKQLSEFDTEREQLRAKLNREEAHTTDLKEEIDKMRKMIEQLKRGSDSKPSLSLPRKTKDRRLVSISVGTEGTVTRSVACQTDLVTENADHMKKLPLTMPVKPSTGSPLVSANAKGSVCTSATMARPGIDRQASYGDLIGASVPAFPPPSANKIEENGPSTGSTPDPTSSTPPLPSNAAPPTAQTPGIAPQNSQAPPMHSLHSPCANTSLHPGLNPRIQAARFRFQGNANDPDQNGNTTQSPPSRDVSPTSRDNLVAKQLARNTVTQALSRFTSPQAGAPSRPGVPPTGDVGTHPPVGRTSLKTHGVARVDRGNPPPIPPKKPGLSQTPSPPHPQLKVIIDSSRASNTGAKVDNKTVASTPSSLPQGNRVINEENLPKSSSPQLPPKPSIDLTVAPAGCAVSALATSQVGAWPAATPGLNQPACSDSSLVIPTTIAFCSSINPVSASSCRPGASDSLLVTASGWSPSLTPLLMSGGPAPLAGRPTLLQQAAAQGNVTLLSMLLNEEGLDINYSCEDGHSALYSAAKNGHTDCVRLLLSAEAQVNAADKNGFTPLCAAAAQGHFECVELLISYDANINHAADGGQTPLYLAC

SEQ ID NO: 2547 - protein, 623 aa, Homo sapiens [sequence omitted]

SEQ ID NO: 2548 - protein, 498 aa, Homo sapiens
MSYSSLINHKSTHSGEKNCKCDECGKSFNYSSVLDQHKRIHTGEKPYECGECGKAFRNSSGLRVHKRIHTGEKPYECDICGKTFSNSSGLRVHKRIHTGEKPYECDECGKAFITRRTLLNHKSIHFGDKPYKCDECGKAFRNNSGLKVHKRIHTGERPYKCEECGKAYISLSSLINHKSVHPGEKPFKCDECEKAFITYRTLTNHKKVHLGEKPYKCDVCEKSFNYTSLLSQHRRVHTREKPYECDRCEKVFRNNSSLKVHKRIHTGERPYECDVCGKAYISHSSLINHKSTHPGKTPHTCDECGKAFFSSRTLISHKRVHLGEKPFKCVECGKSFSYSSLLSQHKRIHTGEKPYVCDRCGKAFRNSSGLTVHKRIHTGEKPYECDECGKAYISHSSLINHKSVHQGKQPYNCECGKSFNYRSVLDQHKRIHTGKKPYRCNECGKAFNIRSNLTKHKRTHTGEESLNVIYVGSYSGTSQKRTYEGGNALDGGRMRMPL

SEQ ID NO: 2549 - protein, 793 aa, Homo sapiens
MMLRRLKDDVEKNLAPKQETIIEVELTNIQKKYYRAILEKNFSFLTKGANQHNMPNLINTMMELRKCCNHPYLINGAEEKILEDFRKTHSPDAPDFQLQAMIQAAGKLVLIDKLLPKLIAGGHKVLIFSQMVRCLDILEDYLIQRRYTYERIDGRVRGNLRQAAIDRFCKPDSDRFVFLLCTRAGGLGINLTAADTCIIFDSDWNPQNDLQAQARCHRIGQSKAVKVYRLITRNSYEREMFDKASLKLGLDKAVLQDINRKGGTNGVQQLSKMEVEDLLRKGAYGALMDEEDEGSKFCEEDIDQILQRRTHTITIQSEGKGSTFAKASFVASGNRTDISLDDPNFWQKWAKIAELDTEAKNEKESLVIDRPRVRKQTKHYNSFEEDELMEFSELDSDSDERPTRSRRLNDKARRYLRAECFRVVKNLLIFGWGRWKDILTHGRFKWHLNEKDMEMICRALLVYCVKHYKGDEKIKSFIWELITPTKDGQAQTLQNHSGLSAPVPRGRKGKKTKNQLLIPELKDADWLATCNPEVVLHDDGYKKHLKQHCNKVLLRVRMLYYLKAEILGEAAEKAFEGSPARELDVPLPDIDYMEIPVDWWDAEADKSLLIGVFKHGYERYNAMRADPAPCFLEKVGMPDEKSLSAEQGVTDGTSDIPERGNTDKEDNAEDKVDGLQKQTESSSDGGDGVFSEKKDDSRAAQDGSDPDKSPWPVSSALTARLRRLVTVYQRCNRKELCRPEILGPGNQGYWVQEEMFRRTSEMDLINKEAQKRWTRREQADFYRTVSSFGVVYD

SEQ ID NO: 2550 - protein, 163 aa, Homo sapiens
MKISGNAMLQLGPFLYWTFLAAFEGTVFFFGTYFLFQTASLEENGKVYGNWTFGTIVFTVLVFTVTLKLALDTRFWTWINHFVIWGSLAFYVFFSFFWGGIIWPFLKQQRMYFVFAQMLSSVSTWLAIILLIFISLFPEILLIVLKNVRRRSARVHHLISSSA

SEQ ID NO: 2551 - protein, 121 aa, Homo sapiens [sequence omitted]

SEQ ID NO: 2552 - protein, 977 aa, Homo sapiens
MRHEIKKGRKKIQKEKSHSYRTDNCSDSDSSLNQSYKFCQGKLQLILDQLDPGQPKEVRYEALQTLCSAPPSDVLNCENWTTLCEKLTVSLSDPDPVFSDRILKFCAQTFLLSPLHMTKEIYTSLAKYLESYFLSRENHIPTLSAGVDITNPNMTRLLKKVRLLNEYQKEAPSFWIRHPEKYMEEIVESTLSLLTVKHNQSHVVSQKILDPIYFFALVDTKAVWFKKWMHAHYSRTTVLRLLEKKYKSLVTTAIQQCVQYFEMCKTRKADETLGHSKHCRNKQKTFYYLGQELQYIYFIHSLCLLGRLLIYKQGRKLFPIKLKNKKGLVSLIDLLVLFTQLIYYSPSCPKMTSAAHSENYSPASMVTEVLWILSDQKECAVECLYNNIVIETLLQPIHNLMKGNEASPNCSETALIHIAGILARIASVEEGLILLLYGANMNSSEESPTGAHIIAQFSKKLLDEDISIFSGSEMLPVVKGAFISVCRHIYSTCEGLQVLITYNLHESIAKAWKKTSLLSERIPTPVEGSDSVSSVSQESQNIMAWEDNLLDDLLHFAATPKGLLLLQRTGAINECVTFIFNRYAKKLQVSRHKKFGYGVLVTRVASTAAGGIALKKSGFINELITELWSNLEYGRDDVRVTHPRTTPVDPIDRSCQKSFLALVNLLSYPAIYELVRNQDLPNKTEYSLREVPTCVIDIIDRLIILNSEAKIRSLFNYEQSHIFGLRDFIIDGLSVERNHVLVRINLVGGPLERILPPRLLEKSDNPYPWPMFSSHPLPNCYLSDITRNAGIKQDNDLDKLLLCLKISDKQTEWIENCQRQFCKMMKAKPDIISGEALIELLEKFVLHLTESPSECYFPSVEYTATDANVKNESLSSVQQLGIKMTVRYGKFLSLLKDGAENDLTWVLKHCERFLKQQQTSIKSSLLCLQGNYAGHDWFVSSLLTILKLAGCSDAPVVPATWEAEAGESLEPGRRRLQ

SEQ ID NO: 2553 - protein, 505 aa, Homo sapiens
MSFNCLEDVESTIPVSPLHLAAYNGHCEALKTLAETLVNLDVRDHKGRTALFLATERGSTECVEVLTAHGASALIKERKRKWTPLHAAAASGHTDSLHLLIDSGERADITDVMDVYGQTPLMLAIMNGHVDCVHLLLEKGSTADAADLRGRTALHRGAVTGCEDCLAALLDHDAFVLCRDFKGRTPIHLASACGHTAVLRTLLQAALSTDPLDAGVDYSGYSPMHWASYTGHEDCLELLLEHSPFSYLEGNPFTPLHCAVINNQDSTTEMLLGALGAKIVNSRDTKGRTPLHAAAFADNVSGLRMLLQHQAEVNATDHTGRTALMTAAENGQTAAVEFLLYRGKADLTVLDENKNTALHLACSKGHEKCALMILAETQDLGLINATNSALQMPLHIAARNGLASVVQALLSHGATVLAVDEEGHTPALACAPNKDVADCLALILSTMKPFPPKDAVSPFSFSLLKNCSIAAAKTVGGCGALPHGASCPYSQERPGAIGLDGCYSE

SEQ ID NO: 2554 - protein, 774 aa, Homo sapiens
MDTYIESHFAGALAYRDLIKVLKWYVDRITEAERQEHIQEVLKAQEYIFKYIVQSRRLFSLATGGQNEEEFRCCIQELLMSVRFFLSQESKGSGALSQSQAVFLSSFPAVYSELLKLFDVREVANLVQDTLGSLPTILHVDDSLQAIKLQCIGKTVESQLYTNPDSRYILLPVVLHHLHIHLQEQKDLIMCARILSNVFCLIKKNSSEKSVLEEIDVIVASLLDILLRTILEITSRPQPSSSAMRFQFQDVTGEFVACLLSLLRQMTDRHYQQLLDSFNTKEELRDFLLQIFTVFRILIRPEMFPKDWTVMRLVANNVIITTVLYLSDALRKNFLNENFDYKIWDSYFYLAVIFINQLCLQLEMFTPSKKKKVLEKYGDMRVTMGCEIFSMWQNLGEHKLHFIPALIGPFLEVTLIPQPDLRNVMIPIFHDMMDWEQRRSGNFKQVEAKLIDKLDSLMSEGEGDETYRELFNSIIPLFGPYPSLLKKIERETWRESGVSLIATVTRLMERLLDYRDCMKMGEVDGKKIGCTVSLLNFYKTELNKEEMYIRYIHKLYDLHLKAQNFTEAAYTLLLYDELLEWSDRPLREFLTYPMQTEWQRKEHLHLTIIQNFDRGKCWENGIILCRKIAEQYESYYDYRNLSKMRMMEASLYDKIMDQQRLEPEFFRVGFYGKKFPFFLRNKEFVCRGHDYERLEAFQQRMLNEFPHAIAMQHANQPDETIFQAEAQYLQIYAVTPIPESQEVLQREGVPDNIKSFYKVNHIWKFRYDRPFHKG

SEQ ID NO: 2555 - protein, 532 aa, Homo sapiens
MLNCGRTDLINQAIEALGPDGVNTMDDQGMTPLMYACAAGDEAMVQMLIDAGANLDIQVPSNSPRHPSIHPDSRHWTSLTFAVLHGHISVVQLLLDAGAHVEGSAVNGGEDSYAETPLQLASAAGNYELVSLLLSRGADPLLSMLEAHGMGSSLHEDMNCFSHSAAHGHRNVLRKLLTQPQQAKADVLSLEEILAEGVEESDASSQGSGSEGPVRLSRTRTKALQEAMYYSAEHGYVDITMELRALGVPWKLHIWIESLRTSFSQSRYSVVQSLLRDFSSIREEEYNEELVTEGLQLMFDILKTSKNDSVIQQLATIFTHCYGSSPIPSIPEIRKTLPARLDPHFLNNKEMSDVTFLVEGKLFYAHKVLLVTASNRFKTLMTNKSEQDGDSSKTIEISDMKYHIFQMMMQYLYYGGTESMEIPTTDILELLSAASLFQLDALQRHCEILCSQTLSMESAVNTYKYAKIHNAPELALFCEGFFLKHMKALLEQDAFRQLIYGRSSKVQGLDPLQDLQNTLAERVHSVYITSRV

SEQ ID NO: 2556 - protein, 145 aa, Homo sapiens [sequence omitted]

SEQ ID NO: 2557 - protein, 147 aa, Homo sapiens
MTPHMAGYPSETKLPGERSGSNICCSAIFAVLQLLLLIPRQTASGVDLQQTPTDLQMRILTVRRKTNKQQGHPHQNPICTSPSSKNKMIKPQKWGKNRAEKLKILKIRVPLPLQRNAAPRQQWNKAGWRVTLMSWEKKASDDQTSPS

SEQ ID NO: 2558 - protein, 181 aa, Homo sapiens
MVLGAGWGWAYQLHLLQALKRKPDLFLCERLDVKAVFQCAVLALKFPEAPTVKASCGFFTELLPRCGEVESVGKVVQEDGRMLLIAVLEAIGGQASRSLMDCFADILFALNKHCFSLLSMWIKEALQPPGFPSARLSPEQKDTFSQQILRERVNKRRVKEMVKEFTLLCRGLHGTDYTADY

SEQ ID NO: 2559 - protein, 109 aa, Homo sapiens [sequence omitted]

SEQ ID NO: 2560 - protein, 129 aa, Homo sapiens
MAKSLRSKWKRKMRAEKRKKNAPKEASRLKSILKLDGDVLMKDVQEIATVVVPKPKHCQEKMQCEVKDEKDDMKMETDIKRNKKTLLDQHGQYPIWMNQRQRKRLKAKREKRKGKSKAKAVKVAKGLAW

SEQ ID NO: 2561 - protein, 108 aa, Homo sapiens
MDHVENSAGEHGIPFNFSDLYGVRETSNAIFYSGSVNFILVLPIKQNCAFFFFLKTESCSVTQARVQWHDLSSLQSPPPGFKRFSCLSLPGCWGYRCVPPRLANFLYF

SEQ ID NO: 2562 - protein, 104 aa, Homo sapiens [sequence omitted]

SEQ ID NO: 2563 - protein, 417 aa, Homo sapiens
MSPGGKFDFDDGGCYVGGWEAGRAHGYGVCTGPGAQGEYSGCWAHGFESLGVFTGPGGHSYQGHWQQGKREGLGVERKSRWTYRGEWLGGLKGRSGVWESVSGLRYAGLWKDGFQDGYGTETYSDGGTYQGQWQAGKRHGYGVRQSVPYHQAALLRSPRRTSLDSGHSDPPTPPPPLPLPGDEGGSPASGSRGGFVLAGPGDADGASSRKRTPAAGGFFRRSLLLSGLRAGGRRSSLGSKRGSLRSEVSSEVGSTGPPGSEASGPPAAAPPALIEGSATEVYAGEWRADRRSGFGVSQRSNGLRYEGEWLGNRRHGYGRTTRPDGSREEGKYKRNRLVHGGRVRSLLPLALRRGKVKEKVDRAVEGARRAVSAARQRQEIAAARWASSSEAKAGLRGGGALGTRKAGVPKGGPRPKA

SEQ ID NO: 2564 - protein, 264 aa, Homo sapiens
MSQAVQTNGTQPLSKTWELSLYELQRTPQEAITDGLEIVVSPRSLHSELMCPICLDMLKNTMTTKECLHRFCADCIITALRSGLQRGKKQQIENGSGAEDNGDSSHCSNASTHSNQEAGPSNKRTKTSDDSGLELDNNNAAMAIDPVMDGASEIELVFRPHPTLMEKDDSAQTRYIKTSGNATVDHLSKYLAVRLALEELRSKGESNQMNLDTASEKQYTIYIATASGQFTVLNGSFSLELVSEKYWKVNKPMELYYAPTKEHK

SEQ ID NO: 2565 - protein, 129 aa, Homo sapiens
MGFYFLIFYYYGNIIVIYSFILFFPPFLFKLGQSPVFFMVFFFSFFPFFFFFFCDGVSLCCSVAQAGVQWCELGSLQPQPPGFKRFSCLSLPSSWDYSRAPPYPYNFCIFSRDRVMPCWPGWLRTPHLK

SEQ ID NO: 2566 - protein, 601 aa, Homo sapiens
MPRILKQCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQPPSSIGCRKKYIDGEKQAEPVVVLDPVSTHEPQTKDQVAEKDPTQHKEDEGEIQPENKEDSIENVRETDSSNC

SEQ ID NO: 2567 - protein, 176 aa, Homo sapiens
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIAVSMPCMSGSSPPVLVAKSCSQQAWAGRRYSSNAGGIPPAFLSPVSSILK

SEQ ID NO: 2568 - protein, 297 aa, Homo sapiens
MEEPTAVEGQVQLPSPHQGSLRKAVAAALALDGESTMGHRKKKRKESRPESIIIYRSDNEKTDEEPGESEGGDQPKEEEGDDFLDYPVDDDMWNLPLDSRYVTLTGTITRGKKKGQMVDIHVTLTEKELQELTKPKESSRETTPEGRMACQMGADRGPHVVLWTLICLPVVFILSFVVSFYYGTITWYNIFLVYNEERTFWHKISYCPCLVLFYPVLIMAMASSLGLYAAVVQLSWSWEAWWQAARDMEKGFCGWLCSKLGLEDCSPYSIVELLESDNISSTLSNKDPIQEVETSTV

SEQ ID NO: 2569 - protein, 577 aa, Homo sapiens
MAVGLCKAMSQGLVTFRDVALDFSQEEWEWLKPSQKDLYRDVMLENYRNLVWLDWESWCEIEELSPKWFIDEDEISQEMVMERLASHGLECSSFREAWKYKGEFELHQGNAERHFMQVTAVKEISTGKRDNEFSNSGRSIPLKSVFLTQQKVPTIQQVHKFDIYDKLFPQNSVIIEYKRLHAEKESLIGNECEEFNQSTYLSKDIGIPPGEKPYESHDFSKLLSFHSLFTQHQTTHFGKLPHGYDECGDAFSCYSFFTQPQRIHSGEKPYACNDCGKAFSHDFFLSEHQRTHIGEKPYECKECNKAFRQSAHLAQHQRIHTGEKPFACNECGKAFSRYAFLVEHQRIHTGEKPYECKECNKAFRQSAHLNQHQRIHTGEKPYECNQCGKAFSRRIALTLHQRIHTGEKPFKCSECGKTFGYRSHLNQHQRIHTGEKPYECIKCGKFFRTDSQLNRHHRIHTGERPFECSKCGKAFSDALVLIHHKRSHAGEKPYECNKCGKAFSCGSYLNQHQRIHTGEKPYECSECGKAFHQILSLRLHQRIHAGEKPYKCNECGNNFSCVSALRRHQRIHNRETL

SEQ ID NO: 2570 - protein, 357 aa, Homo sapiens
MKCGLAFIRKAHLITHQIIHTGEKPYKCGHCGKLFTSKSQLHVHKRIHTGEKPYVCNKCGKAFTNRSNLITHQKTHTGEKSYICSKCGKAFTQRSDLITHQRIHTGEKPYECNTCGKAFTQKSNLNIHQKIHTGERQYECHECGKAFNQKSILIVHQKIHTGEKPYVCTECGRAFIRKSNFITHQRIHTGEKPYECSDCGKSFTSKSQLLVHQPVHTGEKPYVCAECGKAFSGRSNLSKHQKTHTGEKPYICSECGKTFRQKSELITHHRIHTGEKPYECSDCGKSFTKKSQLQVHQRIHTGEKPYVCAECGKAFSNRSNLNKHQTTHTGDKPYKCGICGKGFVQKSVFSVHQSSHA

SEQ ID NO: 2571 - protein, 213 aa, Homo sapiens
MCLSLQYLTVDRNRLWYVPRHLCQLPSLNELSMAGNRLAFLPLDLGRSRELQYVYVDNNIHLKGLPSYLYNKVIGCSGCGAPIQVSEVKLLSFSSGQRTVFLPAEVKAIGTEHDHVLPLQELAMRGLYHTYHSLLKDLNFLSPISLPRSLLELLHCPLGHCHRCSEPMFTIVYPKLFPLRETPMAGLHQWKTTVSFVAYCCSTQCLQTFDLLS

SEQ ID NO: 2572 - protein, 723 aa, Homo sapiens
MPLFFRKRKPSEEARKRLEYQMCLAKEAGADDILDISKCELSEIPFGAFATCKVLQKKVLIVHTNHLTSLLPKSCSLLSLATIKVLDLHDNQLTALPDDLGQLTALQVLNVERNQLMQLPRSIGNLTQLQTLNVKDNKLKELPDTVGELRSLRTLNISGNEIQRLPQMLAHVRTLEMLSLDASAMVYPPREVCGAGTAAILQFLCKESGLEYYPPSQYLLPILEQDGIENSRDSPDGPTDRFSREELEWQNRFSDYEKRKEQKMLEKLEFERRLELGQREHTQLLQQSSSQKDEILQTVKEEQSRLEQGLSEHQRHLNAERQRLQEQLKQTEQNISSRIQKLLQDNQRQKKSSEILKSLENERIRMEQLMSITQEETESLRRRDVASAMQQMLTESCKNRLVQMAYESQRQNLVQQACSSMAEMDERFQQILSWQQMDQNKAISQILQESAMQKAAFEALQVKKDLMHRQIRSQIKLIETELLQLTQLELKRKSLDTESLQEMISEQRWALSSLLQQLLKEKQQREEELREILTELEAKSETRQENYWLIQYQRLLNQKPLSLKLQEEGMERQLVALLEELSAEHYLPIFAHHRLSLDLLSQMSPGDLAKVGVSEAGLQHEILRRVQELLDAARIQPELKPPMGEVVTPTAPQEPPESVRPSAPPAELEVQASECVVCLEREAQMIFLNCGHVCCCQQCCQPLRTCPLCRQDIAQRLRIYHSS

SEQ ID NO: 2573 - protein, 122 aa, Homo sapiens
MIRQGGSIHALHPNPGGIWRGRWWAEVGPKHGSLRLTAPSLWGGSVAADMVACCLFSCSSKHYPLYSLNVASMWLKLGRLYMGLEHKAAGEKALKKAIAIMEVAHGKDHPYISEIKQEIESH

SEQ ID NO: 2574 - protein, 920 aa, Homo sapiens
MEASSSGITNGKTKVFHPVAKDVNILFDELEAVSSPCKDDDSLLHPGNLTSTSDDASRLEAGGETVPERNKSNGLYFRDGKCRIDYILVYRKSNPQTEKREVFERNIRAEGLQMEKESSLINSDIIFVKLHAPWEVLGRYAEQMNVRMPFRRKIYYLPRRYKFMSRIDKQISRLRRWLPKKPMRLDKETLPDLEENDCYTAPFSQQRIHHFIIHNKETFFNNATRSRIVHHILQRIKYEEGKNKIGLNRLLTNGSYEAAFPLHEGSYRSKNSIRTHGAENHRHLLYECWASWGVWYKYQPLDLVRRYFGEKIGLYFAWLGWYTGMLFPAAFIGLFVFLYGVTTLDHSQVSKEVCQATDIIMCPVCDKYCPFMRLSDSCVYAKVTHLFDNGATVFFAVFMAVWATVFLEFWKRRRAVIAYDWDLIDWEEEEEEIRPQFEAKYSKKERMNPISGKPEPYQAFTDKCSRLIVSASGIFFMICVVIAAVFGIVIYRVVTVSTFAAFKWALIRNNSQVATTGTAVCINFCIIMLLNVLYEKVALLLTNLEQPRTESEWENSFTLKMFLFQFVNLNSSTFYIAFFLGRFTGHPGAYLRLINRWRLEECHPSGCLIDLCMQMGIIMVLKQTWNNFMELGYPLIQNWWTRRKVRQEHGPERKISFPQWEKDYNLQPMNAYGLFDEYLEMILQFGFTTIFVAAFPLAPLLALLNNIIEIRLDAYKFVTQWRRPLASRAKDIGIWYGILEGIGILSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 2575 - protein, 120 aa, Homo sapiens [sequence omitted]

SEQ ID NO: 2576 - protein, 202 aa, Homo sapiens [sequence omitted]

SEQ ID NO: 2577 - protein, 250 aa, Homo sapiens [sequence omitted]

SEQ ID NO: 2578 - protein, 382 aa, Homo sapiens
MAERGLEPSPAAVAALPPEVRAQLAELELELSEGDITQKGYEKKRSKLLSPYSPQTQETDSAVQKELRNQTPAPSAAQTSAPSKYHRTRSGGARDERYRSDIHTEAVQAALAKHKEQKMALPMPTKRRSTFVQSPADACTPPDTSSASEDEGSLRRQAALSAALQQSLQNAESWINRSIQGSSTSSSASSTLSHGEVKGTSGSLADVFANTRIENLSAPPDVTTTTSSSSSSSSIRPANIDLPPPGIVKGMHKGSNRSSLMDTADGVPVSSRVSTKIQQLLNTLKRPKRPPLKEFFVDDSEEIVEVPQPDPNQPKPEGRQMTPVKGEPLGVICNWPPALESALQRWGTTQAKCSCLTALDMTGKPVYTLTYGESARFQILLS

SEQ ID NO: 2579 - protein, 213 aa, Homo sapiens
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVGREARISPLGDRSQNRFRCECRYCQSHRPNLSGIPGESNRAPHPSSWETLVQGLSGLTLSLGTNQPGPLPEAALQPQETEEKRQRERQQESKIMFQRLLKQWLEEN

SEQ ID NO: 2580 - protein, 510 aa, Homo sapiens
MDGMSGSGQCLCRSGFAGTACELCAPGAFGPHCQACRCTVHGRCDEGLGGSGSCFCDEGWTGPRCEVQLELQPVCTPPCAPEAVCRAGNSCECSLGYEGDGRVCTVADLCQDGHGGCSEHANCSQVGTMVTCTCLPDYEGDGWSCRARNPCTDGHRGGCSEHANCLSTGLNTRRCECHAGYVGDGLQCLEESEPPVDRCLGQPPPCHSDAVCTDLHFQEKRAGVFHLQATSGPYGLNFSEAEAACEAQGAVLASFPQLSAAQQLGFHLCLMGWLANGSTAHPVVFPVADCGNGRVGVVSLGARKNLSERWDAYCFRVQDVACRCRNGFVGDGISTCNGKLLDVLAATANFSTFYGMLLGYANATQRGLDFLDFLDDELTYKTLFVPVNEGFVDNMTLSGPDLELHASNATLLAPPQPAVLASLPSRRKMMLTTTSHRGKKGPTPPWSLSPTLSLAATPFVNPSMTHCWRRTSLTPRGSSQSSDEAGAESRSMHREETTFIACLGGWGRRG

SEQ ID NO: 2581 - protein, 202 aa, Homo sapiens [sequence omitted]

SEQ ID NO: 2582 - protein, 220 aa, Homo sapiens
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSASEPDAVHVVLDRHLVTGQNASSTVPAVQNLLFLCGSRK

SEQ ID NO: 2583 - protein, 137 aa, Homo sapiens [sequence omitted]

SEQ ID NO: 2584 - protein, 105 aa, Homo sapiens
MGGLLTPGLWCCRQPSPVYTATQPQAVGSQWPGGKQLHSPALPGCPFGFQPGSRPASTGKPVTEAWTQRWTRHLLATCDLGRSESVARSTCSAAAINSLPVSKRR

SEQ ID NO: 2585 - protein, 280 aa, Homo sapiens [sequence omitted]

SEQ ID NO: 2586 - protein, 261 aa, Homo sapiens
MKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLFFVAVRYGREWRGHTQATGDPHCSPPPELPFSRLQNGASGTASLACWWNHINTSVAGAQGRWV

SEQ ID NO: 2587 - protein, 105 aa, Homo sapiens
MYEGLEIVFRVGLALLQVNQAELMQLDMEGMSQYFQRVIPHQFDSCPDKLVLKAYQVKYNPKKMKRLEKEYAAMKSKEMEEQIEIKRLRTENRLLKQRIETLEKR

SEQ ID NO: 2588 - protein, 645 aa, Homo sapiens
MQEGHGGWNPRMAEHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 2589 - protein, 107 aa, Homo sapiens [sequence omitted]

SEQ ID NO: 2590 - protein, 465 aa, Homo sapiens
MLFSALFFLLYSAFFRRPEYQRTIFKFLGWLCDLSIYSLFFPISRISAFQTWRDFPVGERRRPWLMERDISGVPSSDLKSKTKTKESALQNDISWEELHCGLMMERFTKGSSMYSTLGRISKCNKLESQQENQRMGKGQIPLMCKKTFTQERGQESNRFEKRINVKSEVMPGPIGLPRKRDRKYDTPGKRSRYNIDLVNHSRSYTKMKTFECNICEKIFKQLIHLTEHMRIHTGEKPFRCKECGKAFSQSSSLIPHQRIHTGEKPYECKECGKTFRHPSSLTQHVRIHTGEKPYECRVCEKAFSQSIGLIQHLRTHVREKPFTCKDCGKAFFQIRHLRQHEIIHTGVKPYICNVCSKTFSHSTYLTQHQRTHTGERPYKCKECGKAFSQRIHLSIHQRVHTGVKPYECSHCGKAFRHDSSFAKHQRIHTGEKPYDCNECGKAFSCSSSLIRHCKTHLRNTFSNVV

SEQ ID NO: 2591 - protein, 116 aa, Homo sapiens
MGFHHVAQAGLELLCSSNLPVSASQSAGITGVSHRAWPGLYLCLISFLVFFFFLRGSLALSPRLECSGTISAYCKLRLPGSRHSPGSASRVAGTTGACHHARLIFCIFSGDGVSLC

SEQ ID NO: 2592 - protein, 586 aa, Homo sapiens
MGPLTFRDVKIEFSLEEWQCLDTAQRNLYRDVMLENYRNLVFLGIAVSKPDLITWLEQGKEPWNLKRHEMVDKTPVMCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNWSSTLTKHKIIHTGEKPYKCEECGKAFNRSSNLTKHKIIHTGEKPYKCEECGKAFNRSSTLTKHKRIHTEEKPYKCEECGKAFNQFSILNKHKRIHMEDKPYKCEECGKAFRVFSILKKHKIIHTGEKPYKCEECGKAFNQFSNLTKHKIIHTGEKPYKCDECGKAFNQSSTLTKHKRIHTGEKPYKCEECGKAFKQSSTLTEHKIIHTGEKPYKCEKCGKAFSWSSAFTKHKRNHMEDKPYKCEECGKAFSVFSTLTKHKIIHTREKPYKCEECGKAFNQSSIFTKHKIIHTEGKSYKCEKCGNAFNQSSNLTARKIIYTGEKPYKYEECDKAFNKFSTLITHQIIYTGEKPCKHECGRAFNKSSNYTKEKLQT

SEQ ID NO: 2593 - protein, 125 aa, Homo sapiens
MELMFAEWEDGERFSFEDSDRFEEDSLCSFISEAESLCQNWRGWRKQSAGPNSPTGGGGGGGSGGTRMRGESELGGRGAAGPAWASLGSCPGPGAVPDQELSSTRGRKGSCPRPGAVPDWELSQA

SEQ ID NO: 2594 - protein, 123 aa, Homo sapiens [sequence omitted]

SEQ ID NO: 2595 - protein, 206 aa, Homo sapiens
MAVLSAPGLRGFRILGLRSSVGPAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPGRAGTAPPTRELETGPAPHGARRPL

SEQ ID NO: 2596 - protein, 611 aa, Homo sapiens
MACCLCQFKNSIEAVCKTVKLHCNSACLTNTTHCPEEASVGNPEGAFMKVLQARKNYTSTELIIEPEEPSDSSGINLSGFGSEQLDTNDESDVTSTLSYILPYFSAVNLDVKSLLLPFIKLPTTGNSLAKIQTVGKNRQRLNRVLMGPRSIQKRHFKEVGRQSIRREQGAQASVENTAEEKRLGSPAPRELKQPHTQQGPEKLAGNAVYTKPSFTQEHKAAVSVLKPFSKGAPSTSSPAKALPQVRDRWKDLTHAISILESAKARVTNMKTSKPIVHSRKKYRFHKTRSRMTHRTPKVKKSPKVRKKSYLSRLMLSNRLPFSAAKSLINSPSQGAFSSLRDLSPQENPFLEVSAPSEHFIENNNTKDTTARNAFEENVFMENTNMPEGTISENTNHNHPPEADSAGTAFNLGPTVKQTETKWEYNNVGTDLSPEPKSFNYPLLSSPGDQFEIQLTQQLQSVIPNNNVRRLIAHVIRTLKMDCSGAHVQVTCAKLVSRTGHLMKLLSGQQEVKASKIEWDTDQWKTENYINESTEAQSEQKEKSLEFTKELPGYGYTKKLILALIVTGILTILIILLCLIEICCHRRSLQEDEEGFPRDSEAPTEEESEALP

SEQ ID NO: 2597 - protein, 559 aa, Homo sapiens [sequence omitted]

SEQ ID NO: 2598 - protein, 130 aa, Homo sapiens [sequence omitted]

SEQ ID NO: 2599 - protein, 104 aa, Homo sapiens
MRLIFSKYHSLRHYTNNSRKFFLPCSGYSILLYSPAKLLGLFKLISKPNSLDKYLPLYLGGIQAHHLPRQAHQQSRGIFCVIPSRLLHRILLFPFVSWPFSIIC

SEQ ID NO: 2600 - protein, 245 aa, Homo sapiens [sequence omitted]

SEQ ID NO: 2601 - protein, 224 aa, Homo sapiens
MKQGFLSGNSAEKPFVRLERKICLFCLAGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGAAWHPRYNLIVVGRYPDPNFKSCTPYELRTIDVFDGNSGKMMCQLYDPESSGISSLNEFNPMGDTLASAMGYHILIWSQEEARTRK

SEQ ID NO: 2602 - protein, 167 aa, Homo sapiens
MGPVSLLPKYQKLNTWNGDLAKMTHLQAGLSPETIEKARLELNENPDVLHQDIQQVRDMIITRPDIGFLRTDDAFILRFLRARKFHQADAFRLLAQYFQYRQLNLDMFKNFKADDPGIKRALIDGFPGVLENRDHYGRKILLLFAANWDQRTPSQTSFVPSCCHWKS

SEQ ID NO: 2603 - protein, 239 aa, Homo sapiens
MAICPLHSAGQVACPHYIHLLTPLPWMDQWWCHPKQIDTIFPLVTAKGENHPSPNFNQYVRDQGAMTDQLSRRQIREYQLYSRTSGKHVQVTGRRISATAEDGNKFAKLIVETDTFGSRVRIKGAESEKYICMNKRGKLIGKPSGKSKDCVFTEIVLENNYTAFQNARHEGWFMAFTRQGRPRQASRSRQNQREAHFIKRLYQGQLPFPNHAEKQKQFEFVGSAPTRRTKRTRRPQPLT

SEQ ID NO: 2604 - protein, 243 aa, Homo sapiens
MPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 2605 - protein, 721 aa, Homo sapiens
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNVSLKEVMQVLSHVVLEFPLQQMDSPLDSSRYCALLLPLLKAWSPVFRNYIKRAADHLEALAAIEDFFLEHEALGISMAKVLMAFYQLEILAEETILSWFSQRDTTDKGQQLRKNQQLQRFIQWLKEAEEESSEDD

SEQ ID NO: 2606 - protein, 135 aa, Homo sapiens [sequence omitted]

SEQ ID NO: 2607 - protein, 207 aa, Homo sapiens
MSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGTLSVPSVRSHSWGTGTMRRRAWPTARLTTTSSSGTSATTAAM

SEQ ID NO: 2608 - protein, 100 aa, Homo sapiens
MGCLRFLRYHTDQNTLISSIAQDPGFLTGQAPSKELQHKIDDLEVKSLALSQRDQSLEFWPCSLLPCDFDKLLFFLSLSFFFYKQRPERYLLHRIVTRIK

SEQ ID NO: 2609 - protein, 106 aa, Homo sapiens
MPVPRSSEISLCPQAEAPSMGGSGRQEKVALPGARVYWRRPISDFLTQPVWKAEQRMHAQSEICSILLQENRKPVSQSQRNLPKQRNSCFHGSCRCLSQEGKAGSD

SEQ ID NO: 2610 - protein, 126 aa, Homo sapiens
MLSLAMGHSLSHSCVRPVDQHPHTLVADAVCSRSWAFSHGAPGCWGGHPMVIQWLAQTRWVCSDTARAVSLSPGDQERPGGGRDPGGQGRGRILFPCGPYSSIHSLNKYRSGSRDTAGTDGTGAQR

SEQ ID NO: 2611 - protein, 138 aa, Homo sapiens
MRSSAVCHHPLVSTITLVSSSPRIHEVQCCHHPLGSAITLVSSSVIHEVQCCHHPLGSTITLVSSSPRIHEVQCCHHLLGSTMTLVLSSPRIHEVQCCHHLLGSTMTLVLSSPRIHEVQCCHHPLGSTITLVSSQSPL

SEQ ID NO: 2612 - protein, 172 aa, Homo sapiens
MAGLTDLQRLQARVEELERWVYGPGGARGSRKVADGLVKVQVALGNISSKRERVKILYKKIEDLIKYLDPEYIDRIAIPDASKLQFILAGNAGLHVYMHLRMWVVGEVKHRDGLSIQSSGGYKPWMLLSGIVAWFWVEDPMDPLVDIEYSIPLHQLQAMVPATVGASPVFYQ

SEQ ID NO: 2613 - protein, 114 aa, Homo sapiens
MCQWLPDAESKASCSGRFWKNLSPHGVQCQCQIINIIIKSESEPSFRDIQRPLCMKLLSDKEKILFDFLSLLSSAMSRTRQIFHMHSHILCMCVSFPAGTGGPKLCLYDEPVPK

SEQ ID NO: 2614 - protein, 103 aa, Homo sapiens [sequence omitted]

SEQ ID NO: 2615 - protein, 119 aa, Homo sapiens; identical to SEQ ID NO: 1981

SEQ ID NO: 2616 - protein, 478 aa, Homo sapiens [sequence omitted]

SEQ ID NO: 2617 - protein, 131 aa, Homo sapiens
MLSICLLAVYMSSLEKCLFGLFVHFSIRCVFLYVLGIHPFQIYHFKILCPIPWIAFHSVLFFDVQKLFLSFSYLCVPLVSYLRNHCLTLFRYIILKYFVPFRGLPFTLFCSLMYRSCFFLLVTCVCLWCHI

SEQ ID NO: 2618 - protein, 172 aa, Homo sapiens
MIPLRGCADGGRVLRGVRKAQAHSSPVLSLVDLPAPSRTGWSPTHVGRMVPAEWLYQVRPHLETASFLSGHQLCDIFPILMFFSICHLHCPAKLRLLPLQRQLASRHRWTPGSCSDVARLSGKSVLPLPISMPSPSVSPESAVYLIGPVMLTFRATAFSSEEFSSHHGVSGL

SEQ ID NO: 2619 - protein, 168 aa, Homo sapiens
MYVCPCACYIYVYMLCNVQVCMCVHMYMCVHVHVYICRYVCICVHMYMCLCLCVCMCVCVCMSIYMCMYICVHMYICAHMCLCLCACCVCAGGPLLCSFVGAKQRMCMMLSMCACVYVCMCVCVRMYMYVCACVCVSLCVYVVCVHSRVYVCMCVCVCMYVYLLRVVS

SEQ ID NO: 2620 - protein, 103 aa, Homo sapiens [sequence omitted]

SEQ ID NO: 2621 - protein, 936 aa, Homo sapiens
MKQQALTEFEAYKHRVEDMQLCAEAQHVQRIVTMSREVEEIRRKFEEKLRSFGQLQVQFEKDKRLALEDLQAAHRREIQELLKSQQDHSASVNKGQEKAEELHRMEVESLNKMLEELRLERKKLIEDYEGKLNKAQSFYERELDTLKRSQLFTAESLQASKEKEADLRKEFQGQEAILRKTIGKLKTELQMVQDEAGSLLDKCQKLQTALAIAENNVQVLQKQLDDAKEGEMALLSKHKEVESELAAARERLQQQASDLVLKASHIGMLQATQMTQEVTIKDLESEKSRVNERLSQLEEERAFLRSKTQSLDEEQKQQILELEKKVNEAKRTQQEYYERELKNLQSRLEEEVTQLNEAHSKTLEELAWKHHMAIEAVHSNAIRDKKKLQMDLEEQHNKDKLNLEEDKNQLQQELENLKEVLEDKLNTANQEIGHLQDMVRKSEQGLGSAEGLIASLQDSQERLQNELDLTKDSLKETKDALLNVEGELEQERQQHEETIAAMKEEEKLKVDKMAHDLEIKWTENLRQECSKLREELRLQHEEDKKSAMSQLLQLKDREKNAARDSWQKKVEDLLNQISLLKQNLEIQLSQSQTSLQQLQAQFTQERQRLTQELEELEERHQQRHKSLKEAHVLAFQTMEEEKEKEQRALENHLQQKHSAELQSLKDAHRESMEGFRIEMEQELQTLRFELEDEGKAMLASLRSELNHQHAAAIDLLRHNHHQELAAAKMELERSIDISRRQSKEHICRITDLQEELRHREHHISELDKEVQHLHENISALTKELEFKGKEILRIRSESNQQIRLEEMEEKYLMRESKPEDIQMITELKAMLTERDQIIKKLIQKKKNDKSPTNRFVSVPNLSALESGGVGNGHPNRLDPIPNSPVHDIEFNSSKPLPQPVPPKGPKTFLSPAQSEASPVASPDPQRQEWFARYFTF

SEQ ID NO: 2622 - protein, 749 aa, Homo sapiens
MGINNRFPSEKIAIPGSEEQATVSMGTTVRAALSCSDSVAVTDSLVAHPTVAMFTGNMLTINSYDSPPKLSAESLDKNSGPRNRADNSGKPQQPPGGFAPAAINRSIPCKVIVDHSTTLTSSLSLTVSVESSEASLDLQGRPVRTEASVQPVACPQVSVISRPEPVANEGIDHSSTFIAASAAKQDSKTLPATCTSLRELPLVPDKLNEPTAPSHNFAEQARGPAPFKSEADTTCSNQYNPSNRICWNDDGMRSTGQPLVTHSGSSKQKEYLEQSCPKAIKTEHANYLNVSELHPRNLVTNVALPVKSELHEADKGFRMDTEDFPGPELPPPAAEGASSVQQTQNVKASTSSPMEEAISLATDALKRVPGAGSSGCRLSSVEANNPLVTQLLQGNLPLEKVLPQPRLGAKLEINRLPLPLQTTSVGKTAPERNVEIPPSSPNPDGKGYLAGTLAPLQMRKRENHPKKRVARTVGEHTQVKCEPGKLLVEPDVKGVPCVISSGISQLGHSQPFKQEWLNKHSMQNRIVHSPEVKQQKRLLPSCSFQQNLFHVDKNGGFHTDAGTSHRQQFYQMPVAARGPIPTAALLQASSKTPVGCNAFAFNRYLEQKGLGEVSLSSAPHQLRLANMLSPNMPMKEGDEVGGTAHTMPNKALVHPPPPPPPPPPPPLALPPPPPPPPPLPPPLPNAEVPSDQKQPPVTMETTKRLSWPQSTGICSNIKSEPLSFEEGLSSSCELGMKQVSYDHNKHDLK

SEQ ID NO: 2623 - protein, 376 aa, Homo sapiens
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVSRFMPKHKTTHLKKMLGLKGNGGAVLSMALPFQPEQRDSEDLLKNFNSECDTHCGLDTARQEYLGNSLRQESDLKKSTSSDNSSSHHGENKQNLTVDPCDILGGVDNQQRLLHIVWPHRWEHDKDPESFFKVLMHLKDLGLNFHVSVLGETFTDVPGWKLCTVGVTHFVLKIWFIPKYFQLNICILHLNSFQKGSRISARDQIL

SEQ ID NO: 2624 - protein, 415 aa, Homo sapiens [sequence omitted]

SEQ ID NO: 2625 - protein, 328 aa, Homo sapiens
MNMTAYNKGRLQSSFWIVDKQHVYIGSAGLDWQSLGQMKELGVIFYNCSCLVLDLQRIFALYSSLKFKSRVPQTWSKRLYGVYDNEKKLQLQLNETKSQAFVSNSPKLFCPKNRSFDIDAIYSVIDDAKQYVYIAVMDYLPISSTSTKRTYWPDLDAKIREALVLRSVRVRLLLSFWKETDPLTFNFISSLKAICTEIANCSLKVKFFDLERENACATKEQKNHTFPRLNRNKYMVTDGAAYIGNFDWVGNDFTQNAGTGLVINQADVRNNRSIIKQLKDVFERDWYSPYAKTLQPTKQPNCSSLFKLKPLSNKTATDDTGGKDPRNV

SEQ ID NO: 2626 - protein, 638 aa, Homo sapiens [sequence omitted]

SEQ ID NO: 2627 - protein, 132 aa, Homo sapiens [sequence omitted]

SEQ ID NO: 2628 - protein, 152 aa, Homo sapiens
MPAVGFTPHSPGRAPMPPPPKRPEERAGWAQARGTDSCGRRLWSRWVSRAAPAAGSLVQSGGQVRRHRQGAHDAANAADGWPDGHVQPHGHPFRGLRRLRSGTDAAASGPDGISRAGRLPEPHGCLRCRPDAADGGPQHEWPGGRTYDPNLR

SEQ ID NO: 2629 - protein, 123 aa, Homo sapiens
MQFETFSSHVCVYVCVSPCVYMCVRLCVGGCVFFCTPGGRGICKVSSLLSCRVDMQPTDMHSLLLQPQPPLLQPLQPLTVTVMAGCTQPTPTMPLPLPLAMELALWRVYTEVATADLPPTEVT

SEQ ID NO: 2630 - protein, 179 aa, Homo sapiens
MAVAGRQGSPATWSVRSWTSVLGIRPGAGDEGGVGGSSPRASGRTRMPRSTETQGEPFQGVDFGDCSGFPSALGRTWFVLVFLETRSRSFAQAGVQWHDHSSLQPRTPGLKRSSHLTLLSSWDHRRTPRHLTILFLVKTGSWYFWSQTLASSNPPASASQTAGITGMSHHARPFFFFSP

SEQ ID NO: 2631 - protein, 134 aa, Homo sapiens
MGGEPWRGLSGFTPCCFAWPENVRKGHKVTGASATPIFLSPLDWAQRGDCHGNHRCPERGSWGWPHPFPAEIGDPGVGGAAPSRPPGGHGRKPRTPAPEAVSDWPLEAADTQIGGPGCIFINIMSVLINIIYLK

SEQ ID NO: 2632 - protein, 113 aa, Homo sapiens [sequence omitted]

SEQ ID NO: 2633 - protein, 139 aa, Homo sapiens
MQAREQLRAAKQRSKGDRLVIACQEQTYWLVNRPPTKSADFHKREIEYFRKALGRTRVKSSVCLEAYLSFCGQRGPHDPLVSGCLPSNPWISDNDAYWVMNAPTVAAPTKLRVERWGFSFRELLEDPVGRAHFMDFLGK

SEQ ID NO: 2634 - protein, 157 aa, Homo sapiens
MAEKFDCHYCRDPLQGKKYVQKDGHHCCLKCFDKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 2635 - protein, 141 aa, Homo sapiens [sequence omitted]

SEQ ID NO: 2636 - protein, 471 aa, Homo sapiens
MENLKHIITLGQVIHKRCEEMKYCKKQCRRLGHRVLGLIKPLEMLQDQGKRSVPSEKLTTAMNRFKAALEEANGEIEKFSNRSNICRFLTASQDKILFKDVNRKLSDVWKELSLLLQVEQRMPVSPISQGASWAQEDQQDADEDRRAFQMLRRDNEKIEASLRRLEINMKEIKETLRQYLPPKCMQEIPQEQIKEIKKEQLSGSPWILLRENEVSTLYKGEYHRAPVAIKVFKKLQAGSIAIVRQTFNKEIKTMKKFESPNILRIFGICIDETVTPPQFSIVMEYCELGTLRELLDREKDLTLGKRMVLVLGAARGLYRLHHSEAPELHGKIRSSNFLVTQGYQVKLAGFELRKTQTSMSLGTTREKTDRVKSTAYLSPQELEDVFYQYDVKSEIYSFGIVLWEIATGDIPFQGCNSEKIRKLVAVKRQQEPLGEDCPSELREIIDECRAHDPSVRPSVDEILKKLSTFSK

SEQ ID NO: 2637 - protein, 262 aa, Homo sapiens
MQLPPALCARLAAGPGAAEPLPVERDPAAGAAPFRFVARPVRFPREHQFFEDGDVQRHLYLQDVIMQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMVRMHLYPADFRFDKPKKSRSPASAEAPGDSGERSEGEAMEICSEPVAASPAPAGERRIYRHRSVSELFLKPVLNMCSVLRILGCTWAAALLILNSER

SEQ ID NO: 2638 - protein, 422 aa, Homo sapiens [sequence omitted]

SEQ ID NO: 2639 - protein, 488 aa, Homo sapiens
MVAERSPARSPGSWLFPGLWLLVLSGPGGLLRAQEQPSCRRAFDLYFVLDKSGSVANNWIEIYNFVQQLAERFVSPEMRLSFIVFSSQATIILPLTGDRGKISKGLEDLKRVSPVGETYIHEGLKLANEQIQKAGGLKTSSIIIALTDGKLDGLVPSYAEKEAKISRSLGASVYCVGVLDFEQAQLERIADSKEQVFPVKGGFQALKGIINSILAQSCTEILELQPSSVCVGEEFQIVLSGRGFMLGSRNGSVLCTYTVNETYTTSVKPVSVQLNSMLCPAPILNKAGETLDVSVSFNGGKSVISGSLIVTATECSNGIAAIIVILVLLLLLGIGLMWWFWPLCCKVVIKDPPPPPAPAPKEEEEEPLPTKKWPTVDASYYGGRGVGGIKRMEVRWGDKGSTEEGARLEKAKNAVVKIPEETEEPIRPRPPRPKPTHQPPQTKWYTPIKGRLDALWALLRRQYDRVSLMRPQEGDEGRCINFSRVPSQ

SEQ ID NO: 2640 - protein, 490 aa, Homo sapiens
MTIGRMENVEVFTAEGKGRGLKATKEFWAADIIFAERAYSAVVFDSLVNFVCHTCFKRQEKLHRCGQCKFAHYCDRTCQKDAWLNHKNECSAIKRYGKVPNENIRLAARIMWRVEREGTGLTEGCLVSVDDLQNHVEHFGEEEQKDLRVDVDTFLQYWPPQSQQFSMQYISHIFGVINCNGFTLSDQRGLQAVGVGIFPNLGLVNHDCWPNCTVIFNNGNHEAVKSMFHTQMRIELRALGKISEGEELTVSYIDFLNVSEERKRQLKKQYYFDCTCEHCQKKLKDDLFLGVKDNPKPSQEVVKEMIQFSKDTLEKIDKARSEGLYHEVVKLCRECLEKQEPVFADTNIYMLRMLSIVSEVLSYLQAFEEASFYARRMVDGYMKLYHPNNAQLGMAVMRAGLTNWHAGNIEVGHGMICKAYAILLVTHGPSHPITKDLEAMRVQTEMELRMFRQNEFMYYKMREAALNNQPMQVMAEPSNEPSPALFHKKQ

SEQ ID NO: 2641 - protein, 320 aa, Homo sapiens [sequence omitted]

SEQ ID NO: 2642 - protein, 189 aa, Homo sapiens [sequence omitted]

SEQ ID NO: 2643 - protein, 548 aa, Homo sapiens
MSASLNYKSFSKEQQTMDNLEKQLICPICLEMFTKPVVILPCQHNLCRKCASDIFQASNPYLPTRGGTTMASGGRFRCPSCRHEVVLDRHGVYGLQRNLLVENIIDIYKQESTRPEKKSDQPMCEEHEEERINIYCLNCEVPTCSLCKVFGAHKDCQVAPLTHVFQRQKSELSDGIAILVGSNDRVQGVISQLEDTCKTIEECCRKQKQELCEKFDYLYGILEERKNEMTQVITRTQEEKLEHVRALIKKYSDHLENVSKLVESGIQFMDEPEMAVFLQNAKTLLKKISEASKAFQMEKIEHGYENMNHFTVNLNREEKIIREIDFYREDEDEEEEEGGEGEKEGEGEVGGEAVEVEEVENVQTEFPGEDENPEKASELSQVELQAAPGALPVSSPEPPPALPPAADAPVTQGEVVPTGSEQTTESETPVPAAAETADPLFYPSWYKGQTRKATTNPPCTPGSEGLGQIGPPGSEDSNVRKAEVAAAAASERAAVSGKETSAPAATSQIGFEAPPLQGQAAAPASGSGADSEPARHIFSFSWLNSLNE

SEQ ID NO: 2644 - protein, 455 aa, Homo sapiens [sequence omitted]

SEQ ID NO: 2645 - protein, 661 aa, Homo sapiens [sequence omitted]

SEQ ID NO: 2646 - protein, 769 aa, Homo sapiens [sequence omitted]

SEQ ID NO: 2647 - protein, 231 aa, Homo sapiens
MACRPRSPPRHQSRCDGDASFTTPEGPKPRSRCSDWASAVEEDEMRTRVNKEMARYKRKLLINDFGRERKSSSGSSDSKESMSTVPADFETDESVLMRRQKQINYGKNTIAYDRYIKEVPRHLRQPGIHPKTPNKFKKYSRRSWDQQIKLWKVALHFWDPPAEEGCDLQEIHPVDLESAESSSEPQTSSQDDFDVYSGTPTKVRHMDSQVEDEFDLEACLTEPLRDFSAMS

SEQ ID NO: 2648 - protein, 334 aa, Homo sapiens
MQRAVSVVARLGFRLQAFPPALCRPLSCAQEVLRRTPLYDFHLAHGGKMVAFAGWSLPVQYRDSHTDSHLHTRQHCSLFDVSHMLQTKILGSDRVKLMESLVVGDIAELRPNQGTLSLFTNEAGGILDDLRKLPFMTSAVMEVFGVSGCRVTRCGYTGEDGVEISVPVAGAVHLATAILKNPEVKLAGLAARDSLRLEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVEVRRKQQMAVVSKMPFVPTNYYTLK

SEQ ID NO: 2649 - protein, 198 aa, Homo sapiens [sequence omitted]

SEQ ID NO: 2650 - protein, 133 aa, Homo sapiens
MAAGDGDVKLGTLGSGSESSNDGGSESPGDAGAAAEGGGWAAAALALLTGGGEMLLNVALVALVLLGAYRLWVRWGRRGLGAGAGAGLQLGAAAPVRRLPQPAHPARGQWESLRRDQRQQVLRPGGSIWNICW

SEQ ID NO: 2651 - protein, 687 aa, Homo sapiens
MVKLAKAGKNQGDPKKMAPPPKEVEEDSEDEEMSEDEEDDSSGEEVVIPQKKGKKAAATSAKKVVVSPTKKVAVATPAKAVTTPGKKGATPGKALVATPGKKGAAIPAKGAKNGKNAKKEDSDEEEDDDSEEDEEDDEDEDEDEDEIEPAAMKAAAAAPASEDEDDEDDEDDEDDDDDEEDDSEEEAMETTPAKGKKAAKVVPVKAKNVAEDEDEEEDDEDEDDDDDEDDEDDDDEDDEEEEEEEEEEPVKEAPGKRKKEMAKQKAAPEAKKQKVEGTEPTTAFNLFVGNLNFNKSAPELKTGISDVFAKNDLAVVDVRIGMTRKFGYVDFESAEDLEKALELTGLKVFGNEIKLEKPKGKDSKKERDARTLLAKNLPYKVTQDELKEVFEDAAEIRLVSKDGKSKGIAYIEFKTEADAEKTFEEKQGTEIDGRSISLYYTGEKGQNQDYRGGKNSTWSGESKTLVLSNLSYSATEETLQEVFEKATFIKVPQNQNGKSKGYAFIEFASFEDAKEALNSCNKREIGGRAIRLELQGPRGSPNARSQPSKTLFVKGLSEDTTEETLKESFDGSVRARIVTDRETGSSKGFGFVDFNSEEDAKAAKEAMEDGEIDGNKVTLDWAKPKGEGGFGGRGGGRGGFGGRGGGRGGRGGFGGRGRGGFGGRGGFRGGRGGGGDHKPQGKKTKFE

SEQ ID NO: 2652 - protein, 152 aa, Homo sapiens [sequence omitted]

SEQ ID NO: 2653 - protein, 108 aa, Homo sapiens [sequence omitted]

SEQ ID NO: 2654 - protein, 808 aa, Homo sapiens
MGLLLMILASAVLGSFLTLLAQFFLLYRRQPEPPADEAARAGEGFRYIKPVPGLLLREYLYGGGRDEEPSGAAPEGGATPTAAPETPAPPTRETCYFLNATILFLFRELRDTALTRRWVTKKIKVEFEELLQTKTAGRLLEGLSLRDVFLGETVPFIKTIRLVRPVVPSATGEPDGPEGEALPAACPEELAFEAEVEYNGGFHLAIDVDLVFGKSAYLFVKLSRVVGRLRLVFTRVPFTHWFFSFVEDPLIDFEVRSQFEGRPMPQLTSIIVNQLKKIIKRKHTLPNYKIRFKPFFPYQTLQGFEEDEEHIHIQQWALTEGRLKVTLLECSRLLIFGSYDREANVHCTLELSSSVWEEKQRSSIKTVELIKGNLQSVGLTLRLVQSTDGYAGHVIIETVAPNSPAAIADLQRGDRLIAIGGVKITSTLQVLKLIKQAGDRVLVYYERPVGQSNQGAVLQDNFGQLEENFLSSSCQSGYEEEAAGLTVDTESRELDSEFEDLASDVRAQNEFKDEAQSLSHSPKRVPTTLSIKPLGAISPVLNRKLAVGSHPLPPKIQSKDGNKPPPLKTSEITDPAQVSKPTQGSAFKPPVPPRPQAKVPLPSADAPNQAEPDVLVEKPEKVVPPPLVDKSAEKQAKNVDAIDDAAAPKQFLAKQEVAKDVTSETSCPTKDSSDDRQTWESSEILYRNKLGKWTRTRASCLFDIEACHRYLNIALWCRDPFKLGGLICLGHVSLKLEDVALGCLATSNTEYLSKLRLEAPSPKAIVTRTALRNLSMQKGFNDKFCYGDITIHFKYLKEGESDHHVVTN

SEQ ID NO: 2655 - protein, 553 aa, Homo sapiens
MAPRKRSHHGLGFLCCFGGSDIPEINLRDNHPLQFMEFSSPIPNAEELNIRFAELVDELDLTDKNREAMFALPPEKKWQIYCSKKKEQEDPNKLATSWPDYYIDRINSMAAMQSLYAFDEEETEMRNQVVEDLKTALRTQPMRFVTRFIELEGLTCLLNFLRSMDHATCESRIHTSLIGCIKALMNNSQGRAHVLAQPEAISTIAQSLRTENSKTKVAVLEILGAVCLVPGGHKKVLQAMLHYQVYAAERTRFQTLLNELDRSLGRYRDEVNLKTAIMSFINAVLNAGAGEDNLEFRLHLRYEFLMLGIQPVIDKLRQHENAILDKHLDFFEMVRNEDDLELARRFDMVHIDTKSASQMFELIHKKLKYTEAYPCLLSVLHHCLQMPYKRNGGYFQQWQLLDRILQQIVLQDERGVDPDLAPLENFNVKNIVNMLINENEVKQWRDQAEKFRKEHMELVSRLERKERECETKTLEKEEMMRTLNKMKDKLARESQELRQARGQVAELVAQLSELSTGPVSSPPPPGGPLTLSSSMTTNDLPSVVRRAILVCAT

SEQ ID NO: 2656 - protein, 273 aa, Homo sapiens [sequence omitted]

SEQ ID NO: 2657 - protein, 213 aa, Homo sapiens
MASLQGCETLNAALTSPTRMDAVAAKVPNDGQNPGPEEEKLDESMERPESPKEFLDLDNHNAATKRQSSLSASEYLYGTPPPLSSGMGFGSSAFPPHSVMLQTGPPYTPQRPASHFQPRAYSSPVAALPPHHPGATQPNGLSQEGPIYRCQEEGLGHFQAVMMEQIGTRSGIRGPFQEMYRPSGFKRFSCLILPSSWDYRCPPPHLAEFCMIL

SEQ ID NO: 2658 - protein, 105 aa, Homo sapiens
MQVHSCASTNVCTDAGNTVLPPTPATTATNAAGVNAYMDTSNSISASVLPLLCCHHWHKHVQEHHLPAPTVALCKPTCVHLATLLWLLVCMSQHGSHCHYSSDML

SEQ ID NO: 2659 - protein, 114 aa, Homo sapiens
MAYVERMNYVHRDLRAANILVGENLVCKVADFGLARLIEDNEYTARQGAKFPIKWTAPEAALYGRFTIKSDVWSFGILLTELTTKGRVPYPGKKVLMACLWSLNPSALVALGKS

SEQ ID NO: 2660 - protein, 134 aa, Homo sapiens
MGWLTGVLVVLGSGQTGRCGASGEDSRKHFICCKNSSWNVASNHGRRTALEQETFYNNTNTTKDYYSEQKTRNTAGAISYLPDEGHYQAVTLALSTDACAHFVRRSFHGDKSNGNGRRKSGCTLAEAESFMEQY

SEQ ID NO: 2661 - protein, 514 aa, Homo sapiens
MNSGGGFGLGLGFGLTPTSVIQVTNLSSAVTSEQMRTLFSFLGEIEELRLYPPDNAPLAFSSKVCYVKFRDPSSVGVAQHLTNTVFIDRALIVVPCAEGKIPEESKALSLLAPAPTMTSLMPGAGLLPIPTPNPLTTLGVSLSSLGAIPAAALDPNIATLGEIPQPPLMGNVDPSKIDEIRRTVYVGNLNSQTTTADQLLEFFKQVGEVKFVRMAGDETQPTRFAFVEFADQNSVPRALAFNGVMFGDRPLKINHSNNAIVKPPEMTPQAAAKELEEVMKRVREAQSFISAAIEPESGKSNERKGGRSRSHTRSKSRSSSKSHSRRKRSQSKHRSRSHNRSRSRQKDRRRSKSPHKKRSKSRERRKSRSRSHSRDKRKDTREKIKEKERVKEKDREKEREREKEREKEKERGKNKDRDKEREKDREKDKEKDREREREKEHEKDRDKEKEKEQDKEKEREKDRSKEIDEKRKKDKNPEHHPGVTMHREDLVVPAGKGVGGGAGVLPDRQEHQKP

SEQ ID NO: 2662 - protein, 106 aa, Homo sapiens
MTRTAGRAEARWSQLCPIYLTVIIFQRQFQGYYSHDSTHPQGVRFSLCKCIMTFYNTPCHALFYPARIGVWPQLVPTSSTAITSSSSAPSVVLEPLVSSEMHMLKS

SEQ ID NO: 2663 - protein, 409 aa, Homo sapiens
MVGRELTRGLCSDLESMCETKLLSLKKEVYEIELCQREIMGLTKHGLEYSSFGDVLEYRSHLAKQLGYPNGHFSQEIFTPEYMPTFIQQTFLTLHQIINNEDRPYECKKCGKAFSQNSQFIQHQRIHIGEKSYECKECGKFFSCGSHVTRHLKIHTGEKPFECKECGKAFSCSSYLSQHQRIHTGKKPYECKECGKAFSYCSNLIDHQRIHTGEKPYECKVCGKAFTKSSQLFQHARIHTGEKPYECKECGKAFTQSSKLVQHQRIHTGEKPYECKECGKAFSSGSALTNHQRIHTGEKPYDCKECGKAFTQSSQLRQHQRIHAGEKPFECLECGKAFTQNSQLFQHQRIHTDEKPYECNECGKAFNKCSNLTRHLRIHTGEKPYNCKECGKAFSSGSDLIRHQGIHTN

SEQ ID NO: 2664 - protein, 522 aa, Homo sapiens [sequence omitted]

SEQ ID NO: 2665 - protein, 446 aa, Homo sapiens
MHEPSLCANVECPPAHTCPCGVPACSCAHVECPPAHTCRCGVPACSHMPMWSARLLTRAHVECPPAHTRVHVECPPAHVPMWSAHLLTCADVECHLLTHVPMWSARLLTCPCGVPACSHVPMRSARLLTRAHAECPPAHTCPCGVPACSHVPMRSARLLTRADVECPPAHTCPCGVPACSHVPTWSARLITRAHVECSPAHTCRCGVPACSHVPMWSVRLLTRADAECPPAHTCRCGVPACSHVPMWSARLLTCRCGVPACSHVPMWSARLLTCRCGVPACSHVPMWSARLLTRAHVECPPAHTCRRGVPACSRAHMECPPAHTCHCGVPACSHTCRCGVPACSHVPMWSARLLTRAYVECPPAHTRAHVECPPAHTCPCGVPACSHTCPCGVPACSHKALAWWFCRFPVLPAESDAVTVHSTHGGFLIRFYVKDPFYISLHLEIT

SEQ ID NO: 2666 - protein, 151 aa, Homo sapiens [sequence omitted]

SEQ ID NO: 2667 - protein, 125 aa, Homo sapiens [sequence omitted]

SEQ ID NO: 2668 - protein, 118 aa, Homo sapiens [sequence omitted]

SEQ ID NO: 2669 - protein, 129 aa, Homo sapiens [sequence omitted]

SEQ ID NO: 2670 - protein, 305 aa, Homo sapiens
MVVLSPVSPVTSCAHFVAALAPVPVRMGRCPSGLPGVLWWSGPLGSQSGWGGLHPTPPKPALLSGDPVAAVPSTFLLPGPKGQRAVAVWAVEPRRGWGGAACGAAGWHFALRRLFCPVLLVPSGLAFSHAAVVALCPLAVPLAPGSLGEREGWGLGCRVANIPFRAEVDAWPVSAQQVPLPPAAAAAASSSSWSSSFSSSSLSFSSSSSFSSSSSSSSSRCRRSPGAWVSALTGADRLVRGLSITCQNLYSFDICRYVPLFPTFHQQKGLSNSFQIRRPVGDTQHLWTCPLCGAGGGPGPGTALR

SEQ ID NO: 2671 - protein, 113 aa, Homo sapiens [sequence omitted]

SEQ ID NO: 2672 - protein, 610 aa, Homo sapiens
MESVRIEQMLSLPAEVSSDNLESAERGASAAQVDMGPHPKVAAEGPAPLPTREPEQEQSPGTSTPESKVLLTQADALASRGRIREALEVYRQLSERQQLVAEQLEQLVRCLAEKVPQGEALAPAPPDEGSTASGTVAAEETGAAAAAAATEVWDGFKCRKCHGFLSDPVSLSCGHTFCKLCLERGRAADRRCALCGVKLSALMVATGRARGARRAGQQPPPPLRVNVVLSGLLGKLFPGPARASQLRHEGNRLYRERQVEAALLKYNEAVKLAPNDHLLYSNRSQIYFTLESHENALHDAEIACKLRPMGFKAHFRKAQALATLGKVEEALREFLYCVSLDGKNKRARCEAQRDNLELPHCSSQEEAAARGDGSSLMDPAKVKGDGQQHHMKDQEEEEEKWDATSPKAASSKTGKCQEKKRKHCQIESQEETGMPNKASKQDPPTDQGDKPALSLPLASFDASDLECALCMRLFYEPVTTPCGHTFCLKCLERCLDHNAKCPLCKDGLSQCLASRKYSKNVIMEELIAKFLPEELKERRKLYEEEMEELSNLNKNVPIFVCTMAYPTVPCPLHIFEPCYRLMIRRCIETGTRQFGMCLGDPVKGHCLLCN

SEQ ID NO: 2673 - protein, 204 aa, Homo sapiens
MGPQHGTGPDPPPLCHCPHTAGGGAGGTGAPAFGLQGIWVPLAVGDRRGPCGQGASMGAPGQPRQGGRGKGQEASAQTRYGGNSPHGRGQNRLEGPGVQVCCNRARRARGCPHPGQRHHVVLSQWSGSGLVGGIEDTAGLAPPPGAGLSPLAHSKGRDQRGGGLHPPSPRCSPPPYHPVQRCPRRWESCEGRPHLACSGCPASC

SEQ ID NO: 2674 - protein, 142 aa, Homo sapiens [sequence omitted]

SEQ ID NO: 2675 - protein, 596 aa, Homo sapiens [sequence omitted]

SEQ ID NO: 2676 - protein, 351 aa, Homo sapiens
MTDNTNVNYVRYKGDYYLCTETNFMNKVDIETLEKTEKVDWSKFIAVNGATAHPHYDPDGTAYNMGNSFGPYGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVNKTLKVMKNSFLFELFRDLFFPLN

SEQ ID NO: 2677 - protein, 181 aa, Homo sapiens [sequence omitted]

SEQ ID NO: 2678 - protein, 144 aa, Homo sapiens [sequence omitted]

SEQ ID NO: 2679 - protein, 517 aa, Homo sapiens [sequence omitted]

SEQ ID NO: 2680 - protein, 401 aa, Homo sapiens
MKIQEHPSLSDTKQQRNQDAGDQEESFVSEVPQSDLTALCDEKNWEEPIPAFSSWQRENSDSDEAHLSPQAGRLIRQLLDEDSDPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDMTKDQIANEKVALQKALLYYESIHGRPVTKNERQVMKPLYDRYRLVKQILSRANTIPIIEEEEGSEDDSNVKPDFMVTLKTDFSARCFLDQFEDDADGFISPMDDKIPSKCSQDTGLSNLHAASIPELLEHLQEM

SEQ ID NO: 2681 - protein, 111 aa, Homo sapiens
MGEGGYRLTGWRDVSQAPSPLSSGAHCRLLLFPVCCETDHRPAQRSPRRVPCLCPPRRRHPPRSFTSCTFSGSRSHIHPTWRSPHDVPGSVLAPAAALGNRIGKRSPRVDA

SEQ ID NO: 2682 - protein, 390 aa, Homo sapiens
MFLTQVAYQVGNYELAKKVFSPVWDYFVASPLQDEQSVICLSNIITITQRRLHSDILAETSSILLYLFLRNIFVTSDIKIKEENLFCDNIKGNEIFPSQQIARLIECERVLVALELSNFLNDSSYALQAVTQCYGLLAPIIYHNIVLVPVVQILIKCIVVLQGLPSIVCSKKHTASFESIQHMIACCIFYITKILRSWREYDLAVMIINYGKKMLDITPGCKSLFDGSNEQEEMPEEDSSKKSLKTKKPQQILLPEKINEQLALLETHLLKLTKQYVTSELSGGEDPIFLYPVVLNWSVKGAVKEVMKFKQKPRFLEFFTQVMLKCMNEEKFHLMVEVTTPVHDFLKRRNESLLGLIKVKYKDSALNKKANKSLKFKAAVMEIGRSAEMQ

SEQ ID NO: 2683 - protein, 233 aa, Homo sapiens
MAAGCANLSMSSHPFPAGPPVSAGVPLLLLCAGSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVGSSATGTAYYGLLGITKNVFEAVPVTTGGAPIFDRPFTRTGLLGFIGPDNLVFIVGKLDGLMVTGVRRHNADDVVATALAVEPMKFVYRGR

SEQ ID NO: 2684 - protein, 118 aa, Homo sapiens [sequence omitted]

SEQ ID NO: 2685 - protein, 482 aa, Homo sapiens
MWTVPSFTNDSYQVYNVFSTNSFQLLTVKRTPHEAWRVPLTTKTNKTKGLPDCPKKPTNGPFIVTSILWDNCNAPKAVVLQTLAMGIVIDWAPEGHYWQDCSSKNTLCSEFIYSLDYIEHGWQSYTMRQRVSPYPFKWMDTGIAPPRPKIIHPFFTPEHPELWKLAAALSGIKIWNTTYQLLRTKTKTPTFNITLISEWVIPIRSCVKPPYMLLVGNIIMMPDAQTIECHNCKLFTCIDATFNPTTSILLVRAREGVWIPVSLHRPWESSPSIHIVNEVLKDILKRTKRFIFTLIAVLAGLLAVTATAATAGVAIRSSVQTAHYVEACQKNSSRLWNSQAQIDQKLANQINDLRQSVTWLGDRVMNLQHRMQLQCDWNTSDYCITPYAYNQDQHSWENVSRHLKAWDDNLTLDISQLKEQIFEASQAHLSTVPGSHIFEGITKQLPDFNPFKWLKPVRGSLLLLALLILVCLCCLLLVCRCL

SEQ ID NO: 2686 - protein, 221 aa, Homo sapiens
MAQRLPGQSREVAALQGQLLQGQQPREGAARDEYQVVVAHFQPAQAVQVLESVVQQDYQLVLAQVQQREVVQAREDPGRDELQLVATETQDAQARQVGEGAGLHVRDGVLAQVQLLQRGQRGQVARVQAADAVAAELQQAGLGRDAVGHGGQAAARAGHRAGLHGALAAGRAASSRGRRRGQQEQGQAQDAQPAGHGAERGPRAAPPSSCAPAGGRGSGQR

SEQ ID NO: 2687 - protein, 283 aa, Homo sapiens [sequence omitted]

SEQ ID NO: 2688 - protein, 447 aa, Homo sapiens
MPPFPIIIHDEPTYARSSKNAIKVPIVINPNAYDNLAIYKSFLGTSGELSVKEKTTSVISHTYEEIETESKVPDNTTSKTTDCLQTKGFSNSTEHKRGSVAQKVQEFNNCLNRGQSSPQRSYSSSHSSPAKIQRATQEPVAKIEGTQESQMVGSSSTREKASTVLSQIVASIQPPQSPPETPQSGPKACSVEELYAIPPDADVAKSTPKSTPVRPKSLFTSQPSGEAEAPQTTDSPTTKVQKDPSIKPVTPSPSKLVTSPQSEPPAPFPPPRSTSSPYHAGNLLQRHFTNWTKPTSPTRSTEAESVLHSEGSRRAADAKPKRWISFKSFFRRRKTDEEDDKEKEREKGKLVGLDGTVIHMLPPPPVQRHHWFTEAKGESSEKPAIVFMYRCDPAQGQLSVDQSKARTDQAAVMEKGRAENALLQDSEKKRSHSSPSQIPKKILRYVK

SEQ ID NO: 2689 - protein, 737 aa, Homo sapiens
MCGITCPMCPRREKRQQNIKEGLQFIQSPLSYPGTQEQYAVYLRALVRNLFNEGNDVYREHDWNNSISQYTEALNIADYAKSEEILIPKEIIEKLYINRIACYSNMGFHDKVLEDCNIVLSLNASNCKALYRKSKALSDLGRYKKAYDAVAKCSLAVPQDEHVIKLTQELAQKLGFKIRKAYVRAELSLKSVPGDGATKALNHSVEDIEPDLLTPRQEAVPVVSLPAPSFSHEVGSELASVPVMPLTSILPLQVEESALPSAVLANGGKMPFTMPEAFLDDGDMVLGDELDDLLDSAPETNETVMMNGPGSLFASENFLGISSQPRNDFGNFFGSAVTKPSSSVTPRHPLEGTHELRQACQICFVKSGPKLMDFTYHANIDHKCKKDILIGRIKNVEDKSWKKIRPRPTKTNYEGPYYICKDVAAEEECRYSGHCTFAYCQEEIDVWTLERKGAFSREAFFGGNGKINLTVFKLLQEHLGEFIFLCEKCFDHKPRMISKRNKDNSTACSHPVTKHEFEDNKCLVHILRETTVKYSKIRSFHGQCQLDLCRHEVRYGCLREDECFYAHSLVELKVWIMQNETGISHDAIAQESKRYWQNLEANVPGAQVLGNQIMPGFLNMKIKFVCAQCLRNGQVIEPDKNRKYCSAKARHSWTKDRRAMRVMSIERKKWMNIRPLPTKKQMPLQFDLCNHIASGKKCQYVGNCSFAHSPEEREVWTYMKENGIQDMEQFYELWLKS

SEQ ID NO: 2690 - protein, 444 aa, Homo sapiens
MEKLEEIIEKYPRAFPFWIGPFQAFFCIYDPDYAKTLLSRTDPKSQYLQKFSPPLLGKGLAALDGPKWFQHRRLLTPGFHFNILKAYIEVMAHSVKMMLDKWEKICSTQDTSVEVYEHINSMSLDIIMKCAFSKETNCQTNSTHDPYAKAIFELSKIIFHRLYSLLYHSDIIFKLSPQGYRFQKLSRVLNQYTDTIIQERKKSLQAGVKQDNTPKRKYQDFLDIVLSAKDESGSSFSDIDVHSEVSTFLLAGHDTLAASISWILYCLALNPEHQERCREEVRGILGDGSSITWDQLGEMSYTTMCIKETCRLIPAVPSISRDLSKPLTFPDGCTLPAGITVVLSIWGLHHNPAVWKNPKVFDPLRFSQENSDQRHPYAYLPFSAGSRNCIGQEFAMIELKVTIALILLHFRVTPDPTRPLTFPNHFILKPKNGMYLHLKKLSEC

SEQ ID NO: 2691 - protein, 139 aa, Homo sapiens
MAERCSETSCPVMAGGPRYEYRWQDERQYRRPAKLSAPRYMALLMDWIEGLINDEEVFPTRVGVPFPKNFQQVCTKILTRLFRVFVHVYIHHFDSILSMGAEAHVNTCYKHFYYFIREFSLVDQRELEPLREMTERICH

SEQ ID NO: 2692 - protein, 120 aa, Homo sapiens [sequence omitted]

SEQ ID NO: 2693 - protein, 101 aa, Homo sapiens
MLSRLMSKCWWFLLLLCCSMKALPGCLEGCAFPGQCQLGCPRPCTVPIAIAGPSPGHAGASAGAAGLSRQHSAHAERTRPCFSCAEKLLGYLIFPMCFHNS

SEQ ID NO: 2694 - protein, 922 aa, Homo sapiens
MAPKKEKGGTVNTSSKIWEPSLIAAQFNQNDWQASIAFVVGNQIEDDLLIQSLTVAVQVPQRKLFSMVSWQDILQQINEINTLVGSASSKKAKKPVGGNAPLYYEVLTAAKAIMDSGEKLTLPLIGKLLKFQLLQIKFKDQQRRENEKKVIEDKPKLEKDKGKAKSPKEKKAPSAKPAKGKGKDQPEANAPVKKTTQLKRRGEDDHTNRYMDDEPDDGAQHYIIVVGFNNPQLLAIMAELGIPITSVIKISSENYEPLQTHLAAVNQQQEVLLQSEDLEAEKLKKENAIKELKTFWKYLEPVLNNEKPETNLFDVARLEYMVKAADFPSDWSDGEMMLKLGTDIFENIACLMYDILDWKRQHQHYLESMQLINVPQVVNEKPVLEAMPTSEAPQPAVPAPGKKKAQYEEPQAPPPVTSVITTEVDMRYYNYLLNPIREEFISVPLILHCMLEQVVATEEDLVPPSLREPSPRADGLDHRIAAHIVSLLPSLCLSEREKKNLHDIFLSEEENESKAVPKGPLLLNYHDAHAHKKYALQDQKNFDPVQIEQEMQSKLPLWEFLQFPLPPPWNNTKRLATIHELMHFCTSDVLSWNEVERAFKVFTFESLKLSEVDEKGKLKPSGMMCGSDSEMFNIPWDNPARFAKQIRQQYVMKMNTQEAKQKADIKIKDRTLFVGQNLSMSVQDNESNREPSDPSQCDANNMKHSDLNNLKLSVPDNRQLLEQESIMKAQPQHESPEQTTNNEIKDDAVTKADSHEKKPKKMMVEADLEDIKKTQQRSLMDWSFTEHFKPKVLLQVLQEAHKQYRCVDSYYHTQDHSLLLVFHNPMNRQRLHCEYWNIALHSNVGFRNYLELVAKSIQDWITKEEAIYQESKMNEKIIRTRAELELKSSANAKLTSASKIFSIKESKSNKGISKTEISDQEK

SEQ ID NO: 2695 - protein, 306 aa, Homo sapiens [sequence omitted]

SEQ ID NO: 2696 - protein, 376 aa, Homo sapiens [sequence omitted]

SEQ ID NO: 2697 - protein, 116 aa, Homo sapiens
MRKKHKQKPMISPSNLLRFIYYHENNTGRQDPMIQLPPPGSLPPYIGILGEKFKLRFGRGHSQTILLQINRKPEGGYSEKVVFPWSQAAQWLNYPPTTPAKFPSLLVSFCILMACQ

SEQ ID NO: 2698 - protein, 168 aa, Homo sapiens
MASERPEPEVEEAGQVFLLMKKDYRISRNVRLAWFLSHLHQTVQATPQEMLLQSEQELEVLSVLPPGWQPDEPVVPRPFLLVPSTRVTFLAWQYRFVIELDLSPSTGIVDDSTGEILFDEVFHALSRCLGGLLRPFRVPGSCIDFQPEIYVTIQAYSSIIGLQSHQMI

SEQ ID NO: 2699 - protein, 161 aa, Homo sapiens
MLSSLVSERGTQRLLGKRTRVLKPRVFSPTASALAVACQTSPLIFAFLPASAFVYPRRQDPTVKSERKTSGSRFSSRCCVSQCHLLSSQRQLDVVTDFLGMSKYLAVGLLDHMKMPDYISSATSESSSCSTPSLALNIVDRCLDSQKDKLQCILKDSSTVN

SEQ ID NO: 2700 - protein, 113 aa, Homo sapiens
MRHRARMDPSLGVEANKRMRRHLPNAAVHCTVAHQVPASCWPSAKAEEVSCLVSYRQVLGSPDGDQPSHKTQHHGKPRRRDQVTRGTHSHASCQHRTVHISLQRNSVWVKEAR

SEQ ID NO: 2701 - protein, 254 aa, Homo sapiens
MDILKPGVSYDFRVIVVIALVGLIFILLLVFVLIIRGQSKKYAKKTDSGNSAKSGALGHSEMMSLDESSFPALELNNRRLSVKNSFCRKNGLYTRSPPRPSPGSLHYSDEDVTKYNDLIPAESSSLTEKPSEISDSQGSDSEYEVDSNHQKAHSFVNHYISDPTYYNSWRRQQKGISRAQAYSYTESDSGEPDHTTVTNSTSTQQGSLFRPKASRTPTPQNPPNPPSQQSTLYRPPSSLAPGSRAPIAGFSSFV

SEQ ID NO: 2702 - protein, 109 aa, Homo sapiens
MHYPGAMSAAFPYSATPSGTSISSLSVAGMPATSRFHHTYLPPPYRGPRRTRAGPSRPTRPPTTSTTGHPLAPTSSPWWPAAAVGATAHLPACWPLAPAALPLSPPATS

SEQ ID NO: 2703 - protein, 273 aa, Homo sapiens
MEHAATTGPRPGPPSRRVENVVLRAKDWLPGAPGGTAVWATSLEAEVPPDLALNKEQQLQISKELVDIQITTHHLHEQHEAEIFQLKSEILRLESRVLELELRGDGTSQGCAVPVESDPRHPRAAAQELRHKAQVPGHSDDHRFQVQPKNTMNPENEQHRLGSGVSVQPPSSGERAAPETPSLGSHPASPVCPTAAGGSEVGAGASGGPAAGTGDACVSGHLTWGPILEQREPLIVGLLSLTPVSSGQPWAGSCREPERRPGQPGSDWPHRLW

SEQ ID NO: 2704 - protein, 295 aa, Homo sapiens
MGMTARTKRTRSGSRWWCTRARHGWGARTRSSSTSPLGHPPQVRTIRQTIVKLGNKVQELEKQQVTILATPLPEESMKQELQNLRDEIKQLGREIRLQLKAIEPQKEEADENYNSVNTRMRKTQHGVLSQQFVELINKCNSMQSEYREKNVERIRRQLKITNAGMVSDEELEQMLDSGQSEVFVSNILKDTQVTRQALNEISARHSEIQQLERSIRELHDIFTFLATEVEMQGEMINRIEKNILSSADYVERGQEHVKTALENQKKARKKKVLIAICVSITVVLLAVIIGVTVVG

SEQ ID NO: 2705 - protein, 153 aa, Homo sapiens
MRKGTSSGIRAQGRHKCWLTVKCLWEVPTEWRSGRLSLITDKVVHERRSLTLLPRLEFNGAMISAHCNLRLLGASNSPASASRVAGITESGVNRRLSINAAGQGLFLMPEHRGALDTVFPNQDSIEHKCSEGMSEDAAGCCLSESQLVHGPQH

SEQ ID NO: 2706 - protein, 142 aa, Homo sapiens
MYLWSSFFIPSSVDKQCRPRPPAHGGVLQTAAAAAAAAAAAAEAWLPEELLAGLRKEGSPTYHDHPPAWRKLHASSMDQHGSQSPANAAAHHPCSAAQQPSSHCHIPFPGPPAPMPPRAHGPTHHSSCWPKVGMEGIFQVHF

SEQ ID NO: 2707 - protein, 557 aa, Homo sapiens
MGNSFCYTAVYCMINTGTQMDLEVKGVAATSRSQIQPFFGRKKPLQQRWTSESWTNQNSCPPVVPRLDLGSLVDSDDEDNFSYIPLSTANLPNSSSTLGWVTPCQTPYTQYHLNKLDQNIIPENLPAPTDKCKLKYQQCKTEIKEGYKQYSQRNAENTKSNVTHKQSPRNKIDEKCVQDEEANTDDLTTLDRKAILQQGYADNSCDKQQRARKLDAEIVAAEKKKQIVAEQVMIDHLSRAVISDPEQNLAIEQKESDHILPDSKMTPLRFRKRTLHETKIRTHSTLTENVLSHKLQFDGRIVSRNGRDACRELIGFFFTHDQSLTIYEYRQFGKNRTNVLPFIQKSIYSHQCGRRKGKQYRLGDFYVGATLTFLSSDHLSLPESIKENTLLKLRITNIDQIALDSLKTASMEQEDDIIIQETNDRLVFKAIQDVLKEKLHKRGVRILTGLGKYFQQLDKEGNGLLDKADFKQALKVFHLEVSEKDFESAWLILNDNGNGKVDYGEFKRGIIGEMNEYRKSYVRKAFMKLDFNKSGSVPIINIRKCYCAKKHSQVISG

SEQ ID NO: 2708 - protein, 151 aa, Homo sapiens
MPYETRSRITLLRTQRREECGLHCTSLPSLARDLKFHTTEPNTSRPSSKDIRNRKLCLAADKLSQCPWDLQDVWNEERQLSQCELSGGPQKNVGRRVFPIRQTVLQPRPPKRSNPGLLFSGTECGCILPFLCFLSRYLLTVHMRGLGKLSV

SEQ ID NO: 2709 - protein, 571 aa, Homo sapiens
MAVSASPVISATSSGAGVPGGLFRAEPLYSTPREPPRLTPNMINSFVVNNHSNSAGGGGRGNTNTNECRMVDMHGMKVASFLMDGQELICLPQVFDLFLKHLVGGLHTVYTKLKRLDISPVVCTVEQVRILRGLGAIQPGVNRCKLITRKDFETLFTDCTNASSRPGRPPKRSLGVLQENARLLTHAVPGLLSPGLITPTGITAAAMAEAMKLQKMKLMAMNTLQGNGSQNGTESEPDDLNSNTGGSESSWDKDKMQSPFAAPGPQHGIAHAALAGQPGIGGAPTLNPLQQNHLLTNRLDLPFMMMPHPLLPVSLPPASVAMAMNQMNHLNTIANMAAAAQIHSPLSRAGTSVIKERIPESPSPAPSLEENHRPGSQTSSHTSSSVSSSPSQMDHHLERMEEVPVQIPIMKSPLDKIQLTPGQALPAGFPGPFIFADSLSSVETLLTNIQGLLKVALDNARIQEKQIQQEKKELRLELYREREIRENLERQLAVELQSRTTMQKRLKKEKKTKRKLQEALEFESKRREQVEQALKQATTSDSGLRMLKDTGIPDIEIENNGTPHDSAAMQA

SEQ ID NO: 2710 - protein, 109 aa, Homo sapiens [sequence omitted]

SEQ ID NO: 2711 - protein, 113 aa, Homo sapiens [sequence omitted]

SEQ ID NO: 2712 - protein, 118 aa, Homo sapiens
MPIPESLVCLPPLASSGRPMIPSVSACPNPRVTLSQHFPADPACPRGAVRSPSPAAHPPASVIYAPFVGDGHALTMSLAEGFPPGSPAWCPHCLASARHPHVAHLLLSLVLSINGLRI

SEQ ID NO: 2713 - protein, 188 aa, Homo sapiens [sequence omitted]

SEQ ID NO: 2714 - protein, 595 aa, Homo sapiens
MEVRKLSISWQFLIVLVLILQILSALDFDPYRVLGVSRTASQADIKKAYKKLAREWHPDKNKDPGAEDKFIQISKAYEILSNEEKRSNYDQYGDAGENQGYQKQQQQREYRFRHFHENFYFDESFFHFPFNSERRDSIDEKYLLHFSHYVNEVVPDSFKKPYLIKITSDWCFSCIHIEPVWKEVIQELEELGVGIGVVHAGYERRLAHHLGAHSTPSILGIINGKISFFHNAVVRENLRQFVESLLPGNLVEKVTNKNYVRFLSGWQQENKPHVLLFDQTPIVPLLYKLTAFAYKDYLSFGYVYVGLRGTEEMTRRYNINIYAPTLLVFKEHINRPADVIQARGMKKQIIDDFITRNKYLLAARLTSQKLFHELCPVKRSHRQRKYCVVLLTAETTKLSKPFEAFLSFALANTQDTVRFVHVYSNRQQEFADTLLPDSEAFQGKSAVSILERRNTAGRVVYKTLEDPWIGSESDKFILLGYLDQLRKDPALLSSEAVLPDLTDELAPVFLLRWFYSASDYISDCWDSIFHNNWREMMPLLSLIFSALFILFGTVIVQAFSDSNDERESSPPEKEEAQEKTGKTEPSFTKENSRFL

SEQ ID NO: 2715 - protein, 223 aa, Homo sapiens
MYADLASPVSSASSRSPAPAQTRKEKGKSKKEDGVKEEKRKRDSSTQPPKSAKPPAGGKSSQQPSTPQQAPPGQPQQGTFVAHKEIKLTLLNKAADKGSRKRYEPSDKDRQSPPPAKRPNTSPDRGSRDRKSGGRLGSPKPERQRGQNSKAPAAPADRKRQLSPQSKSSSKVTSVPGKASDPGAASTKSGKASTLSRREELLKQLKAVEDAIARKRAKIPGKA

SEQ ID NO: 2716 - protein, 598 aa, Homo sapiens
MSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 2717 - protein, 122 aa, Homo sapiens
MDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQVGKDIPFFK

SEQ ID NO: 2718 - protein, 570 aa, Homo sapiens
MHQPPESTAAAAAAADISARKMAHPAMFPRRGSGSGSASALNAAGTGVGSNATSSEDFPPPSLLQPPPPAASSTSGPQPPPPQSLNLLSQAQLQAQPLAPGGTQMKKKSGFQITSVTPAQISASISSNNSIAEDTESYDDLDESHTEDLSSSEILDVSLSRATDLGEPERSSSEETLNNFQEAETPGAVSPNQPHLPQPHLPHLPQQNVVINGNAHPHHLHHHHQIHHGHHLQHGHHHPSHVAVASASITGGPPSSPVSRKLSTTGSSDSITPVAPTSAVSSSGSPASVMTNMRAPSTTGGIGINSVTGTSTVNNVNITAVGSFNPNVTSSMLGNVNISTSNIPSAAGVSVGPGVTSGVNVNILSGMGNGTISSSAAVSSVPNAAAGMTGGSVSSQQQQPTVNTSRFRVVKLDSSSEPFKKGRWTCTEFYEKENAVPATEGVLINKVVETVKQNPIEVTSERESTSGSSVSSSVSTLSHYTESVGSGEMGAPTVVVQQQQQQQQQQQQQPALQGVTLQQMDFGSTGPQSIPAVSIPQSISQSQISQVQLQSQELSYLTMKVVLLIVYLCM

SEQ ID NO: 2719 - protein, 140 aa, Homo sapiens [sequence omitted]

SEQ ID NO: 2720 - protein, 138 aa, Homo sapiens [sequence omitted]

SEQ ID NO: 2721 - protein, 186 aa, Homo sapiens
MREDDPKPVGALAGHQDGITFIDSKGDARYLISNSKDQTIKLWDVRRFSSREGMEASRQAATQQNWDYRWQQVPKKAWRKLKLPGDSSLMTYRGHGALHTLIRCRFSPIHSTGQQFIYSGCSTGKVVVYDLLSGHIVKKLTNHKACVRDVSWHPFEEKIVSSSVRLQGLRVLAHVWGLDLGGGSTS

SEQ ID NO: 2722 - protein, 213 aa, Homo sapiens [sequence omitted]

SEQ ID NO: 2723 - protein, 104 aa, Homo sapiens
MMLVRSFASLHHFLLHSHFLCSLFLPCLGDRSLLSTILVPCLLFSNRSGKPHFLFCGEGAKLLNELRVYLAKATASCFVKPGKYVWPQGSGSHFCFETRMGCKP

SEQ ID NO: 2724 - protein, 117 aa, Homo sapiens
MQARDLGLLTARSWYFPLPVDDGDCGHLPFSWMRCPQKLPEGKTPARGSPEMSEGNCWGWGVEREECALDRLRLLRILYVNLCPSLRGCKSPLALATCCSFPSGLWLIRSWLHFSAS

SEQ ID NO: 2725 - protein, 136 aa, Homo sapiens
MHNLPVVLGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 2726 - protein, 141 aa, Homo sapiens
MPGKNAVTLRNRKGFVKLALRHGADLVPIYSFGENEVYKQVIFEEGSWGRWVQKKFQKYIGFAPCIFHGRGLFSSDTWGLVPYSKPITTVVGEPITIPKLEHPTQQDIDLYHTMYMEALVKLFDKHKTKFGLPETEVLEVN

SEQ ID NO: 2727 - protein, 134 aa, Homo sapiens
MSLGSQGVSGGGKCIPQSLGSSLLSPSLLPSFPPRISRESLSAAGGCYPYRSESLVSPLFTRQALAAMDKPPAHSTPPTSALSLAAEGHLDFQLLRVSQKQKDKYNCAGLLYKLQKVSQSPHGSVSDGVRLSRT

SEQ ID NO: 2728 - protein, 905 aa, Homo sapiens [sequence omitted]

SEQ ID NO: 2729 - protein, 326 aa, Homo sapiens
MNVHNLATVFGPNCFHVPPGLEGMKEQDLCNKIMAKILENYNTLFEVEYTENDHLRCENLARLIIVKEVYYKNSLPILLTRGLERDMPKPPPKTKIPKSRSEGSIQAHRVPQPELSDGIPQLSLRLSYRKACLEDMNSAEGAISAKLVPSSQEDERPLSPFYLSAHVPQVSNVFATGELLERTIRSAVEQHLFDVNNSGGQSSEDSESGTLSASSATSARQRRRQSKEQDEVRHGRDKGLINKENTPSGFNHLDDCILNTQEVEKVHKNTFGCAGERSKPKRQKSSTKLSELHDNQDGLVNMESLNSTRSHERTGPDDFEWMSDER

SEQ ID NO: 2730 - protein, 520 aa, Homo sapiens
METWSVEQVCSWLVEKNLGELVHRFQEEEVSGAALLALNDRMVQQLVKKIGHQAVLMDLIKKYKQNTQGLKSPENPKKAALVMQTEAARDYRDEESSSPARHGEQMPSFYPAENLDNGLIDQRVLKQRRNVKQILARSKALQWTKSYVLPEFPYDVKCMLAEQKCPDHSMRIRIIEFLQADMTKYLEGSLYPSTQQYNDVVNALLQAHPFLDEDGCGFFLWKRALKDRFKYVRRPIEDDEQVIRNKCKFGHRRGQTRKSLADIRFDEIKLVQIKEEAVCFDSELDEHIKWFQQEYVKTEKDWREIDKRMSQTLEIRRKMIGSRTPLKDILKLFPFLKCPYQMFREFQLLTRTDIYKKTRHILESYSENILTSFSVVDNPINIVLQEKMKHYTDEDMLKYMKMTATCLLLPDVFGDDPSLFVIMNEQVQVSTPVLEVKNPFNMEVCEFSLYLERERLTKVDDCVTALAALVAGFHVFRIECPRRLSQTFNFLETLIFDMHSPYFPSLKEKENEVGFQHPLT

SEQ ID NO: 2731 - protein, 499 aa, Homo sapiens
MCELYSKRDTLGLRKKHIGPSCKVFFASDPIKIVRAQRQYMFDENGEQYLDCINNVAHVGHCHPGVVKAALKQMELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 2732 - protein, 362 aa, Homo sapiens
MQRQVLKEMEQQLQSSHQLTARLRAQIAMYESELERAHGQMLEEMQSLEEDKNRAIEEAFARAQVENERLRQEMRRCEAELQELRTKPAGPCPGCEHSQESAQLRDKLSQLQLEMAESKGMLSELNLEVQQKTDRLAEVELRLKDCLAEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSA

SEQ ID NO: 2733 - protein, 159 aa, Homo sapiens [sequence omitted]

SEQ ID NO: 2734 - protein, 308 aa, Homo sapiens
MNPIVVVHGGGAGPISKDRKERVHQGMVRAATVGYGILREGGSAVDAVEGAVVALEDDPEFNAGCGSVLNTNGEVEMDASIMDGKDLSAGAVSAVQCIANPIKLARLVMEKTPHCFLTDQGAAQFAAAMGVPEIPGEKLVTERNKKRLEKEKHEKGAQKTDCQKNLGTVGAVALDCKGNVAYATSTGGIVNKMVGRVGDSPCLGAGGYADNDIGAVSTTGHGESILKVNLARLTLFHIEQGKTVEEAADLSLGYMKSRVKGLGGLIVVSKTGDWVAKWTSTSMPWAAAKDGKLHFGIDPDDTTITDLP

SEQ ID NO: 2735 - protein, 514 aa, Homo sapiens [sequence omitted]

SEQ ID NO: 2736 - protein, 202 aa, Homo sapiens
MPWHDIASAVHGKAARDVARHFIQRWNFTKIMKSKYRSLSYPFLLPKSQTTAHELRYQVPGSVHANVQLLRSAADWSAGIKYHEESIHAAYVHVIENSRHYIYIENQFFISCADDKVVFNKIGDAIAQRILKAHSLALSPKLKCSGVILAYCNLHLPGSSNSPASASRVSGITGTRHHTQLIFLYFWWRRGFTMSARLALNS

SEQ ID NO: 2737 - protein, 643 aa, Homo sapiens [sequence omitted]

SEQ ID NO: 2738 - protein, 107 aa, Homo sapiens
MLSKGRSPRRKQVQTQRKAALVLSVTPMVPVGSVWLAMSSVLSAFMRELPGWFLFFGVFLPVTLLLLLLIAYFRIKLIEVNEELSQNCDRQHNPKDGSSLYQRMKWT

SEQ ID NO: 2739 - protein, 585 aa, Homo sapiens [sequence omitted]

SEQ ID NO: 2740 - protein, 119 aa, Homo sapiens
MELPDPVRQRLGNFSRAVFSDTNRTSPESNEGPENEMVSSLALQMSLYFNTYYFPLWWVSSIMMLHMKYSILPDYYKFIVITVIILITLIEAIRLYLGYVGNLQEKVSSFFLSLSDRYK

SEQ ID NO: 2741 - protein, 214 aa, Homo sapiens
MQPTAAGEEAPRGPWVPGSRPGARGATQTPRPALRIAGTGSGRPSRTLQRRETLRRARCPGGQRVRVPACYAQVRPAPRAPPARRALQPLARPPGAHSRRLRRCRICRRSGAPHSAPGQERRSHPRPPAPGPPVRGRRERAPGGSGSPQAPPAAAAAAAPASTQPGSGCSRPTCSRTAVPQTRSRGQDRGRRGCNRTPLAAPSPPASRRSHPGK

SEQ ID NO: 2742 - protein, 111 aa, Homo sapiens [sequence omitted]

SEQ ID NO: 2743 - protein, 344 aa, Homo sapiens
MQFSSLEHEGEYYMTPRDFLFSVMFEQMERKTSVKKLTKKDIEDTLSGIQTAGCGSTFFRDLGDKGLISYTEYLFLLTILTKPHSGFHVAFKMLDTDGNEMIEKREFFKLQKIISKQDDLMTVKTNETGYQEAIVKEPEINTTLQMRFFGKRGQRKLHYKEFRRFMENLQTEIQEMEFLQFSKGLSFMRKEDFAEWLLFFTNTENKDIYWKNVREKLSAGESISLDEFKSFCHFTTHLEDFAIAMQMFSLAHRPVRLAEFKRAVKVATGQELSNNILDTVFKIFDLDGDECLSHEEFLGVLKNRMHRGLWVPQHQSIQEYWKCVKKESIKGVKEVWKQAGKGLF

SEQ ID NO: 2744 - protein, 469 aa, Homo sapiens
MAAEAGVVGAGASPDGDWRDQACGLLLHVHLSSRLGRAAPVRTGRHLRTVFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 2745 - protein, 132 aa, Homo sapiens
MLSPLWLQISKRPRPEVSVSNACFSSALPTSNPTSLTLKHHNIFVLRVALEIIQYSVHGGRNRKPLEVTSLAYSCPENWWQKQIGVQPPDVHASALSPKPCVSWSRPLSLLSSTILFWKTHDERADFSKLHS

SEQ ID NO: 2746 - protein, 105 aa, Homo sapiens
MKGGHSDEETDHFQARTSKNSRFLMCIQMVFFERYLGLKSTCTLSAVYLCYCTRKASFSSVRIPSFNTLLKCRLLQEAFFPPLGSKICFSTHSSLMVLISCHVLF

SEQ ID NO: 2747 - protein, 411 aa, Homo sapiens
MSKDALNLAQMQEQTLQLEQQSKLKQLVNEDLRKQEESVQKHHQTFLESIRAAGTLFGEGFRAFVTDRDKVTATVAGLTLLAVGVYSAKNATAVTGRYIEARLGKPSLVRETSRITVLEALRHPIQQVSRRLLSRPQDVLEGVVLSPSLEARVRDIAIMTRNIKKNRGLYRHILLYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLILASCHPEQFDWAINACIDVMVHFDLPGQEERARLVRMYLNEYVLKPATEGKRRLKLAQFDYGRKCLEIARLTEGMSCRKIAQLAVSWQATAYASKDGVLTEAMMDACVQDFVQQHQQMMRWLKGERPGPEDEQPSS

SEQ ID NO: 2748 - protein, 102 aa, Homo sapiens
MPTFTTSIQHSTGNPSQCNWTRERKGIQISKEEVKLSLFTDDMIAYLENPKDSSKKILDLINKSSKVSGYKINVRKPVALLYTNSNQAENQINYSTPLTTPA

SEQ ID NO: 2749 - protein, 449 aa, Homo sapiens
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLE

SEQ ID NO: 2750 - protein, 104 aa, Homo sapiens [sequence omitted]

SEQ ID NO: 2751 - protein, 207 aa, Homo sapiens [sequence omitted]

SEQ ID NO: 2752 - protein, 179 aa, Homo sapiens
MENSTTLHVRALLQQQDTLATIIDILEYSNKKRLQQLKSELQEWEEKKKCKMSYLEQQAEQLNAKIEKTQEEVNFLSTYMDHEYSIKSVQISTLMRQLQQVKDSQQDELDDLGEMRRKVLESLSDKIQKKKKKILSSVVAETQRPYEEALLQKMWESQDFLKCMQRFREVRGQGRWWSL

SEQ ID NO: 2753 - protein, 190 aa, Homo sapiens
MGRGFRGTGSSPSRERPHSTSPLPDDSLFVASLSSPRAGVGLSRVPLRESGSVLPTYQSSPLVSGDTSWGPFRWLAPVQGLRAWGRGLRVPTCRRGHRQYLRSGPDYDFARYRSTVHGVTQAFAAASREVLAVEAELGGPRRQPLLAGHVRSLQELEQTRLGTVALLQLMETPELAGQEDAVRMQQLKMK

SEQ ID NO: 2754 - protein, 109 aa, Homo sapiens
MTQAGQSSGCTALWFPSMLFSLSLLSNLNQIGSSHLDRPHIPGQSAQLFIYQMSSQQLQQQPSANKKAGKIHNTPFANQLNPTQHLAKPFQQILPGRQSGSLTSPFLAC

SEQ ID NO: 2755 - protein, 819 aa, Homo sapiens
MNNSNGNWKSSVRSTNNWNYSGPGDKFQPGRNRNSNCQMEDMTMLWNKKSNKSNKYSHDRYNWQRQENDKLGTVATYRGPSEGFTSDKFPSEGLLDFNFEQLESQTTKQADTATSKVSGKNGSAAREKPRRWTPYPSQKTLDLQSGLKDITGNKSEMIEKPLFDFSLITTGIQEPQTDETRNSPTQKTQKEIHTGSLNHKASSDSAASFEVVRQCPTAEKPEQEHTPNKMPSLKSPLLPCPATKSLSQKQDPKNISKNTKTNFFSPGEHSNPSNKPTVEDNHGPYISKLRSSCPHVLKGNKSTFGSQKQSGDNLNDTLRKAKEVLQCHESLQNPLLSASKSTRNYAKASRNVEESEKGSLKIEFQVHALEDESDGETSDTEKHGTKIGTLGSATTELLSGSTRTADEKEEDDRILKTSRELSTSPCNPIVRQKESELQMTSAASPHPGLLLDLKTSLEDAQVDDSIKSHVSYETEGFESASLDAELQKSDISQPSGPLLPELSKLGFPASLQRDLTRHISLKSKTGVHLPEPNLNSARRIRNISGHRKSETEKESGLKPTLRQILNASRRNVNWEQVIQQVTKKKQELGKGLPRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLERKN

SEQ ID NO: 2756 - protein, 181 aa, Homo sapiens
MAVVTPEALLWGTVLCGRGWPWALLPASPAPELQHHCRTPEQNTLLEQGTNPRLRSEWLLRLDFFLLILSHMEELGRHWEARGQPCSDPFSFPVIMPHSEFPSAAGLFIQEGASAGQGPSIGILCLRLYDSLSESPPPAHCTCARQVPRGPLLSLMLRVLGCRGPEVTPSSVREGLQWISI

SEQ ID NO: 2757 - protein, 153 aa, Homo sapiens [sequence omitted]

SEQ ID NO: 2758 - protein, 147 aa, Homo sapiens [sequence omitted]

SEQ ID NO: 2759 - protein, 239 aa, Homo sapiens
MCETGYRLAADQHRCEDVDDCILEPSPCPQRCVNTQGGFECHCYPNYDLVDGECVEPVDPCFRANCEYQCQPLNQTSYLCVCAEGFAPIPHEPHRCQMFCNQTACPADCDPNTQASCECHNLPGTFECICGPDSALVRHIGTDCDSGKVDGGDSGSGEPPPSPTPGSTLTPPAVGLVHSGLLIGISIASLCLVVALLALLCHLRKKQGAARAKMEYKCAAPSKEVVLQHVRTERTPQRL

SEQ ID NO: 2760 - protein, 156 aa, Homo sapiens
MGMGPTIQFSSFTDHPQRHSQDRRRGEHRGGWQSWGLRALLLILTHRGSLPQMHRPQVQATTSGSAPGLPSVLIGNGWAHGRSAWDVAWDCCSAGCCVDAFPGALSKASPSPKPARICHSGTFYGSLWGKALALYSPQVALSFLGNLSSVLGLQLL

SEQ ID NO: 2761 - protein, 158 aa, Homo sapiens [sequence omitted]

SEQ ID NO: 2762 - protein, 192 aa, Homo sapiens
MAEQQGRELEAECPVCWNPFNNTFHTPKMLDCCHSFCVECLAHLSLVTPARRRLLCPLCRQPTVLASGQPVTDLPTDTAMLTLLRLEPHHVILEGHQLCLKDQPKSRYFLRQPRVYTLDLGPQPGGQTGPPPDTASATVSTPILIPSHHSLRECFRNPQFRIFAYLMAVILSVTLLLIFSIFWTKQFLWGVG

SEQ ID NO: 2763 - protein, 367 aa, Homo sapiens [sequence omitted]

SEQ ID NO: 2764 - protein, 106 aa, Homo sapiens
MNKLHFVLTLTCHRNLMKAECSLWYKTTLVVGQARWLTPVIPTLWEAKTGGSPEVRSSRPAWPTWQNPIPTKNTKISWVWWHMHVIPATWEAEAQESLELRRWRLQ

SEQ ID NO: 2765 - protein, 447 aa, Homo sapiens [sequence omitted]

SEQ ID NO: 2766 - protein, 763 aa, Homo sapiens
MGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 2767 - protein, 111 aa, Homo sapiens [sequence omitted]

SEQ ID NO: 2768 - protein, 143 aa, Homo sapiens [sequence omitted]

SEQ ID NO: 2769 - protein, 398 aa, Homo sapiens
MPRPGHPRPASGPPRLGPWERPTELCLETYDKPPQPPPSRRTRRPDPKDPGHHGPESITFISGSAEPALESPTCCLLWRPWVWEWCRAAFCFRRCRDCLQRCGACVRGCSPCLSTEDSTEGTAEANWAKEHNGVPPSPDRAPPSRRDGQQLKSTMGSSFSYPDVKLKGIPVYPYPRATSPAPDADSCCKEPLADPPPMRHSLPSTFASSPRGSEEYYSFHESDLDLPEMGSGSMSSREIDVLIFKKLTELFSVHQIDELAKCTSDTVFLEKTSKISDLISSITQDYHLDEQDAEGRLVRGIIRISTRKSRARPQTSEGRSTRAAAPTAAAPDSGHETMVGSGLSQDELTVQISQETTADAIARKLRPYGAPGYPASHDSSFQGTDTDSSGAPLLQVYC

SEQ ID NO: 2770 - protein, 759 aa, Homo sapiens
MLEHKYGGHLVSRRAACTIQTAFRQYQLSKNFEKIRNSLLESRLPRRISLRKVRSPTAESLAAEKALMEGYGLVGLPLVRSPSLPPTFAGTLTKLEDSFTEQVQSLAKSIDDALSTWSLKTMCSLRESGAYQLHQALQAAAGPPGLEAEGRAPESAGPGPGDDAAETPGLPPTHSGTLMMAFRDVTVQIANQNISVSSSTALSVANCLGAHTVQAPAEPAAGKAEQGETSGREAPEAPAVGREDASAEDSCAEAAASGAADGATAPKTEEEEEEEETAEVGRGAEAEAGDLEQLSSSSTSTKSAKSGSEASASASKDALQAMILSLPRYHCENPASCKSPTLSTDTLRKRLYRIGLNLFNINPDKGIQFLISRGFIPDTPIGVAHFLLQRKGLSRQMIGEFLGNSKKQFNRDVLDCVVDEMDFSSMELDEALRKFQAHIRVQGEAQKVERLIEAFSQRYCMCNPEVVQQFHNPDTIFILAFAIILLNTDMYSPNIKPDRKMMLEDFIRNLRGVDDGADIPRELVVGIYERIQQKELKSNEDHVTYVTKVEKSIVGMKTVLSVPHRRLVCCSRLFEVTDVNKLQKQAAHQREVFLFNDLLVILKLCPKKKSSSTYTFCKSVGLLGMQFQLFENEYYSHGITLVTPLSGSEKKQVLHFCALGSDEMQKFVEDLKESIAEVTELEQIRIEWELEKQQGTKTLSFKPCGAQGDPQSKQGSPTAKREAALRERPAESTVEVLINASPARLTILPISRDTIKSYC

SEQ ID NO: 2771 - protein, 174 aa, Homo sapiens [sequence omitted]

SEQ ID NO: 2772 - protein, 122 aa, Homo sapiens
MMRKSLRGSPAKNLTNSWKNGPKPRTDCPTSPAPQLRAPRVPHLAQRPGRRPRRKMMTCCLPYECGVWHPAAQVPTALTPLGWDLPPSSGVKAALGVACYPLFLLFEDGAAPAVAGGVEAVG

SEQ ID NO: 2773 - protein, 757 aa, Homo sapiens [sequence omitted]

SEQ ID NO: 2774 - protein, 673 aa, Homo sapiens [sequence omitted]

SEQ ID NO: 2775 - protein, 531 aa, Homo sapiens
MDLCELHHLDISYNRLHLVPRMGPSGAALGVLILRGNELRSLHGLEQLRNLRHLDLAYNLLEGHRELSPLWLLAELRKLYLEGNPLWFHPEHRAATAQYLSPRARDAATGFLLDGKVLSLTDFQTHTSLGLSPMGPPLPWPVGSTPETSGGPDLSDSLSSGGVVTQPLLHKVKSRVRVRRASISEPSDTDPEPRTLNPSPAGWFVQQHPELELMSSFRERFGRNWLQYRSHLEPSGNPLPATPTTSAPSAPPASSQGPDTAPRPSPPQEEARGPQESPQKMSEEVRAEPQEEEEEKEGKEEKEEGEMVEQGEEEAGEEEEEEQDQKEVEAELCRPLLVCPLEGPEGVRGRECFLRVTSAHLFEVELQAARTLERLELQSLEAAEIEPEAQAQRSPRPTGSDLLPGAPILSLRFSYICPDRQLRRYLVLEPDAHAAVQELLAVLTPVTNVAREQLGEARDLLLGRFQCLRCGHEFKPEEPRMGLDSEEGWRPLFQKTGTSPALDLSAHTPPLFQGKWLCVGECEGGALGRRG

SEQ ID NO: 2776 - protein, 333 aa, Homo sapiens
MFKLCSNKMVSQEGSEVELLVSPGARSEHGRYLQDPIVSIDLSEWLRIIEFLLQGLKVYGSVYHINHGNPFNMEVLVDSWPEYQMVIIRPQKQEMTDDMDSYTNVYRMFSKEPQKSEEVLKNCEIVNWKQRLQIQGLQESLGEGIRVATFSKSVKVEHSRALLLVTEDILKLNASSKSKLGSWAETGHPDDEFESETPNFKYAQLDVSYSGLVNDNWKRGKNERSLHYIKRCIEDLPAACMLGPEGVPVSWVTMDPSCEVGMAYSMEKYRRTGNMARVMVRYMKYLRQKNIPFYISVLEENEDSRRFVGQFGFFEASCEWHQWTCYPQNLVPF

SEQ ID NO: 2777 - protein, 386 aa, Homo sapiens [sequence omitted]

SEQ ID NO: 2778 - protein, 153 aa, Homo sapiens
MYGNAWMPKQKSAAGVGPSRRISAGAVQKGNVGLEPPHRVPPGALPSGAVRRGSQSSRLQNGRSTDSLHCGPGKAADTQCHPMKAARREAVPCKATGAELPKTMGIHLLPQCDLDVRHGVKGDHFGALRFDCPTGFQICMGSVAPAFWPMSPI

SEQ ID NO: 2779 - protein, 159 aa, Homo sapiens
MEQDWQPGEEVTPGPEPCSKGQAPLYPIVHVTELKHTDPNFPSNSNAVGTSSGWNRIGTGCSHTWDWRFSCTQQALLPLLGAWEWSIDTEAGGGRREQSQKPCSNGGPAAAGEGRVLPSPCFPWSTCQAAIHKVCRWQGCTRPALLAPSLATLKEHSYP

SEQ ID NO: 2780 - protein, 536 aa, Homo sapiens [sequence omitted]

SEQ ID NO: 2781 - protein, 221 aa, Homo sapiens
MLNTHQSQEVLKKMHNAFAHLPQGVIWTCQSSHWPRDVHLATNVKIVDWLPQSDLLAHPSIRLFVTHGGQNSVMEAIRHGVPMVGLPVNGDQHGNMVRVVAKNYGVSIRLNQVTADTLTLTMKQVIEDKRYKSAVVAASVILHSQPLSPAQRLVGWIDHILQTGGATHLKPYAFQQPWHEQYLIDVFVFLLGLTLGTMWLCGKLLGVVARWLRGARKVKKT

SEQ ID NO: 2782 - protein, 135 aa, Homo sapiens
MLSVSILHQFACLGFWTFTKPLSQSVLVRVLQRNRTNIYIYVLRNLGWGYIPINVSQCQKNCKLNHYKSRILCTHTHTHTHTENERESERETERERERERDWLKELCSLRIPKIYSLEAEDPGKPMCISSLSLKT

SEQ ID NO: 2783 - protein, 203 aa, Homo sapiens [sequence omitted]

SEQ ID NO: 2784 - protein, 460 aa, Homo sapiens [sequence omitted]

SEQ ID NO: 2785 - protein, 170 aa, Homo sapiens [sequence omitted]

SEQ ID NO: 2786 - protein, 429 aa, Homo sapiens
MCIFHPILSDFFGAAIHIPHPEIACQHVLFQELVTFEDVAVYFIRKEWKRLEPAQRDLYRDVMLENYGNVFSLDRETRTENDQEISEDTRSHGVLLGRFQKDISQGLKFKEAYEREVSLKRPLGNSPGERLNRKMPDFGQVTVEEKLTPRGERSEKYNDFGNSFTVNSNLISHQRLPVGDRPHKCDECSKSFNRTSDLIQHQRIHTGEKPYECNECGKAFSQSSHLIQHQRIHTEEKPYECSDCGKTFSCSSALILHRRIHTGEKPYECNECGKTFSWSSTLTHHQRIHTGEKPYACNECGKAFSRSSTLIHHQRIHTGEKPYECNECGKAFSQSSHLYQHQRIHTGEKPNECMECGGKFTYSSGLIQHQRIHTGENPYECSECGKAFRYSSALVRHQRIHTGEKPLNGIGMSKSSLRVTTELNIREST

SEQ ID NO: 2787 - protein, 143 aa, Homo sapiens [sequence omitted]

SEQ ID NO: 2788 - protein, 457 aa, Homo sapiens
MDRSLRNVLVVSFGFLLLFTAYGGLQSLQSSLYSEEGLGVTALSTLYGGMLLSSMFLPPLLIERLGCKGTIILSMCGYVAFSVGNFFASWYTLIPTSILLGLGAAPLWSAQCTYLTITGNTHAEKAGKRGKDMVNQYFGIFFLIFQSSGVWGNLISSLVFGQTPSQETLPEEQLTSCGASDCLMATTTTNSTQRPSQQLVYTLLGIYTGSGVLAVLMIAAFLQPIRDVQRESEGEKKSVPFWSTLLSTFKLYRDKRLCLLILLPLYSGLQQGFLSSEYTRSYVTCTLGIQFVGYVMICFSATDALCSVLYGKVSQYTGRAVLYVLGAVTHVSCMIALLLWRPRADHLAVFFVFSGLWGVADAVWQTQNNALYGVLFEKSKEAAFANYRLWEALGFVIAFGYSMFLCVHVKLYILLGVLSLTMVAYGLVECVESKNPIRPHAPGQVNQAEDEEIQTKM

SEQ ID NO: 2789 - protein, 128 aa, Homo sapiens [sequence omitted]

SEQ ID NO: 2790 - protein, 247 aa, Homo sapiens [sequence omitted]

SEQ ID NO: 2791 - protein, 234 aa, Homo sapiens [sequence omitted]

SEQ ID NO: 2792 - protein, 299 aa, Homo sapiens
MGGPGGSGLNSSLQGRCRPHSTSACGRGGSLLLRQALIQGLIPGPKGSRTRDPSHWPPPPCRRLVCLSASCSRLICSTPAPRISDILNSVRRGSGTPEAEGPLSAGPPPCLSPALLGPLSSPSPRISDILNSVRRGSGTPEAEGPSPVGPPPCPSPTIPGPLPTPSRKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 2793 - protein, 223 aa, Homo sapiens
MLHNFLLLRNSSLWEYDLEKVPRLEPPASLPGEGLVWGPPGESGAPSAVTVLSSSLRLSSTKRAVKAALADDFDTPRVVDAILGLAHHGNGQLRASLKEPEGPRSPAVFGAIISYFEQFFETVGISLANQQYVSGDGSEATLHGVVDELVRFRQKVRQFALAMPEATGDARRQQLLERQPLLEACDTLRRGLTAHGINIKDRSSTTSTWELLDQRTKDQKSAG

SEQ ID NO: 2794 - protein, 314 aa, Homo sapiens
MLTPAFHFNILKSYITIFNKSANIMLDKWQHLASEGSSRLDMFEHISLMTLDSLQKCIFSFDSHCQERPSEYIATILELSALVEKRSQHILQHMDFLYYLSHDGRRFHRACRLVHDFTDAVIRERRRTLPTQGIDDFFKDKAKSKTLDFIDVLLLSKDEDGKALSDEDIRAEADTFMFGGHDTTASGLSWVLYNLARHPEYQERCRQEVQELLKDRDPKEIEWDDLAQLPFLTMCVKESLRLHPPAPFISRCCTQDIVLPDGRVIPKGITCLIDIIGVHHNPTVWPDPEVLPSPFTTTTPILYFCVCVCEFQGS

SEQ ID NO: 2795 - protein, 256 aa, Homo sapiens
MGLFLLFFVLRVRSNVLKGAIQDRVGLLYQFVGATPYTGMLNAVNLFPVLRAVSDQESQDGLYQKWQMMLAYALHVLPFSVVATMIFSSVCYWTLGLHPEVARFGYFSAALLAPHLIGEFLTLVLLGIVQNPNIVNSVVALLSIAGVLVGSGFLRNIQEMPIPFKIISYFTFQKYCSEILVVNEFYGLNFTCGSSNVSVTTNPMCAFTQGIQFIEKTCPGATSRFTMNFLILYSFIPALVILGIVVFKIRDHLISR

SEQ ID NO: 2796 - protein, 107 aa, Homo sapiens
MSSENEDGTSIRYSLTELFSGEGRSCSVPGSIIEESLVSLSEVLVWVRTSLVSVFMSLMQLSTVCSSSLLTRRLLMGVAPSSSVKTHAKRETSLKVIKITLGGDVGS

SEQ ID NO: 2797 - protein, 308 aa, Homo sapiens
MDFVAGAIGGVCGVAVGYPLDTVKVRIQTEPKYTGIWHCVRDTYHRERVWGFYRGLSLPVCTVSLVSSVSFGTYRHCLAHICRLRYGNPDAKPTKADITLSGCASGLVRVFLTSPTEVAKVRLQTQTQAQKQQRRLSASGPLAVPPMCPVPPACPEPKYRGPLHCLATVAREEGLCGLYKGSSALVLRDGHSFATYFLSYAVLCEWLSPAGHSRPDVPGVLVAGGCAGVLAWAVATPMDVIKSRLQADGQGQRRYRGLLHCMVTSVREEGPRVLFKGLVLNCCRAFPVNMVVFVAYEAVLRLARGLLT

SEQ ID NO: 2798 - protein, 391 aa, Homo sapiens [sequence omitted]

SEQ ID NO: 2799 - protein, 399 aa, Homo sapiens [sequence omitted]

SEQ ID NO: 2800 - protein, 181 aa, Homo sapiens
MKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKQDTKGDYQKALLYLCGGDD

SEQ ID NO: 2801 - protein, 140 aa, Homo sapiens [sequence omitted]

SEQ ID NO: 2802 - protein, 1143 aa, Homo sapiens [sequence omitted]

SEQ ID NO: 2803 - protein, 130 aa, Homo sapiens
MKKRRRESLVKLRSICNHKLQNVAAKQNESWIKVVANIKSEYTPRQSTANAAHLSWILVHLVLTRGCRLTSFHHEGLSFAIAGRGKWSKSVTSSSYRRVSHVISADMLWPKYMTISKELRGEIRTFVWTE

SEQ ID NO: 2804 - protein, 581 aa, Homo sapiens [sequence omitted]

SEQ ID NO: 2805 - protein, 561 aa, Homo sapiens
MITSQGSVSFRDVTVGFTQEEWQHLDPAQRTLYRDVMLENYSHLVSVGYCIPKPEVILKLEKGEEPWILEEKFPSQSHLELINTSRNYSIMKFNEFNKGGKCFCDEKHEIIHSEEEPSEYNKNGNSFWLNEDLIWHQKIKNWEQSFEYNECGKAFPENSLFLVHKRGYTGQKTCKYTEHGKTCDMSFFITHQQTHPRENHYGNECGENIFEESILLEHQSVYPFSQKLNLTPIQRTHSINNIIEYNECGTFFSEKLVLHLQQRTHTGEKPYECHECGKTFTQKSAHTRHQRTHTGGKPYECHECGKTFYKNSDLIKHQRIHTGERPYGCHECGKSFSEKSTLTQHQRTHTGEKPYECHECGKTFSFKSVLTVHQKTHTGEKPYECYACGKAFLRKSDLIKHQRIHTGEKPYECNECGKSFSEKSTLTKHLRTHTGEKPYECIQCGKFFCYYSGFTEHLRRHTGEKPFGCNECGKTFRQKSALIVHQRTHIRQKPYGCNQCGKSFCVKSKLIAHHRTHTGEKPYECNVCGKSFYVKSKLTVHQRIHLGRNPINVVNEGNYSG

SEQ ID NO: 2806 - protein, 378 aa, Homo sapiens
MPRFRTRALAASGGGDHGHPEKVLHTSQRRLPAMEPLKSLFLKSPLGSWNGSGSGGGGGGGGGRPEGSPKAAGYANPVWTALFDYEPSGQDELALRKGDRVEVLSRDAAISGDEGWWAGQVGGQVGIFPSNYVSRGGGPPPCEVASFQELRLEEVIGIGGFGKVYRGSWRGELVAVKAARQDPDEDISVTAESVRQEARLFAMLAHPNIIALKAVCLEEPNLCLVMEYAAGGPLSRALAGRRVPPHVLVNWAVQIARGMHYLHCEALVPVIHRDLKSNNILLLQPIESDDMEHKTLKITDFGLAREWHKTTQMSAAGTYAWMAPEVIKASTFSKGSDVWRCGPWWGWTGCYGAAEGRGGCLNLGLGQVQGQGPKPLGS

SEQ ID NO: 2807 - protein, 742 aa, Homo sapiens
MFLWLFLILSALISSTNADSDISVEICNVCSCVSVENVLYVNCEKVSVYRPNQLKPPWSNFYHLNFQNNFLNILYPNTFLNFSHAVSLHLGNNKLQNIEGGAFLGLSALKQLHLNNNELKILRADTFLGIENLEYLQADYNLIKYIERGAFNKLHKLKVLILNDNLISFLPDNIFRFASLTHLDIRGNRIQKLPYIGVLEHIGRVVESQLEDNPWNCSCDLLPLKAWLENMPYNIYIGEAICETPSDLYGRLLKETNKQELCPMGTGSDFDVRILPPSQLENGYTTPNGHTTQTSLHRLVTKPPKTTNPSKISGIVAGKALSNRNLSQIVSYQTRVPPLTPCPAPCFCKTHPSDLGLSVNCQEKNIQSMSELIPKPLNAKKLHVNGNSIKDVDVSDFTDFEGLDLLHLGSNQITVIKGDVFHNLTNLRRLYLNGNQIERLYPEIFSGLHNLQYLYLEYNLIKEISAGTFDSMPNLQLLYLNNNLLKSLPVYIFSGAPLARLNLRNNKFMYLPVSGVLDQLQSLTQIDLEGNPWDCTCDLVALKLWVEKLSDGIVVKELKCETPVQFANIELKSLKNEILCPKLLNKPSAPFTSPAPAITFTTPLGPIRSPPGGPVPLSILILSILVVLILTVFVAFCLLVFVLRRNKKPTVKHEGLGNPDCGSMQLQLRKHDHKTKKRWTEHRSFHSTNYRTDEQEPHLWLERVRNWVHVFRSSRTESCYEKCGRQGERFITCRYQEETEHN

SEQ ID NO: 2808 - protein, 262 aa, Homo sapiens [sequence omitted]

SEQ ID NO: 2809 - protein, 298 aa, Homo sapiens
MATDMQRKRSSECLDGTLTPSDGQSMERAESPTPGMAQGMEPDGYKVVFVRRSPLVLVAVARTRQSAQELAQELLYIYYQILSLLTGAQLSHIFQQKQNYDLRRLLSGSERITDNLLQLMARDPSFLMGAARCLPLAAAVRDTVSASLQQARARSLVFSILLARNQLVALVRRKDQFLHPIDLHLLFNLISSSSSFREGEAWTPVCLPKFNAAGFFHAHISYLEPDTDLCLLLVSTDREDFFAVSDCRRRFQERLRKRGAHLALREALRTPYYSVAQVGIPDLRHFLYKSKSSGLFTR

SEQ ID NO: 2810 - protein, 795 aa, Homo sapiens
MNMVKRIMGRPRQEECSPQDNALGLMHLRRLFTELCHPPRHMTQKEQEEKLYMMLPVFNRVFGNAPPNTMTEKFSDLLQFTTQVSRLMVTEIRRRASNKSTEAASRAIVQFLEINQSEEASRGWMLLTTINLLASSGQKTVDCMTTMSVPSTLVKCLYLFFDLPHVPEAVGGAQNELPLAERRGLLQKVFVQILVKLCSFVSPAEELAQKDDLQLLFSAITSWCPPYNLPWRKSAGEVLMTISRHGLSVNVVKYIHEKECLSTCVQNMQQSDDLSPLEIVEMFAGLSCFLKDSSDVSQTLLDDFRIWQGYNFLCDLLLRLEQAKEAESKDALKDLVNLITSLTTYGVSELKPAGITTGAPFLLPGFAVPQPAGKGHSVRNVQAFAVLHNAFLKAKTSFLAQIILDAITNIYMADNANYFILESQHTLSQFAEKISKLPEVQNKYFEMLEFVVFSLNYIPCKELISVSILLKSSSSYHCSIIAMKTLLKFTRHDYIFKDVFREVGLLEVMVNLLHKYAALLKDPTQALNEQGDSRNNSSVEDQKHLALLVMETLTVLLQGSNTNAGIFREFGGARCAHNIVKYPQCRQHALMTIQQLVLSPNGDDDMGTLLGLMHSALPTELQLKTDILRALLSVLRESHRSRTVFRKVGGFVYITSLLVAMERSLSCPPKNGWEKVNQNQVFELLHTVFCTLTAAMRYEPANSHFFKTEIQYEKLADAVRFLGCFSDLRKISAMNVFPSNTQPFQRLLEEDVISIESVSPTLRHCSKLFIYLYKVATDSFDRYGSALSSELKGVY

SEQ ID NO: 2811 - protein, 633 aa, Homo sapiens
MLPSSSWGKRKLRGRLGWVRSDARGVMWARQEGLHHPHPHAVIRCPSSSSSSVSCSGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCL

SEQ ID NO: 2812 - protein, 1036 aa, Homo sapiens
MRKHRHLPLVAVFCLFLSGFPTTHAQQQQAVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPGEMGASEVLLGAFSI

SEQ ID NO: 2813 - protein, 143 aa, Homo sapiens [sequence omitted]

SEQ ID NO: 2814 - protein, 699 aa, Homo sapiens
MERHQPRLHHPAQGSAAGTPYPSSASLRGCRESKMPRRKGPQHPPPPSGPEEPGEKRPKFHLNIRTLTDDMLDKFASIRIPGSKKERPPLPNLKTAFASSDCSAAPLEMMENFPKPLSENELLELFERMMEDMNLNEDKKAPLREKDFSIKKEMVMQYINTASKTGSLKRSRQISPQEFIHELKMGSADERLVTCLESLRVSLTSNPVSWVESFGHEGLGLLLDILEKLISGKIQEKVVKKNQHKVIQCLKALMNTQYGLERIMSEERSLSLLAKAVDPRHPNMMTDVVKLLSAVCIVGEESILEEVLEALTSAGEEKKIDRFFCIVEGLRHNSVQLQVACMQLINALVTSPDDLDFRLHIRNEFMRCGLKEILPNLKCIKNDGLDIQLKVFDEHKEEDLFELSHRLEDIRAELDEAYDVYNMVWSTVKETRAEGYFISILQHLLLIRNDYFIRQQYFKLIDECVSQIVLHRDGMDPDFTYRKRLDLDLTQFVDICIDQAKLEEFEEKASELYKKFEKEFTDHQETQAELQKKEAKINELQAELQAFKSQFGALPADCNIPLPPSKEGGTGHSALPPPPPLPSGGGVLPPPPPPPPPPLPGMRMPFSGPVPPPPPLGFLGGQNSPPLPILPFGLKPKKEFKPEISMRRLNWLKIRPHEMTENCFWIKVNENKYENVDLLCKLENTFCCQQKERREEEDI

SEQ ID NO: 2815 - protein, 575 aa, Homo sapiens
MLDHPEDGGEALRAWRASWRLSWEQLQPCLDRAATLASRRDLFFRQALHKARHVLEARQDLSLRPLIWAAVREGCPGPLLATLDQAGAGDPGVAARALACVADVLGCMAEGRGGLRSGPAANPEWMRPFSYLECGDLAAGVEALAQERDKWLSRPALLVRAARHYEGAGQILIRQAVMSAQHFVSTEQVELPGPGQWVVAECPARVDFSGGWSDTPPLAYELGGAVLGLAVRVDGRRPIGARARRIPEPELWLAVGPRQDEMTVKIVCRCLADLRDYCQPHAPGALLKAAFICAGIVHVHSELQLSEQLLRTFGGGFELHTWSELPHGSGLGTSSILAGTALAALQRAAGRVVGTEALIHAVLHLEQVLTTGGGWQDQVGGLMPGIKVGRSRAQLPLKVEVEEVTVPEGFVQKLNDHLLLVYTGKTRLARNLLQDVLRSWYARLPAVVQNAHSLVRQTEECAEGFRQGSLPLLGQCLTSYWEQKKLMAPGCEPLTVRRMMDVLAPHVHGQSLAGAGGGGFLYLLTKEPQQKEALEAVLAKIEGLGNYSIHLVEVDTQGLSLKLLGTEASTCCPFP

SEQ ID NO: 2816 - protein, 128 aa, Homo sapiens
MDGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGK

SEQ ID NO: 2817 - protein, 136 aa, Homo sapiens [sequence omitted]

SEQ ID NO: 2818 - protein, 713 aa, Homo sapiens
MPSTEPRHCYRRMEEDTDYRIRFSSLCFFNGHVGFHGTIKSSPSDFIVIEIDEQGQLVNKTIDEPIFKISEIQLEPNNFPKKPKLDLQNLSLEDGRNQEVHTLIKYTDGDQNHQSGSEKEDTIVDGTSKCEEKADVLSSFLDEKTHELLNNFACDVREKWLSKTELIGLPPEFSIGRILDKNQRASLHSAIRQKFPFLVTVGKNSEIVVKPNLEYKELCHLVSEEEAFDFFKYLDAKKENSKFTFKPDTNKDHRKAVHHFVNKKFGNLVETKSFSKMNCSAGNPNVVVTVRFREKAHKRGKRPLSECQEGKVIYTAFTLRKENLEMFEAIGFLAIKLGVIPSDFSYAGLKDKKAITYQAMVVRKVTPERLKNIEKEIEKKRMNVFNIRSVDDSLRLGQLKGNHFDIVIRNLKKQINDSANLRERIMEAIENVKKKGFVNYYGPQRFGKGRKVHTDQIGLALLKNEMMKAIKLFLTPEDLDDPVNRAKKYFLQTEDAKGTLSLMPEFKVRERALLEALHRFGMTEEGCIQAWFSLPHSMRIFYVHAYTSKIWNEAVSYRLETYGARVVQGDLVCLDEDIDDENFPNSKIHLVTEEEGSANMYAIHQVVLPVLGYNIQYPKNKVGQWYHDILSRDGLQTCRFKVPTLKLNIPGCYRQILKHPCNLSYQLMEDHDIDVKTKGSHIDETALSLLISFDLDASCYATVCLKEIMKHDV

SEQ ID NO: 2819 - protein, 838 aa, Homo sapiens
MWGGGPKKTKIEEARELLASTILTHVPVKEFNFRAKCIYTAVMVRRVILAQGDNKVDDRDYYGNKRLELAGQLLSLLFEDLFKKFNSEMKKIADQVIPKQRAAQFDVVKHMRQDQITNGMVNAISTGNWSLKRFKMDRQGVTQVLSRLSYISALGMMTRISSQFEKTRKVSGPRSLQPSQWGMLCPSDTPEGEACGLVKNLALMTHITTDMEDGPIVKLASNLGVEDVNLLCGEELSYPNVFLVFLNGNILGVIRDHKKLVNTFRLMRRAGYINEFVSISTNLTDRCVYISSDGGRLCRPYIIVKKQKPAVTNKHMEELAQGYRNFEDFLHESLVEYLDVNEENDCNIALYEHTINKDTTHLEIEPFTLLGVCAGLIPYPHHNQSPRNTYQCAMGKQAMGTIGYNQRNRIDTLMYLLAYPQKPMVKTKTIELIEFEKLPAGQNATVAVMSYSGYDIEDALVLNKASLDRGFGRCLVYKNAKCTLKRYTNQTFDKVMGPMLDAATRKPIWRHEILDADGICSPGEKVENKQVLVNKSMPTVTQIPLEGSNVPQQPQYKDVPITYKGATDSYIEKVMISSNAEDAFLIKMLLRQTRRPEIGDKFSSRHGQKGVCGLIVPQEDMPFCDSGICPDIIMNPHGFPSRMTVGKLIELLAGKAGVLDGRFHYGTAFGGSKVKDVCEDLVRHGYNYLGKDYVTSGITGEPLEAYIYFGPVYYQKLKHMVLDKMHARARGPRAVLTRQPTEGRSRDGGLRLGEMERDCLIGYGASMLLLERLMISSDAFEVDVCGQCGLLGYSGWCHYCKSSCHVSSLRIPYACKLLFQELQSMNIIPRLKLSKYNE

SEQ ID NO: 2820 - protein, 111 aa, Homo sapiens
MRGLYRCHRGPGLLKWNPAWSRARPLARGRRRSSKGGAGLKPGSEPALTGAEIRDAAVSTVFYFTMDPSAWGARPGCPSSPGQPDAGTGGTCSGPGPWEGKKGPSRFTCLG

SEQ ID NO: 2821 - protein, 285 aa, Homo sapiens [sequence omitted]

SEQ ID NO: 2822 - protein, 312 aa, Homo sapiens
MANRTVKDAHSIHGTNPQYLVEKIIRTRIYESKYWKEECFGLTAELVVDKAMELRFVGGVYGGNIKPTPFLCLTLKMLQIQPEKDIIVEFIKNEDFKYVRMLGALYMRLTGTAIDCYKYLEPLYNDYRKIKSQNRNGEFELMHVDEFIDELLHSERVCDIILPRLQKRYVLEEAEQLEPRVSALEEDMDDVESSEEEEEEDEKLERVPSPDHRRRSYRDLDKPRRSPTLRYRRSRSRSPRRRSRSPKRRSPSPRRERHRSKSPRRHRSRSRDRRHRSRSKSPGHHRSHRHRSHSKSPERSKKSHKKSRRGNE

SEQ ID NO: 2823 - protein, 225 aa, Homo sapiens
MDPGKDKEGVPQPSGPPARKKFVIPLDEDEVPPGVRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKARRLFDVLHEPFLKVP

SEQ ID NO: 2824 - protein, 282 aa, Homo sapiens
MWSSRGTTSPGPVPGKCRWGILCATTTTALLKMARSLIQAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGRGVPQPPPQLLLRTAHCV

SEQ ID NO: 2825 - protein, 500 aa, Homo sapiens
MKSPRRTTLCLMFIVIYSSKAALNWNYESTIHPLSLHEHEPAGEEALRQKRAVATKSPTAEEYTVNIEISFENASFLDPIKAYLNSLSFPIHGNNTDQITDILSINVTTVCRPAGNEIWCSCETGYGWPRERCLHNLICQERDVFLPGHHCSCLKELPPNGPFCLLQEDVTLNMRVRLNVGFQEDLMNTSSALYRSYKTDLETAFRKGYGILPGFKGVTVTGFKSGSVVVTYEVKTTPPSLELIHKANEQVVQSLNQTYKMDYNSFQAVTINESNFFVTPEIIFEGDTVSLVCEKEVLSSNVSWRYEEQQLEIQNSSRFSIYTALFNNMTSVSKLTIHNITPGDAGEYVCKLILDIFEYECKKKIDVMPIQILANEEMKVMCDNNPVSLNCCSQGNVNWSKVEWKQEGKINIPGTPETDIDSSCSRYTLKADGTQCPSGSSGTTVIYTCEFISAYGARGSANIKVTFISVENCKLLKILMSSSSEIMLSGKTNHSPNYLT

SEQ ID NO: 2826 - protein, 103 aa, Homo sapiens
MAIKLTCSPSLCLPPMYTYIYPFSLTCYYFSLYKYEILGISIWHLFREKICRSLEKNVNFFPTVNCLLFALSFQIVFKVGQYSGSYLEQFLRVDLGLSFEKDL

SEQ ID NO: 2827 - protein, 626 aa, Homo sapiens
MLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNNKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFEVIWVWLLGVLDMKIIICTFSFQI

SEQ ID NO: 2828 - protein, 106 aa, Homo sapiens
MWEGPRTFHALSGLTTIREPPSVQLCGSCLNPPSPLVVVVIVVFEKQGLALSPMLENSGAVLAHCRPNLPASSDPPFSATLSAGITGASHHTQPQWGFYGGFITEA

SEQ ID NO: 2829 - protein, 228 aa, Homo sapiens
MKVIESRAQKDEEKMEIQEIQLKEAKHIAEDADRKYEEVARKLVIIESDLERAEERAELSEGQVRQLEEQLRIMDQTLKALMAAEDKVLMARVVFRFNCNPDIFQLPMPPGSFGITTAPSLHPLLFISCLKCFPLVLYAPLFSLHKCSLGSQKRSQIIALQSCWIWSPCLLLLRGWGAVFLEKLNILIPDDLATLRQPFVSRTQFSFFPIPLLFLSSFLWLVSHPFCL

SEQ ID NO: 2830 - protein, 1045 aa, Homo sapiens
MEGLEEAEANCSVAFAEAQRWVEAVTEKNFETKDFRASLENGVLLCDLINKLKPGVIKKINRLSTPIAGLDNINVFLKACEQIGLKEAQLFHPGDLQDLSNRVTVKQEETDRRVKNVLITLYWLGRKAQSNPYYNGPHLNLKAFENLLGQALTKALEDSSFLKRSGRDSGYGDIWCPERGEFLAPPRHHKREDSFESLDSLGSRSLTSCSSDITLRGGREGFESDTDSEFTFKMQDYNKDDMSYRRISAVEPKTALPFNRFLPNKSRQPSYVPAPLRKKKPDKHEDNRRSWASPVYTEADGTFSRLFQKIYGENGSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLPSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERGQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYS

SEQ ID NO: 2831 - protein, 195 aa, Homo sapiens
MSEKENNFPPLPKFIPVKPCFYQNFSDEIPVEHQVLVKRIYRLWMFYCATLGVNLIACLAWWIGGGSGTNFGLAFVWLLLFTPCGYVCWFRPVYKAFRGWLSAIGFFQYSPGAAVVMLLPAIMFSVSAAMMAIAIMKVHRIYRGAGGSFQKAQTEWNTGTWRNPPSREAQYNNFSGNSLPEYPTVPSYPGSGQWP

SEQ ID NO: 2832 - protein, 162 aa, Homo sapiens [sequence omitted]

SEQ ID NO: 2833 - protein, 361 aa, Homo sapiens
MSCKKQRSRKHSVNEKCNMKIEHYFSPVSKEQQNNCSTSLMRMESRGDPRATTNTQAQRFHSPKKNPEDQTMPQNRTIYVTLKVNHRRNQDMKLKLTHSENSSLYMALNTLQAVRKEIETHQGQEMLVRGTEGIKEYINLGMPLSCFPEGGQVVITFSQSKSKQKEDNHIFGRQDKASTECVKFYIHAIGIGKCKRRIVKCGKLHKKGRKLCVYAFKGETIKDALCKDGRFLSFLENDDWKLIENNDTILESTQPVDELEGRYFQVEVEKRMVPSAAASQNPESEKRNTCVLREQIVAQYPSLKRESEKIIENFKKKMKVKNGETLFELHRTTFGKVTKNSSSIKVVKLLVRLSDSVGYLF

SEQ ID NO: 2834 - protein, 880 aa, Homo sapiens
MMGSYECHCREGFFLSDNQHTCIQRPEEGMNCMNKNHGCAHICRETPKGGIACECRPGFELTKNQRDCKLTCNYGNGGCQHTCDDTEQGPRCGCHIKFVLHTDGKTCIGERRLEQHIPTQAVSNETCAVNNGGCDSKCHDAATGVHCTCPVGFMLQPDRKTCKDIDECRLNNGGCDHICRNTVGSFECSCKKGYKLLINERNCQDIDECSFDRTCDHICVNTPGSFQCLCHRGYLLYGITHCGDVDECSINRGGCRFGCINTPGSYQCTCPAGQGRLHWNGKDCTEPLKCQGSPGASKAMLSCNRSGKKDTCALTCPSRARFLPESENGFTVSCGTPSPRAAPARAGHNGNSTNSNHCHEAAVLSIKQRSPFKIKDAKCRLHLRNKGKTEEAGRITGPGGAPCSECQVTFIHLKCDSSRKGKGRRARTPPGKEVTRLTLELEAEVRAEETTASCGLPCLRQRMERRLKGSLKMLRKSINQDRFLLRLAGLDYELAHKPGLVAGERAEPMESCRPGQHRAGTKCVSCPQGTYYHGQTEQCVPCPAGTFQEREGQLSCDLCPGSDAHGPLGATNVTTCAGQCPPGQHSVDGFKPCQPCPRGTYQPEAGRTLCFPCGGGLTTKHEGAISFQDCDTKVQCSPGHYYNTSIHRCIRCAMGSYQPDFRQNFCSRCPGNTSTDFDGSTSVAQCKNRQCGGELGEFTGYIESPNYPGNYPAGVECIWNINPPPKRKILIVVPEIFLPSEDECGDVLVMRKNSSPSSITTYETCQTYERPIAFTARSRKLWINFKTSEANSARGFQIPYVTYDEDYEQLVEDIVRDGRLYASENHQEILKDKKLIKAFFEVLAHPQNYFKYTEKHKEMLPKSFIKLLRSKVSSFLRPYK

SEQ ID NO: 2835 - protein, 147 aa, Homo sapiens
MYGNTWMSRQRCAAGVEPSWRTSARAVQKGNVGWEPPHSVPIGVLPCGAVRRRPPSSRSRNGRSIESLNCAPKEATDTQCQPRKAARREAVPCKATGAELSVAVGAHLLYQHDLDVKHGVKGDHFGALRFDCPTGFWTCMGPAAPLF

SEQ ID NO: 2836 - protein, 284 aa, Homo sapiens [sequence omitted]

SEQ ID NO: 2837 - protein, 368 aa, Homo sapiens
MAVLLETTLGDVVIDLYTEERPRACLNFLKLCKIKYYNYCLIHNVQRDFIIQTGDPTGTGRGGESIFGQLYGDQASFFEAEKVPRIKHKKKGTVSMVNNGSDQHGSQFLITTGENLDYLDGVHTVFGEVTEGMDIIKKINETFVDKDFVPYQDIRINHTVILDDPFDDPPDLLIPDRSPEPTREQLDSGRIGADEEIDDFKGRSAEEVEEIKAEKEAKTQAILLEMVGDLPDADIKPPENVLFVCKLNPVTTDEDLEIIFSRFGPIRSCEVIRDWKTGESLCYAFIEFEKEEDCEKAFFKMDNVLIDDRRIHVDFSQSVAKVKWKGKGGKYTKSDFKEYEKEQDKPPNLVLKDKVKPKQEYPYQESVS

SEQ ID NO: 2838 - protein, 467 aa, Homo sapiens [sequence omitted]

SEQ ID NO: 2839 - protein, 330 aa, Homo sapiens
MPAWQPAPGVGRRRGRGELRGWPRPAAPGCPSERKVPAASAHVWGQPPRVPSSAACYPCSWREVPCPPARGRQAPPPPDADKPTALQPRGAHLPPPQLWLPPQALLGRPVPQAVPWGAHLPLEAERGQAGLRELLARLAPPHGHSQPSALPGWHQLSWRMSCALWTLLCAPEHGRPCYHTLGLEVIGSEQMWGWPARLAALHHWHCLPWDPLPTCCGHHGGEHSNPRCPEHCPMPTLCTQVQRVRPPQQPQVEGWSPWGLPSGSALAVGVEGPCQDEPPSPRHPLAPSAEQHPASGGLKQSLTPVPSGPGPSLPEPHGVYLRMFPGEVAL

SEQ ID NO: 2840 - protein, 119 aa, Homo sapiens
MSLGLFCIPLPLYTVLPSFPIYSKSVLPPLRRLPRENSDISSFVDTFYLTNKLILIQGRVFPEPCWPAHRNVSSLNLGHSVFENCNHLHQHDIAIRTTGACHHAWLIFCIFSRDGVSPC

SEQ ID NO: 2841 - protein, 340 aa, Homo sapiens [sequence omitted]

SEQ ID NO: 2842 - protein, 461 aa, Homo sapiens
MPAYALLGEFTQAKVIINDTEDEPTLEFDKKIYWVNESAGFLFAPIERKGDASSIVSAICYTVPKSAMGSSLYALESGSDFKSRGMSAASRVIFGPGVTMSTCDVMLIDDSEYEEEQFRVYLGLPLGNHWSGARIGKNNMATITISNDEDAPTIEFEEAAYQVREPAGPDAIAILNIKVIRRGDQNRTSKVRCSTRDGSAQSGVDYYPKSRVLKFSPGVDHIFFKVEILSNEDREWHESFSLVLGPDDPVEAVLGDVTTATVTILDQEAAGSLILPAPPIVVTLADYDHVEEVTKEGVKKSPSPGYPLVCVTPCDPHFPRYAVMKERCSEAGINQTSVQFSWEVAAPTDGNGARSPFETITDNTPFTSVNHMVLDSIYFSRRFHVRCVAKAVDKVGHVGTPLRSNIVTIGTDSAICHTPVVAGTSRGFQAQSFIATLKYLDVKHKEHPNRSGRWCLPPHID

SEQ ID NO: 2843 - protein, 339 aa, Homo sapiens
MGSPSPKTWLSRSSRRSTARSRAFPLSSSQIATRKAYGQALAKLGHASDRIIALDGDTKNSTFSEIFKKEHPDRFIECYIAEQNMVSIAVGCATRNRTAPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 2844 - protein, 347 aa, Homo sapiens
MSFVLSRMAACGGTCKNKVTVSKPVWDFLSKETPARLARLREEHRVSILIDGETSDIYVLQLSPQGPPPAPPNGLYLARKALKGLLKEAEKELKKAQRQGELMGCLALGGGGEHPEMHRAGPPPLRAAPLLPPGARGLPPPPPPLPPPLPPRLREEAEEQESTCPICLGEIQNAKTLEKCRHSFCEGCITRALQVKKACPMCGRFYGQLVGNQPQNGRMLVSKDATLLLPSYEKYGTIVIQYVFPPGVQGAEHPNPGVRYPGTTRVAYLPDCPEGNKVLTLFRKAFDQRLTFTIGTSMTTGRPNVITWNDIHHKTSCTGGPQLFGYPDPTYLTRVQEELRAKGITDD

SEQ ID NO: 2845 - protein, 403 aa, Homo sapiens
MKQRKGQGSGGSRGRKKRGLSDISPSTSLPPLVEGQLRCFLKLTVNRVIWKIAKPPTCVLVRVRWWGETSDGTLFCPRDALQTEPKAVRTTTRYAIRCGPKQFTSYLTDMAVLVLEVITKLDGLPIGRVQINGLAQLSPTHQINGFFTIVSSTSKKLGELQVSLALEPLSETYDSYHPLPTTDMTENVLLSKQGFRENTEPSSTQFQVPSRPRDIHTIKIDGKELAANSSRSTTPRGKDHVCFAENPDTIKDSSFGLQHSLNSGQSLESVTLKGRAPRKQMSLLNSSEFQPQIRTVAKSHSDSCILSSNNLPTKDLLSALLEQGNKLRNAMVISAMKSSPETSMLLDQVHPLLMKILLEHQHRSEPFLGIGLKTTLKITSSLQLRIHFGDMTQKLIPELYSCY

SEQ ID NO: 2846 - protein, 138 aa, Homo sapiens
MGATAVLEMAAATPPARKSLAKDTAASVMLKEEADCCRTGLGREPALTPALRGGAKQMADLYRGSRSWSGRRRRRGRGGVWAPARWAAEPLSGPARRRRSRGGRAGTALRAARARPRHLTRREEGAGPENTRDLNAGP

SEQ ID NO: 2847 - protein, 130 aa, Homo sapiens
MRHRYLDMISRKLEQLERTAEEQRLFLMDREERRQREHTRRKLTLRRKIEEEWKTKEMLLLTRMAEDVKREERIEEQQHRNREESDRKKQDLLEKKMAYHLQKMQDTGFNGEDIGKNTFKYRGQDGTHGE

SEQ ID NO: 2848 - protein, 452 aa, Homo sapiens
MKGHEQESLFKCEVCAERFPTHAKLSSHQRSHFEPERPYKCDFPGCEKTFITVSALFSHNRAHFREQELFSCSFPGCSKQYDKACRLKIHLRSHTGERPFICDSDSCGWTFTSMSKLLRHRRKHDDDRRFTCPVEGCGKSFTRAEHLKGHSITHLGTKPFECPVEGCCARFSARSSLYIHSKKHVQDVGAPKSRCPVSTCNRLFTSKHSMKAHMVRQHSRRQDLLPQLEAPSSLTPSSELSSPGQSELTNMDLAALFSDTPANASGSAGGSDEALNSGILTIDVTSVSSSLGGNLPANNSSLGPMEPLVLVAHSDIPPSLDSPLVLGTAATVLQQGSFSVDDVQTVSAGALGCLVALPMKNLSDDPLALTSNSNLAAHITTPTSSSTPRENASVPELLAPIKVEPDSPSRPGAVGQQEGSHGLPQSTLPSPAEQHGAQDTELSAGTGNFYLV

SEQ ID NO: 2849 - protein, 137 aa, Homo sapiens
MLRFIQEVNTTTRSCALWDLEEDTEYIVHVQAISIQGQSPASEPVLFKTPREAEKMASKNKDEVTMKEMGRNQQLRTGEVLIIVVVLFMWAGVIALFCRQYDIIKDNEPNNNKEKTKSASETSTPEHQGGGLLRSKI

SEQ ID NO: 2850 - protein, 286 aa, Homo sapiens [sequence omitted]

SEQ ID NO: 2851 - protein, 188 aa, Homo sapiens
MAPPWAGGERRGPGTTCLHSPWMLEAAPPWAGGEGRELGAACLHSLRMLEAGGSEAATARGRGDFGAASCSDLAFRCASSQNPRSLEPVASSPERRRRQPSRAFACTLPGCWRLEAVTQQQREATLERPHIATSPSAARPPRAQEARNLWHPSLKGEDGNPAEALLGWGLHDRAGLIKWRPTRGSNPG

SEQ ID NO: 2852 - protein, 297 aa, Homo sapiens
MLQCRPAQEFSFGPRALKDALVSTDAALQQLYVSAFSPAERLFLAEAYNPQRTLFCTLLIRTGFDWLLSRPEAPEDFQTFHASLQHRKPRLARKHIYLQPIDLSEEPVGSSLLHQLCSCTEAFFLGLRVKCLPSVAAASIRCSSRPSRDSDRLQLHTDGILSFLKNNKPGDALCVLGLTLSDLYPHEAWSFTFSKFLPGHGHVPRALPPSGPGELPLAPLPHAGCAQPGRGPAAAPGPLSHLPEEAAACPGFQAHREVPETLHLDSGGGGDVAQPGGGGAVSVGGHPACQRRLGHVL

SEQ ID NO: 2853 - protein, 148 aa, Homo sapiens
MILASGARGPGFKSRTSPPLPFTETRVSSRNMLPDQRCRRLDCKSSMYSKLFCGTAVAESISIPRPAWHVRKRRGTPRLGQVPPFLLPDFLPGVSTRPPQPGFALIDTRQSIVVDDSVRESPGTVKTWFSAVLKALCLFRSLHLTIGA

SEQ ID NO: 2854 - protein, 286 aa, Homo sapiens
MVTHSGDGPYKCKFCGKALDCLSLYLTHERTHTGEKRYECKQCGKAFSWHSSVRIHERTHTGEKPYECKECGKSFNFSSSFRRHERTHTGEKPYKCKECGKAFNCPSSFHRHERTHTGEKPYECKLYGKALSRLISFRRHMRMHTGERPHKCKICGKAFYSPSSFQRHERSHTGEKPYKCKQCGKAFTCSTSFQYHERTHTGEKPDGCKQCGKAFRSAKYIRIHGRTHTGEKPYECKQCGKAFHCVSSFHRHERTHAGEKPYECKHCGKAFTCSIYIRIHERIHTG

SEQ ID NO: 2855 - protein, 118 aa, Homo sapiens
MVPIQTLRISTATLLSIMLCIVRAPHWQKNCFSMVKILKHWTRGCPFREGVYSPVCCCAHLSTSFTQATFLCALTHLEQECLTLTSGILTPLIEVNQASLCHPEETSTCIGKLWRLYP

SEQ ID NO: 2856 - protein, 107 aa, Homo sapiens
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQVKKKNSVTLWL

SEQ ID NO: 2857 - protein, 229 aa, Homo sapiens
MDAVAFEDVAVNFTQEEWALLGPSQKNLYRYVMQETIRNLDCIRMIWEEQNTEDQYKNPRRNLRCHMVERFSESKDSSQCGETFSLIRDSIVNNSICPGEDPCQSAECEEVIMGHLSLNSHIRVDSGHKPHEYQEYGEKPHTHKQRGKAFSYHHSFQSRGRPHTGKKRYECKECGKTFSSRRNLRRHMVVQGGNRPYKFPIEDMRECTLGRNRMNVSSVLKPCLIPVPI

SEQ ID NO: 2858 - protein, 146 aa, Homo sapiens
MAITLTLQTAEMQEGLLAVKVKEEEEEHSCGPESGLSRNNPHTREIFRRRFRQFCYQESPGPREALQRLQELCHQWLRPEMHTKEQILELLVLEQFLTILPEELQAWVRQHRPVSGEEAVTVLEDLERELDDPGEQMARLGLGMWS

SEQ ID NO: 2859 - protein, 112 aa, Homo sapiens
MKLEASCGTATSEVPKPEKKTARDAEPSSETRPQEVEAEPRSGSGPEAEAEPLDFVVATEREFEEVLAISGGIYGGLDYLPSRYHSWLRDPDRTVVLAKRNGGVVSPGARPR

SEQ ID NO: 2860 - protein, 495 aa, Homo sapiens
MQTSFERMLSLKDLEIEQWHKKHKEKIKQKEKERLRNRNCLELKIKDKEKTKHTPTESKNKELTRSKSSEVTDAYTKEKQPKDAVSNRSQSVDTKNVMTLGKSSFVSDNSLNRSPRSENEKPGLSSRSVSMISVASSEDSCHTTVTTPRPPVEYDSDFMLESSESQMSFSQSPFLSIAKSPALHERELDSLADLPERIKPPYANRLSTSHLRSSSVEDVKLIISEGRPTIEVRRCSMPSVICEHTKQFQTISEESNQGSLLTVPGDTSPSPKPEVFSNVPERDLSNVSNIHSSFVTSPTGASNSKYVSADRNLIKNTAPVNTVMDSPVHLEPSSQVGVIQNKSWEMPVDRLETLSTRDFICPNSNIPDQESSLQSFCNSENKVLKENADFLSLRQTELPGNSCAQDPASFMPPQQPCSFPSQSLSDAESISKHMSLSYVANQEPGILQQKNAVQIISSALDTDNESTKDTENTFVLGDVQKTDAFVPVYSDSTIQ

SEQ ID NO: 2861 - protein, 127 aa, Homo sapiens
MCSAYPPTVTSVVEPLTSQGSIWEGEKSTHSIWGCCSSHISLPGGMWGCLPPCPPSADVPPLRLSRCHLTQAAVQRQAGKPKPHSQGGPQPPESRFSRGYDLRRLRGKTGGKEKSYNCQEWGTFPCP

SEQ ID NO: 2862 - protein, 292 aa, Homo sapiens [sequence omitted]

SEQ ID NO: 2863 - protein, 104 aa, Homo sapiens [sequence omitted]

SEQ ID NO: 2864 - protein, 110 aa, Homo sapiens
MLPSLTSALGPSQHRAQHSPSLPPSRFQHILYFSFFFLETESQLLPRLECRGMMSAHCNLLLLGSRDCFASASRVAAITGTRHHARLIFVFLVEMGFHHVSQAGLELLTL

SEQ ID NO: 2865 - protein, 456 aa, Homo sapiens
MRKLKYKHLAFLAESCATLSQEQHSQELLAELLTHLERRWTEIEDSHTLVTVMMKVGHLSEPLMNRLEDKCLELVEHFGPNELRKVLVMLAAQSRRSVPLLRAISYHLVQKPFSLTKDVLLDVAYAYGKLSFHQTQVSQRLATDLLSLMPSLTSGEVAHCAKSFALLKWLSLPLFEAFAQHVLNRAQDITLPHLCSVLLAFARLNFHPDQEDQFFSLVHEKLGSELPGLEPALQVDLVWALCVLQQAREAELQAVLHPEFHIQFLGGKSQKDQNTFQKLLHINATALLEYPEYSGPLLPASAVAPGPSALDRKVTPLQKELQETLKGLLGSADKGSLEVATQYGWVLDAEVLLDSDGEFLPVRDFVAPHLAQPTGSQSPPPGSKRLAFLRWEFPNFNSRSKDLLGRFVLARRHIVAAGFLIVDVPFYEWLELKSEWQKGAYLKDKMRKAVAEELAK

SEQ ID NO: 2866 - protein, 1131 aa, Homo sapiens
MQVNTLFETSQVPDWSDPPQVQVQETVRETISCSQMPAFSEPAGEESPFTGTTTISFSNLGGVHKENASLAQHSEVKPCTCGPQQEEKQDRDGNIPDNFREDLKYEQSISEANDETMSPGVFSRHLPKYARADFREPVAVSVASPEPTDTALTLENVCDEPRDREAVCAMECFEASDQGTCFDTIDSLVGTPVDNYSPQEICSVDTELAEGQNKVSDLCSSNDKTLEVFFQTQVSETSVSTCKSSKDGNSVMSPLFISTFTLNISHTASEGATGENLAKVEKSTYPLASTVHAGQEQPSPSNSGGLDETQLLSSENNPLVQFKEEGDKSPSPSAADTTATPASYSSIVSFPWEKPTTLTANNECFQATRETVTIATEVHPAKYLAVSIPEDKHAGGTEERFPRASHEKVSQFPSQVQVDHILSGATIKSTKELLCRAPSVPGVPHHVLQLPEGEGFCSNSPLQVDNLSGDKSQTVDRADFRSYEENFQERGSETKQGVQQQSLSQQGSLSAPDFQQSLPTTSAAQEERNLVPTAPSPASSREGAGQRSGWGTRVSVVAETAGEEDSQALSNVPSLSDTLLEESKEYRPGNWEAGNKLKIITLEASASEIWPPRQLTNSESKASDGGLIIPDKVWAVPDSLKADAVVPELAPSEIAALAHSPEDAESALADSRESHKGEEPTISVHWRSLSSRGFSQPRLLESSVDPVDEKELSVTDSLSAASETGGKENVNNVSQDQEEKQLKMDHTAFFKKFLTCPKILESSVDPIDEISVIEYTRAGKPEPSETTPRGAREGGQSNDGNMGHEAEIQSAILQVPCLQGTILSENRISRSQEGSMKQEAEQIQPEEAKTAIWQVLQPSEGGERIPSGCSIGQIQESSDGSLGEAEQSKKDKAELISPTSPLSSCLPIMTHSSLGVDTHNSTGQIHDVPENDIVEPRKRQYVFPVSQKRGTIENERGKPLPSSPDLTRFPCTSSPEGNVTDFLISHKMEEPKIEVLQIGETKPPSSSSSSAKTLAFISGERELEKAPKLLQDPCQKGTLGCAKKSREREKSLEARAGKSPGTLTAVTGSEEVKRKPEAPGSGHLAEGVKKKILSRVAALRLKLEEKENIRKNSAFLKKMPKLETSLSHTEE

SEQ ID NO: 2867 - protein, 154 aa, Homo sapiens
MEIMPMNIVSIISPLIDVSPGRRGRLKNAGGGIRLAERVNRRADRNVLRREKGLALGRVTFPRAGRGSRVSAPARSEPGPAAVPGGVRRADDRKFPPGASQPAFRSRRFQAAAGGPSYANDPTSSAKPVKLLPRERAGLKVTNFSQSREREGSA

SEQ ID NO: 2868 - protein, 487 aa, Homo sapiens
MDFSQEEWELLVPAQKNLYREVMLENYRNVVSLEALKNQCTDVGIKEGPLSPAQTSQVTSLSSWTGYLLFQPVASSHLEQREALWIEEKGTPQASCSDWMTVLRNQDSTYKKVALQEEPASGINMIKLIREDGGWKQLEDSHEDPQGLLSQKASLHVVAVPQEKATAWHGFGENGNLSPALVLSQGSSKGNHLCGSELDITSLASDSVLNHHQLGYADRRPCESNECGNAIRQNSHFIQHGGKMFVYLENGQSLNHGMALTIHNKINTAEKPFECHQCGKVFNRRHSLSEHQRIHTGEKPYECQECGRAFTHSSTLTRHLRTHTGEKPYGCGECGKAFNRISSLTQHQRIHTGEKPYKCEDCGKSFCQSSYLILHKRTHTGEKPYECSECGKAFSDRSSLNQHERTHTGENPYECKQCGRAFSQRSSLVRHERTHTGEKPYRCQECGKAFSQSSSLVTHQKTHSSQKTYKIIDCGKAFYQNRHLIGY

SEQ ID NO: 2869 - protein, 100 aa, Homo sapiens [sequence omitted]

SEQ ID NO: 2870 - protein, 143 aa, Homo sapiens
MKLLKYFDLNLPPICFLCILPVPDLDIFKEYRLLILFFGGGEFFGGFVFWFLVLFLETGLCCIAQAGIQWRDDSSLQPRTPGLKGPSCFSLPSSWDYRPAPPRPGNFLFFVEMGCSMLPSVVSNSWAQEILPLLLPKVLGLQA

SEQ ID NO: 2871 - protein, 179 aa, Homo sapiens [sequence omitted]

SEQ ID NO: 2872 - protein, 106 aa, Homo sapiens
MQPQILQQEGCCELMRSAFAPGLCQCLYEPQAVLLPLPLGLSFPPARKFSYLSDLSHSYHRTLSFPSPGRIFLREGTTEHFSALPSSLGSSGLTWMTPHLLNLPMS

SEQ ID NO: 2873 - protein, 477 aa, Homo sapiens
MLSSGRHQDLLVFDADKKPLPPVQSDKKIEAKACVSSPPRNSLSTAAVKETVWNCPSKKQKEPQQKICKKPNLVVKPLQLQVETNKSELNLAMANHDIPPDAVPNKKLCRLPPLDTSSLIGVFVEYIISPSQFYIRIYSRDSSELLEDMMIEMRRCYSNQLVSDRYVMPECFIQPGHLCCVRISEDKWWYRVIIHRVLEKQEVEVFYPDFGNIGIVQKSSLRFLKCCYTKLPAQAIPCSLAWVRPVEEHWTSKAILQFQKLCGLKPLVGVVDEYVDGILNIFLCDTSSNEDVYFHHVLRTEGHAIVCRENISSKGFSELNPLALYTTSSGGPEDIVLTELGYPSQQHYFNEDRKISPQSKESELRILDEIPTGMPCLESVTIGDDIWDENWLPLQAKMGKGGDAASHLFTASLGGKNQYSSCKEMPQKDWCFSTPKDTWDDSWQPSGLVNGTKVEVHKPEVLGAQEKILAQTGLKSN

SEQ ID NO: 2874 - protein, 105 aa, Homo sapiens
MPRLRGGIWPGPSSSSCPRQAPAQTRPPASHPDLRFPPQPPAQALDTRPAPASVPGPHAASRPSDLRPASPRPAPTRPPAGPFFSWARTSPWSRAAAAAPAASSG

SEQ ID NO: 2875 - protein, 113 aa, Homo sapiens [sequence omitted]

SEQ ID NO: 2876 - protein, 580 aa, Homo sapiens
MHLSAVFNALLVSVLAAVLWKHVRLREHAATLEEELALSRQATEPAPALRIDYPKALQILMEGGTHMVCTGRTHTDRICRFKWLCYSNEAEEFIFFHGNTSVMLPNLGSRRFQPALLDLSTVEDHNTQYFNFVELPAAALRFMPKPVFVPDVALIANRFNPDNLMHVFHDDLLPLFYTLRQFPGLAHEARLFFMEGWGEGAHFDLYKLLSPKQPLLRAQLKTLGRLLCFSHAFVGLSKITTWYQYGFVQPQGPKANILVSGNEIRQFARFMTEKLNVSHTGVPLGEEYILVFSRTQNRLILNEAELLLALAQEFQMKTVTVSLEDHTFADVVRLVSNASMLVSMHGAQLVTTLFLPRGATVVELFPYAVNPDHYTPYKTLAMLPGMDLQYVAWRNMMPENTVTHPERPWDQGGITHLDRAEQARILQSREVPRHLCCRNPEWLFRIYQDTKVDIPSLIQTIRRVVKGRPGPRKQKWTVGLYPGKVREARCQASVHGASEARLTVSWQIPWNLKYLKVREVKYEVWLQEQGENTYVPYILALQNHTFTENIKPFTTYLVWVRCIFNKILLGPFADVLVCNT

SEQ ID NO: 2877 - protein, 351 aa, Homo sapiens
MLRHMLQLQCNAQAMTTIQHTGPKGSIVTDSRQVRLATGIFPVISLLNHSCSPNTSVSFISTVATIRASQWIRKGQEILHCYGPHKSRMGVAERQQKLRSQYFFDCACPACQTEAHRMAAGPRWEAFCCNSCGAPMQGDDVLRCGSRSCAESAVSRDHLVSRLQDLQQQVRVAQKLLRDGELERAVQRLSGCQRDAESFLWAEHAVVGEIADGLARACAALGDWQKSATHLQRSLCVVEVRHGPSSVEMGHELFKLAQIFFNGFAVPEALSTIQKAEEVLSLHCGPWDDEIQELQKMKSCLLDLPPTPVGPALWGSRRILTHRKGAHGTQVKEVLLPGMVAHACNPSTLGG

SEQ ID NO: 2878 - protein, 161 aa, Homo sapiens
MPEPPTPSVGSCAARASRMSAAPCSRAPSPIDHPRAEECGRAARDWQAAPPAAPVRDPLGEASWAPESGEDMENLYVQLKLQSVGTCFNREELPSVLQWPQGEELGATSVTNKPGLSAMRKETDQQVGERKLTYCGDQVTLFTDQALSQILSSEEGRIKVM

SEQ ID NO: 2879 - protein, 115 aa, Homo sapiens
MVGGTGHHNPSPCTHSSRAEWSLNPGCLCCELKFKQNKNRELRWGWGGGRTRQHETSSWYKWPFLIAIYIPGCFYQPRARDSPQSNLLPECCGGCAILGAKFSQVAILSAFFSPG

SEQ ID NO: 2880 - protein, 463 aa, Homo sapiens
MDALELALKCSSLLKRTMIREGKEHDLSVSSDSTHVTFYGLLRANNLHSGDNFQLNDSEIERQHFKDQDMYSDKSDKENDQEHDESDNEVMGKSEESDTDTSERQDDSYIEPEPVEPLKETTYTEQSHEELGEAGEASQTETVSEENKSLIWTLLKQVRPGMDLSKVVLPTFILEPRSFLDKLSDYYYHADFLSEAALEENPYFRLKKVVKWYLSGFYKKPKGLKKPYNPILGETFRCLWIHPRTNSKTFYIAEQVSHHPPISAFYVSNRKDGFCLSGSILAKSKFYGNSLSAILEGEARLTFLNRGEDYVMTMPYAHCKGILYGTMTLELGGTVNITCQKTGYSAILEFKLKPFLGSSDCVNQISGKLKLGKEVLATLEGHWDSEVFITDKKTDNSEVFWNPTPDIKQWRLIRHTVKFEEQGDFESEKLWQRVTRAINAKDQTEATQEKYVLEEAQRQAARD

SEQ ID NO: 2881 - protein, 149 aa, Homo sapiens
MQEIHEKVLNEVVGAMMYHTFSLTREDLENFKALRVIVQVGSGYDNVAIKAAGELEIAVCSIPSAAVEETADSTTGHILNLYWGNRSLYQALREGTRVQSVEQIGEVASVKARIRGEILGLIGFGRTQQEVAVRAKAFAGWDRAVPGCA

SEQ ID NO: 2882 - protein, 422 aa, Homo sapiens [sequence omitted]

SEQ ID NO: 2883 - protein, 118 aa, Homo sapiens
MFLYPTLNQWDDFLFSFAISLTCGDSEDPPADVAIELKAVFTDRQLLRNSCISGERGEEQSAIPYFPFIPDQPFRVSTSSASAPATGRLIMFDLPSVCQEHLKQPEFLHVQEICHPMV

SEQ ID NO: 2884 - protein, 213 aa, Homo sapiens
MGQGGGHTSQSLTSCGSRPLAAAVGARIRLWEAPAWLTPPVPVCLCASTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPGRAGTAPPTRELETGPAPHGARRPL

SEQ ID NO: 2885 - protein, 132 aa, Homo sapiens [sequence omitted]

SEQ ID NO: 2886 - protein, 199 aa, Homo sapiens [sequence omitted]

SEQ ID NO: 2887 - protein, 113 aa, Homo sapiens
MWKVKVINLGSIHMALILQVCRMQKLRGHAFSHLHFKGCCERPPQRAPSRARSSGATRVGPPPRPQNGRAIIVQCQLGRTAGMRLQPVRSATWAEPSKTTGAELPEASGVQIP

SEQ ID NO: 2888 - protein, 164 aa, Homo sapiens [sequence omitted]

SEQ ID NO: 2889 - protein, 504 aa, Homo sapiens [sequence omitted]

SEQ ID NO: 2890 - protein, 132 aa, Homo sapiens
MYNSVLPTGGRPLFLQVGANYTFTQIAADRVAAADGHYDVLFIGTDVGTVLKVISVPKGSRPSAEGLLLEELHVFEDSAAVTSMQISSKRAVPAARRKEWRPQHVVLRRLVSSRAAGTQGVRRGGQQRLSGV

SEQ ID NO: 2891 - protein, 287 aa, Homo sapiens
MSQGPPTGESSEPEAKVLHTKRLYRAVVEAVHRLDLILCNKTAYQEVFKPENISLRNKLRELCVKLMFLHPVDYGRKAEELLWRKVYYEVIQLIKTNKKHIHSRSTLECAYRTHLVAGIGFYQHLLLYIQSHYQLELQCCIDWTHVTDPLIGCKKPVSASGKEMDWAQMACHRCLVYLGDLSRYQNELAGVDTELLAERFYYQALSVAPQIGMPFNQLGTLAGSKYYNVEAMYCYLRCIQSEVSFEGAYGNLKRLYDKAAKMYHQLKKCETRKLSPGKKRCKDIKGC

SEQ ID NO: 2892 - protein, 252 aa, Homo sapiens
MEDGVAGPQLGAAAEAAEAAEARARPGVTLRPFAPLSGAAEADEGGGDWSFIDCEMEEVDLQDLPSATIACHLDPRVFVDGLCRAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 2893 - protein, 145 aa, Homo sapiens
MASSDIQVKELEKRASGQAFELILSPRSKESVPEFPLSPPKKKDLSLEEIQKKLEAAEERRKSQEAQVLKQLAEKREHEREVLQKALEENNNFSKMAEEKLILKMEQIKENREANLAAIIERLQEKERHAAEVRRNKELQVELSG

SEQ ID NO: 2894 - protein, 178 aa, Homo sapiens
MDSNKYIEHLLTQLEEQHRSLWREKLAVARLQREVAQRTSEGAMHEKLIHELEEERHLRLQSEKRLQEVTLESERNRIQMRSLQQQFSRMEETVRNLLQSQGSPEQKKEETVNIMVYQEKLSEEERKHKEALEDLHMVVDEDSRSESSSTDEGKEKTKLLLERLKALEKHGWNWRPLS

SEQ ID NO: 2895 - protein, 105 aa, Homo sapiens
MISFNSISHIQVILMEGVGSHGLEQLRPCGFAGYSLSPSCFHGLVLSVCGFSRRTVQAVGGSIILGSGGWWSSSPSSTRQCPSRDSVWGLPLHISLLHCPSRGSP

SEQ ID NO: 2896 - protein, 144 aa, Homo sapiens
MTAFVISFLSFSGGGGTRRGDLNICKIVCGLGVGRKPERGGGGRSWCVPGGSRAGGRRGAGPPQSPSGGDSRASRSAPDKQARSSGKRGLQPQRKGKCWLFSAPLHAGSRGWWFFPHRTTAFFSWASRAYNLIGTVSFKFRISP

SEQ ID NO: 2897 - protein, 119 aa, Homo sapiens
MSVMLILNYRIPRILYCCSSKPFAVEVSLWIGRVKQEQLIQFLWLENEQYMLPVLMMFPHVDGEAGTKMTKLEQQDLVNPELTNNSSSGMEAKEEVPGKAKAQICESVCHVLGKIETFQ

SEQ ID NO: 2898 - protein, 478 aa, Homo sapiens
MDHTAFFKKFLTCPKILESSVDPIDEISVIEYTRAGKPEPSETTPRGAREGGQSNDGNMGHEAEIQSAILQVPCLQGTILSENRISRSQEGSMKQEAEQIQPEEAKTAIWQVLQPSEGGERIPSGCSIGQIQESSDGSLGEAEQSKKDKAELISPTSPLSSCLPIMTHSSLGVDTHNSTGQIHDVPENDIVEPRKRQYVFPVSQKRGTIENERGKPLPSSPDLTRFPCTSSPEGNVTDFLISHKMEEPKIEVLQIGETKPPSSSGSSAKTLAFISGERELEKAPKLLQDPCQKGTLGCAKKSREREKSLEARAGKSPGTLTAVTGSEEVKRKPEAPGSGHLAEGVKKKILSRVAALRLKLEEKENIRKNSAFLKKMPKLETSLSHTEEKQDPKKPSCKREGRAPVLLKKIQAEMFPEHSGNVKLSCQFAEIHEDSTICWTKDSKSIAQVQRRCDVFPWLLFTVVACLFHNMVVKKKKE

SEQ ID NO: 2899 - protein, 459 aa, Homo sapiens [sequence omitted]

SEQ ID NO: 2900 - protein, 164 aa, Homo sapiens
MNVLVWEDCIAEQAEVLHNDSYGVIIDCSPKGMFSLNCASQSACHGHTMFSWSEQNGQMVEMIRSMARVPIIWKHGGIVAPQPQMIWPAVGAKHKDLWKLLMALNKIKIWERIKKHLEGHSRNLDIAKLKEQIFKASQAHLTLMPGTGVLEGAADGLAAINPLK

SEQ ID NO: 2901 - protein, 114 aa, Homo sapiens [sequence omitted]

SEQ ID NO: 2902 - protein, 148 aa, Homo sapiens
MRTAEAGQIACDELFTNEAEEYSLYEAVKFLMLNRAIELYNDKEKGKEVPFFSVLLFARDTSNDPGQLLRNHLNQVGHTGGLEQVEMFLLAYAVRHTIQVYRLSKYNTEEFITVYPTDPPKDWPVVTLIAEDDRHYNIPVRVCEETSL

SEQ ID NO: 2903 - protein, 109 aa, Homo sapiens
MFFLLASHIFLGLEISFLILILAATLHDSLRSAHSSREPCFLPSTLHTGVHGYTYMHTHMHTHMHTHVHTCTRTHTHTYTHTHPLLGVSLLLHSGLSPTFESGEGEQQL

SEQ ID NO: 2904 - protein, 638 aa, Homo sapiens
MTDPMMDFFDDANLFGETLEGLSDDAFVQPGPVSLVDELNLGAEFEPLHIDSLNHVQGTPTHQKMTDFEQLNQFDSIKFHHVNQSFGSPAEHVLSPHSQFNCSPIHPQNQPNGLFPDVSDGSPMWGHQTATTISNQNGSPFHQQGHSHSMHQNKSFVAHHDFALFQANEQQTQCTSLRSQQNRNNLNPGQNSLSQSKNFMNVSGPHRVNVNHPPQMTNASNSQQSISMQQFSQTSNPSAHFHKCSSHQEGNFNGPSPNMTSCSVSNSQQFSSHYSFSSNHISPNSLLQSSAVLASNHTNQTLSDFTGSNSFSPHRGIKQESTQHILNPNTSLNSNNFQILHSSHPQGNYSNSKLSPVHMNFPDPVDSGTQMGHFNDHVETNGFSSLEENLLHQVESQTEPFTGLDPEDLLQEGLLPHFDESTFGQDNSSHILDHDLDRQFTSHLVTRPSDMAQTQLQSQARSWHSSFSNHQHLHDRNHLCLQRQPPSSKKSDGSGTYTKLQNTQVRVMSEKKQRKKVESESKQEKANRIISEAIAKAKERGGRNIPRVMSPENFPTASVEGKEEKKGRRMKSKPKDKDSKKTKTCSKLKEKTKIGKLIITLGKKQKRKNESSDEISDAEQMPQHTLKDQDSQKRRSNR

SEQ ID NO: 2905 - protein, 186 aa, Homo sapiens [sequence omitted]

SEQ ID NO: 2906 - protein, 194 aa, Homo sapiens [sequence omitted]

SEQ ID NO: 2907 - protein, 117 aa, Homo sapiens
MVLPPSSEKVKSLSQTPRVEASGRGSWQEMGLVERLLLCFHSRPVASLLRQLPSGHHWQLLHDPASQGLPAFSLKLPYSLVVSLLVFVRLWEEEIHFKSAETCYQATAVIKSNLMSE

SEQ ID NO: 2908 - protein, 157 aa, Homo sapiens [sequence omitted]

SEQ ID NO: 2909 - protein, 129 aa, Homo sapiens [sequence omitted]

SEQ ID NO: 2910 - protein, 113 aa, Homo sapiens
MHHHTPLIFVFLVEMGFHHVGQAGLKLLTSGDPSASAFQSAGITGVCHHARPDYQIFLLIVSLVMAILRLLPSTDNCYLVLILFKRQFIISYRTLTGVLESKSLITLEIGLLE

SEQ ID NO: 2911 - protein, 391 aa, Homo sapiens
MFIASLTIWLLCRNIVQKPVTDEAAQSNPEFENEELAEGEKIDSEEALIYEEDFNGGDGVEGELEESTKLKMFRRLASVASKLKEFIGNMITTAGKVVVTILLGSSGMMLPSLTSSVYFFVFLGLCTWWSWCRTFDPLLFSCLCVLLAIFTAGHLIGLYLYQFQFFQEAVPPNDYYARLFGIKSVIQTDCSSTWKIIVNPDLSWYHHANPILLLVMYYTLATLIRIWLQEPLVQDEGTKEEDKALACSPIQITAGRRRSLWYATHYPTDERKLLSMTQDDYKPSDGLLVTVNGNPVDYHTIHPSLPMENGPGKADLYSTPQYRWEPFDESSEKREEEEEEKEEFEEERSREEKRSIKVHAMVSVFQFIMKQSYICALIAMMRPGASPITAG

SEQ ID NO: 2912 - protein, 112 aa, Homo sapiens
MNVGRKCLDQYSMLPATPWGVWEIIKRTDIPTLGKNVVVTGRSKIVGMPIVMSLHIRGVHERPRDDATVRISHGYTPKEQLKKQNICRYCNIRCTNSKPVHNRYNQGKNSSC

SEQ ID NO: 2913 - protein, 448 aa, Homo sapiens [sequence omitted]

SEQ ID NO: 2914 - protein, 589 aa, Homo sapiens [sequence omitted]

SEQ ID NO: 2915 - protein, 617 aa, Homo sapiens
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGAEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 2916 - protein, 685 aa, Homo sapiens [sequence omitted]

SEQ ID NO: 2917 - protein, 314 aa, Homo sapiens
MSCKKQRSRKHSVNEKCNMKIEHYFSPVSKEQQNNCSTSLMRMESRGDPRATTNTQAQRFHSPKKNPEDQTMPQNRTIYVTLKVNHRRNQDMKLKLTHSENSSLYMALNTLQAVRKEIETHQGQEMLVRGTEGIKEYINLGMPLSCFPEGGQVVITFSQSKSKQKEDNHIFGRQDKASTECVKFYIHAIGIGKCKRRIVKCGKLHKKGRKLCVYAFKGETIKDALCKDGRFLSFLENDDWKLIENNDTILESTQPVDELEGRYFQVEVEKRMVPSAAASQNPESEKRNTCVLREQIVAQYPILKRESEKIIENF

SEQ ID NO: 2918 - protein, 858 aa, Homo sapiens [sequence omitted]

SEQ ID NO: 2919 - protein, 397 aa, Homo sapiens
MMFQDPVACEDVAVNFTQEEWALLDISQRKLYREVMLETFRNLTSIGKKWKDQNIEYEYQNPRRNFRSLIEGNVNEIKEDSHCGETFTQVPDDRLNFQEKKASPEAKSCDNFVCGEVGIGNSSFNMNIRGDIGHKAYEYQDYAPKPYKCQQPKKAFRYHPSFRTQERNHTGEKPYACKECGKTFISHSGIRRRMVMHSGDGPYKCKFCGKAVHCLRLYLIHERTHTGEKPYECKQCVKSFSYSATHRIHERTHTGEKPYECQQCGKAFHSSSSFQAHKRTHTGGKPYECKQCGKSFSWCHSFQIHERTHTGEKPCECSKCNKAFRSYRSYLRHKRSHTGEKPYQCKECRKAFTYPSSLRRHERTHSAKKPYECKQCGKALSYKFSNTPKNALWRKTL

SEQ ID NO: 2920 - protein, 901 aa, Homo sapiens
MEANQCPLVVEPSYPDLVISVGEVTLGEENRKKLQKIQRDQEKERVMRAACALLNSGGGVIRMAKKVEHPVEMGLDLEQSLRELIQSSDLQAFFETKQQGRCFYIFVKSWSSGPFPEDRSFKPRLCSLSSSLYRRSETSVRSTDSREAFCFLKTKRKPKILEEGPFHKIHKGVYQELPNSDPADPNSDPADLIFQKDYLEYGEILPFPESQLVEFKQFSTKHFQEYVKRTIPEYVPAFANTGGGYLFIGVDDKSREVLGCAKENVDPDSLRRKIEQAIYKLPCVHFCQPQRPITFTLKIVDVLKRGELYGYACMIRVNPFCCAVFSEAPNSWIVEDKYVCSLTTEKWVGMMTDTDPDLLQLSEDFECQLSLSSGPPLSRPVYSKKGLEHKKELQQLLFSVPPGYLRYTPESLWRDLISEHRGLEELINKQMQPFFRGILIFSRSWAVDLNLQEKPGVICDALLIAQNSTPILYTILREQDAEGQDYCTRTAFTLKQKLVNMGGYTGKVCVRAKVLCLSPESSAEALEAAVSPMDYPASYSLAGTQHMEALLQSLVIVLLGFRSLLSDQLGCEVLNLLTAQQYEIFSRSLRKNRELFVHGLPGSGKTIMAMKIMEKIRNVFHCEAHRILYVCENQPLRNFISDRNICRAETRKTFLRENFEHIQHVVIDEAQNFRTEDGDWYGKAKSITRRAKGGPGILWIFLDYFQTSHLDCSGLPPLSDQYPREELTRIVRNADPIAKYLQKEMQVIRSNPSFNIPTGCLEVFPEAEWSQGVQGTLRIKKYLTVEQIMTCVADTCRRFFDRGYSPKDVAVLVSTAKEVEHYKYELLKAMRKKRVVQLSDACDMLGDHIVLDSVRRFSGLERSIVFGIHPRTADPAILPNVLICLASRAKQHLYIFPWGGH

SEQ ID NO: 2921 - protein, 530 aa, Homo sapiens
MGSVGSQRLEEPSVAGTPDPGVVMCFTFDSHQLEEAAEAARGQGLRARGVPAFTDTTLDEPVPDDRYHAIYFAMLLAGVGFLLPYNSFITDVDYLHHKYPGTSIVFDMSLTYILVALAAVLLNNVLVERLTLHTRITAGYLLALGPLLFISICDVWLQLFSRDQAYAINLAAVGTVAFGCTVQQSSFYGYTGMLPRRYTQGVMTGESTAGVMISLSRILTKLLLPDERASTLIFFLVSVALELLCFLLHLLVRRSRFVLFYTTRPRDSHRGRPGLGRGYGYRVHHDVVAGDVHFEHPAPAPAPNESPKDSPAHEVTGSGGAYMRFDVPRPRVQRSWPTFRALLLHRYVVARVIWADMLSIAVTYFITLCLFPGLESEIRHCILGEWLPILIMAVFNLSDFVGKILAALPVDWRGTHLLACSCLRVVFIPLFILCVYPSGMPALRHPAWPCIFSLLMGISNGYFGSVPMILAAGKVSPKQRELAGNTMTVSYMSGLTLGSAVAYCTYSLTRDAHGSCLHASTANGSILAGL

SEQ ID NO: 2922 - protein, 489 aa, Homo sapiens
MELQSRPEALAVELARHQNGDLKKQLHERQPRIAALSDKQALGTITAVPVTGPQVSSLQRLAGQGAAVLPQVRPKTLIPDSLPVAPGRDRPPKQPPTFQKATVVSVKNPSPALPTANNTVSHVPAPGSQPQALAEPAALASPLSSAGVAYAIISTSPSNAAAMAPSTAVSVVSDSIKVQPLLISADNKVIIIQPQVQTQPESTAESRPPTEEPSQGAQATKKKKEDRPPTQENPEKIAFMVALGLVTTEHLEEIQSKRQERKRRSTANPAYSGLLETERKRLASNYLNNPLFLTARANEDPCWKNEITHDEHCAACKRGANLQPCGTCPGAYHLSCLEPPLKTAPKGVWVCPRCQQKALKKDEGVPWTGMLAIVHSYVTHKTVKEEEKQKLLQRGSELQNEHQQLEERDRRLASAVQKCLELKTSLLARQRGTQSSLDRLRALLRLIQGEQLLQVTMTTTSPAPLLAGPWTKPSVAATHPTVQHPQGHN

SEQ ID NO: 2923 - protein, 914 aa, Homo sapiens [sequence omitted]

SEQ ID NO: 2924 - protein, 219 aa, Homo sapiens
MGSAKSVPVTPARPPPHNKHLARVADPRSPSAGILRTPIQVESSPQPGLPAGEQLEGLKHAQDSDPRSPTLGIARTPMKTSSGDPPSPLVKQLSEVFETEDSKSNLPPEPVLPPEAPLSSELDLPLGTQLSVEEQMPPWNQTEFPSKQVFSKEEARQPTETPVASQSSDKPSRDPETPRSSASSVPDFEEAVPGTCGHSHPVSCDSQAAHPVIVAREDA

SEQ ID NO: 2925 - protein, 475 aa, Homo sapiens [sequence omitted]

SEQ ID NO: 2926 - protein, 351 aa, Homo sapiens
MFCLQNGATVGPGQRRELPTAPSTVPRELEASQSSTPSPSPADPSSSGALCPTGSSLNLCLFVTEVRRFLFLGTVSSGTTSTTARGTDGRLDRLEAPAMGTHPVGQTEGWMDGWTGWRPLPWGTHPAGWTEGRMDGWTGWRPLLWGTHPTGQTKDGWTAGQAGGPCHGHSPRGTDRRTDGRLDRLEAPSMGHSPRATDRRTDGRLDGPEAPAVDTHPAGQTEGRMDGWTGWRPLPWTLTPQDRQKDGWTAGQAGGPCRGRSPRSCWASVGSWEISTAVQCAGRAFVLSSQRPRLRLCCIWPPAGQAPSEEGLLRVCGSRRPSSVCDSHPPPTPAHFWEHLPGGFGGPSILP

SEQ ID NO: 2927 - protein, 144 aa, Homo sapiens [sequence omitted]

SEQ ID NO: 2928 - protein, 933 aa, Homo sapiens
MGLQARRWASGSRGAAGPRRGVLQLLPLPLPLPLLLLLLLRPGAGRAAAQGEAEAPTLYLWKTGPWGRCMGDECGPGGIQTRAVWCAHVEGWTTLHTNCKQAERPNNQQNCFKVCDWHKELYDWRLGPWNRCQPVISKSLEKPLECIKGEEGIQVREIACIQKDKDIPAEDIICEYFEPKPLLEQACLIPCQQDCIVSEFSAWSECSKTCGSGLQHRTRHVVAPPQFGGSGCPNLTEFQVCQSSPCEAEELRYSLHVGPWSTCSMPHSRQVRQARRRGKNKEREKDRSKGVKDPEARELIKKKRNRNRQNRQENKYWDIQIGYQTREVMCINKTGKAADLSFCQQEKLPMTFQSCVITKECQVSEWSEWSPCSKTCHDMVSPAGTRVRTRTIRQFPIGSEKECPEFEEKEPCLSQGDGVVPCATYGWRTTEWTECRVDPLLSQQDKRRGNQTALCGGGIQTREVYCVQANENLLSQLSTHKNKEASKPMDLKLCTGPIPNTTQLCHIPCPTECEVSPWSAWGPCTYENCNDQQGKKGFKLRKRRITNEPTGGSGVTGNCPHLLEAIPCEEPACYDWKAVRLGNCEPDNGKECGPGTQVQEVVCINSDGEEVDRQLCRDAIFPIPVACDAPCPKDCVLSTWSTWSSCSHTCSGKTTEGKQIRARSILAYAGEEGGIRCPNSSALQEVRSCNEHPCTVYHWQTGPWGQCIEDTSVSSFNTTTTWNGEASCSVGMQTRKVICVRVNVGQVGPKKCPESLRPETVRPCLLPCKKDCIVTPYSDWTSCPSSCKEGDSSIRKQSRHRVIIQLPANGGRDCTDPLYEEKACEAPQACQSYRWKTHKWRRCQLVPWSVQQDSPGAQEGCGPGRQARAITCRKQDGGQAGIHECLQYAGPVPALTQACQIPCQDDCQLTSWSKFSSCNGDCGAVRTRKRTLV

SEQ ID NO: 2929 - protein, 799 aa, Homo sapiens
MPSQNYDLPQKKQEKMTKFQEAVTFKDVAVVFSREELRLLDLTQRKLYRDVMVENFKNLVAVGHLPFQPDMVSQLEAEEKLWMMETETQRSSKHQNKMETLQKFALKYLSNQELSCWQIWKQVASELTRCLQGKSSQLLQGDSIQVSENENNIMNPKGDSSIYIENQEFPFWRTQHSCGNTYLSESQIQSRGKQIDVKNNLQIHEDFMKKSPFHEHIKTDTEPKPCKGNEYGKIISDGSNQKLPLGEKPHPCGECGRGFSYSPRLPLHPNVHTGEKCFSQSSHLRTHQRIHPGEKLNRCHESGDCFNKSSFHSYQSNHTGEKSYRCDSCGKGFSSSTGLIIHYRTHTGEKPYKCEECGKCFSQSSNFQCHQRVHTEEKPYKCEECGKGFGWSVNLRVHQRVHRGEKPYKCEECGKGFTQAAHFHIHQRVHTGEKPYKCDVCGKGFSHNSPLICHRRVHTGEKPYKCEACGKGFTRNTDLHIHFRVHTGEKPYKCKECGKGFSQASNLQVHQNVHTGEKRFKCETCGKGFSQSSKLQTHQRVHTGEKPYRCDVCGKDFSYSSNLKLHQVIHTGEKPYKCEECGKGFSWRSNLHAHQRVHSGEKPYKCEQCDKSFSQAIDFRVHQRVHTGEKPYKCGVCGKGFSQSSGLQSHQRVHTGEKPYKCDVCGKGFRYSSQFIYHQRGHTGEKPYKCEECGKGFGRSLNLRHHQRVHTGEKPHICEECGKAFSLPSNLRVHLGVHTREKLFKCEECGKGFSQSARLEAHQRVHTGEKPYKCDICDKDFRHRSRLTYHQKVHTGKKL

SEQ ID NO: 2930 - protein, 508 aa, Homo sapiens
MLASSGSGLSGSYEDLQSGQVSEALVDFTGGVTMTINLAEAHGNLWDILIEATYNRTLIGCQTHSGEKILENGLVEGHAYTLTGIRKVTCKHRPEYLVKLRNPWGKVEWKGDWSDSSSKWELLSPKEKILLLRKDNDGEFWMTLQDFKTHFVLLVICKLTPGLLSQEAAQKWTYTMREGRWEKRSTAGGQRQLLQDTFWKNPQFLLSVWRPEEGRRSLRPCSVLVSLLQKPRHRCRKRKPLLAIGFYLYRMNKYHDDQRRLPPEFFQRNTPLSQPDRFLKEKEVSQELCLEPGTYLIVPCILEAHQKSEFVLRVFSRKHIFYEIGSNSGVVFSKEIEDQNERQDEFFTKFFEKHPEINAVQLQNLLNQMTWSSLGSRQPFFSLEACQGILALLDLNASGTMSIQEFRDLWKQLKLSQKVFHKQDRGSGYLNWEQLHAAMREAGIMLSDDVCQLMLIRYGGPRLQMDFVSFIHLMLRVENMEDVFQNLTQDGKGIYLQKPEWMMMALYS

SEQ ID NO: 2931 - protein, 161 aa, Homo sapiens
MESRAALRLGPSSISGCSPMGRPWGPWPWAPVEYVALGRWVAGASVQDAPQGGSGGLDGAWLPALPGLYRLERAWLTQHQPLFTGVRQPGAAVGSACYLLPDASEHAAAAGGQHPGGRDGAELGELPRAEAVRGECPAGCPHLTARLPALLLAGLLPQRGI

SEQ ID NO: 2932 - protein, 437 aa, Homo sapiens
MAVATLRTPTQGTVTFEDVAVHFSWEEWGLLDEAQRCLYRDVMLENLALLTSLDVHHQKQHLGEKHFRSNVGRALFVKTCTFHVSGEPSTCREVGKDFLAKLGFLHQQAAHTGEQSNSKSDGGAISHRGKTHYNCGEHTKAFSGKHTLVQQQRTLTTERCYICSECGKSFSKSYSLNDHWRLHTGEKPYECRECGKSFRQSSSLIQHRRVHTAVRPHECDECGKLFSNKSNLIKHRRVHTGERPYECSECGKSFSQRSALLQHRGVHTGERPYECSECGKFFTYHSSLIKHQKVHIGSRPYECSECGKSFSQNSSLIEHHRVHTGERPYKCSECGKSFSQRSALLQHRGVHTGERPYECSECGKFFPYSSSLRKHQRVHTGSRPYECSECGKSFTQNSGLIKHRRVHTGEKPYECTECGKSFSHNSSLIKHQRIHSR

SEQ ID NO: 2933 - protein, 1196 aa, Homo sapiens
MPTAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTGIISIERKPCNHQVDTAPTVVALYDYTANRSDELTIHRGDIIRVFFKDNEDWWYGSIGKGQEGYFPANHVASETLYQELPPEIKERSPPLSPEEKTKIEKSPAPQKQSINKNKSQDFRLGSESMTHSEMRKEQSHEDQGHIMDTRMRKNKQAGRKVTLIE

SEQ ID NO: 2934 - protein, 122 aa, Homo sapiens
MAEPGGRGDYRKDGRLPSLSRSPLSTTLGTSPACGLEIPPTSGARPDGSCSLPAPVYHLKSRQWKGMGRGHRQRWRLQGRGDCDMGCVVQASGLFPAEMRERTTKKMATSPLDLCAGACWEM

SEQ ID NO: 2935 - protein, 132 aa, Homo sapiens
MYSVLQLLKCLCSCWRKGPEGRRFQTEAAVCARPAWSPHPAGASEALGALPPPRQLVEKRRVSPPRRLDQSGRDGGAVAKCSLSRGLSPPGWTGRSLLRPWGSAAVLGSRAALACVLRPSRGVMPATIQSRR

SEQ ID NO: 2936 - protein, 299 aa, Homo sapiens
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLESAAPPEPAPEPAPQPDPRPDSQPTPKPALQPELPTQEDPTPEILSESVGEKQENGAVVPLQAGDGEEGPAPEPHSPPSKKSPPANGAPPRVLQQLVEEDRMRRAHSGHPGSPRGSLSRHPSSQLAGPGVEGGEGTQKPRDYIILAILSCFCPMWPVNIVAFAYAVMVSPMGP

SEQ ID NO: 2937 - protein, 781 aa, Homo sapiens
MATQGHLTFKDVAIEFSQEEWKCLEPVQKALYKDVMLENYRNLVFLGISPKCVIKELPPTENSNTGERFQTVALERHQSYDIENLYFREIQKHLHDLEFQWKDGETNDKEVPVPHENNLTGKRDQHSQGDVENNHIENQLTSNFESRLAELQKVQTEGRLYECNETEKTGNNGCLVSPHIREKTYVCNECGKAFKASSSLINHQRIHTTEKPYKCNECGKAFHRASLLTVHKVVHTRGKSYQCDVCGKIFRKNSYFVRHQRSHTGQKPYICNECGKSFSKSSHLAVHQRIHTGEKPYKCNLCGKSFSQRVHLRLHQTVHTGERPFKCNECGKTFKRSSNLTVHQVIHAGKKPYKCDVCGKAFRHRSNLVCHRRIHSGEKQYKCNECGKVFSKRSSLAVHRRIHTVEKPCKCNECGKVFSKRSSLAVHQRIHTGQKTYKCNKCGKVYSKHSHLAVHWRIHTGEKAYKCNECGKVFSIHSRLAAHQRIHTGEKPYKCNECGKVFSQHSRLAVHRRIHTGEKPYKCKECGKVFSDRSAFARHRRIHTGEKPYKCKECGKVFSQCSRLTVHRRIHSGEKPYKCNECGKVYSQYSHLVGHRRVHTGEKPYKCHECGKAFNQGSTLNRHQRIHTGEKPYKCNQCGNSFSQRVHLRLHQTVHTGDRPYKCNECGKTFKRSSNLTAHQIIHAGKKPYKCDECGKVFRHSSHLVSHQRIHTGEKRYKCIECGKAFGRLFSLSKHQRIHSGKKPYKCNECGKSFICRSGLTKHRIRHTGESLTTKLNVTRP

SEQ ID NO: 2938 - protein, 1054 aa, Homo sapiens
MAGLRRPQPGCYCRTAAAVNLLLGVFQVLLPCCRPGGAQGQAIEPLPNVVELWQAEEGELLLPTQGDSEEGLEEPSQEQSFSDKLFSGKGLHFQPSVLDFGIQFLGHPVAKILHAYNPSRDSEVVVNSVFAAAGHFHVPPVPCRVIPAMGKTSFRIIFLPTEEGSIESSLSINTSSYGVLSYHVSGIGTRRISTEGSAKQLPNAYFLLPKVQSIQLSQMQAETTNTSLLQVQLECSLHNKVCQQLKGCYLESDDVLRLQMSIMVTMENFSKEFEENTQHLLDHLSIVYVATDESETSDDSAVNMYILHSGNSLIWIQDIRHFSQRDALSLQFEPVLLPTSTTNFTKIASFTCKAATSCDSGIIEDVKKTTHTPTLKACLFSSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKRNVLGTTRFAHLKKSKESESFVFFLPRLIAEPGLMLNFSATALRSRMIKYFVVQNPSSWPVSLQLLPLSLYPKPEALVHLLHRWFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRQLKDSKQILSITKNFKVENIGPLPITVSSLKINGYNCQGYGFEVLDCHQFSLDPNTSRDISIVFTPDFTSSWVIRDLSLVTAADLEFRFTLNVTLPHHLLPLCADVVPGPSWEESFWRLTVFFVSLSLLGVILIAFQQAQYILMEFMKTRQRQNASSSSQQNNGPMDVISPHSYKSNCKNFLDTYGPSDKGRGKNCLPVNTPQSRIQNAAKRSPATYGHSQKKHKCSVYYSKHKTSTAAASSTSTTTEEKQTSPLGSSLPAAKEDICTDAMRENWISLRYASGINVNLQKNLTLPKNLL

SEQ ID NO: 2939 - protein, 127 aa, Homo sapiens [sequence omitted]

SEQ ID NO: 2940 - protein, 130 aa, Homo sapiens [sequence omitted]

SEQ ID NO: 2941 - protein, 382 aa, Homo sapiens [sequence omitted]

SEQ ID NO: 2942 - protein, 245 aa, Homo sapiens
MGRQVNPRPRGNCQLDREEGTQQRVTAHRKTMSHCQVLWEDKDSQCWGHLDWVWAHVSRSSQRGLPGGGGIGADLGRKGRIWRGQQRPLTATWAEQRAWPPLRMASTLAQGKDPPMEKALSMFSDDFGSFMRPHSEPLAFPARPGGAGNIKTLGDAYEFAVDVRDFSPEDIIVTTSNNHIEVRAEKLAADGTVMNTFAHKCQLPEDVDPTSVTSALREDGSLTIRARRHPHTEHVQQTFRTEIKI

SEQ ID NO: 2943 - protein, 355 aa, Homo sapiens [sequence omitted]

SEQ ID NO: 2944 - protein, 786 aa, Homo sapiens
MRRQPAASLDPLAKEPGPPGSRDDRLEDALLSLGSVIDISGLQRAVKEALSAVLPRVETVYTYLLDGESQLVCEDPPHELPQEGKVREAIISQKRLGCNGLGFSDLPGKPLARLVAPLAPDTQVLVMPLADKEAGAVAAVILVHCGQLSDNEEWSLQAVEKHTLVALRRVQVLQQRGPREAPRAVQNPPEGTAEDQKGGAAYTDRDRKILQLCGELYDLDASSLQLKVLQYLQQETRASRCCLLLVSEDNLQLSCKVIGDKVLGEEVSFPLTGCLGQVVEDKKSIQLKDLTSEDVQQLQSMLGCELQAMLCVPVISRATDQVVALACAFNKLEGDLFTDEDEHVIQHCFHYTSTVLTSTLAFQKEQKLKCECQALLQVAKNLFTHLDDVSVLLQEIITEARNLSNAEICSVFLLDQNELVAKVFDGGVVDDESYEIRIPADQGIAGHVATTGQILNIPDAYAHPLFYRGVDDSTGFRTRNILCFPIKNENQEVIGVAELVNKINGPWFSKFDEDLATAFSIYCGISIAHSLLYKKVNEAQYRSHLANEMMMYHMKVSDDEYTKLLHDGIQPVAAIDSNFASFTYTPRSLPEDDTSMAILSMLQDMNFINNYKIDCPTLARFCLMVKKGYRDPPYHNWMHAFSVSHFCYLLYKNLELTNYLEDIEIFALFISCMCHDLDHRGTNNSFQVASKSVLAALYSSEGSVMERHHFAQAIAILNTHGCNIFDHFPLRTTTILMVGLGPGGYRGPRKKLPEGQLSALQRGALGRSRMGLMGRRDPRTGRQAQV

SEQ ID NO: 2945 - protein, 644 aa, Homo sapiens
MSYFLSYCKAHGGALLTGYQALRAEGFLCDVTLETEGSEFPAHRSLLACSSDYFRALFKSHTQESRARVIHLHVPSAAGLQRLLDFIYTAWLSLSMDTVEDTLEAASYLQVTEALGLCGRYLERQLAPENCCFAANVAARFGLAHTLDAAERCIVSHLQELLARGAGPAGLLELNPTSLRAVLGAPDVARVPEARLLGLALAWLRQEPTTERLAHCTELLERVRFGLVPADVLRRVYSGSGLVLPARVKGLIIQALNYHTTPSRQPLMQGEQTSIRSPQTRILLVGGRRAREVVIEEVAAPQRAARGQVAAPEPEEEEEELEEEEEEEEWELTQNVVAFDVYNHRWRSLTQLPTPLLGHSVCTAGNFLFVLGGESPSGSASSPLADDSRVVTAQVHRYDPRFHAWTEVPAMREARAHFWCGAVGERLLAVGGLGAGGEVLASVEMYDLRRDRWTAAGALPRALHGHAGAVGDRGVVYISGGKAGRGEGGASSLRDLYVLGPEEQVWSKKAPMGTARFGHHMAVLRGAVFAFLGRYEPFSEIERYDPGADQWTRLRPLPYDRFCYGLAVVEETALLLGGLKWRDSRQVPTRNVVGYDLDLDRWEDIGCALPWAWSGLRCAVLQLAEGGDDEREGEVGEALDLVLG

SEQ ID NO: 2946 - protein, 885 aa, Homo sapiens [sequence omitted]

SEQ ID NO: 2947 - protein, 586 aa, Homo sapiens
MRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRS

SEQ ID NO: 2948 - protein, 381 aa, Homo sapiens
MGVVMKVRIPTCHDKPGTTQIVQLTQQVDTNISVILPTVHEVDIFRCFCPVFLHSQMLWELVLLGEPLVVMAPSPSESSETVLALVNCISPLKYFSDFRPYFTIHDSEFKEYTTRTQAPPSVILGVTNPFFAKTLQHWPHIIRIGDLKPTGEIPKQVKVKKLKNLKTLDSKPGVYTSYKPYLNRDEEIIKQLQKGVQQKRPSEAQSVILRRYFLELTQSFIIPLERYVASLMPLQKSISPWKSPPQLRQFLPEEFMKTLEKTGPQLTSRIKGDWIGLYRHFLKSPNFDGWFKTRRKEMTQKLEALHLEALCEEDLLLWIQKHTEVETVDLVLKLKNKLLQADREHLPVKPDTMEKLRTHIDAIILALPEDLQGILLKTGMT

SEQ ID NO: 2949 - protein, 1166 aa, Homo sapiens [sequence omitted]

SEQ ID NO: 2950 - protein, 526 aa, Homo sapiens [sequence omitted]

SEQ ID NO: 2951 - protein, 903 aa, Homo sapiens
MPEQFSVAEFLAVTAEDLSSPAGAAAFAAKMPRYRGAALAREEILEGDQAILQRIKKAVRAIHSSGLGHVENEEQYREAVESLGNSHLSQNSHELSTGFLNLAVFTREVAALFKNLIQNLNNIVSFPLDSLMKGQLRDGRQDSKKQLEKAWKDYEAKMAKLEKERDRARVTGGIPGEVAQDMQRERRIFQLHMCEYLLKAGESQMKQGPDFLQSLIKFFHAQHNFFQDGWKAAQSLFPFIEKLAASVHALHQAQEDELQKLTQLRDSLRGTLQLESREEHLSRKNSGCGYSIHQHQGNKQFGTEKVGFLYKKSDGIRRVWQKRKCGVKYGCLTISHSTINRPPVKLTLLTCQVRPNPEEKKCFDLVTHNRTYHFQAEDEHECEAWVSVLQNSKDEALSSAFLGEPSAGPGSWGSAGHDGEPHDLTKLLIAEVKSRPGNSQCCDCGAADPTWLSTNLGVLTCIQCSGVHRELGVRFSRMQSLTLDLLGPSELLLALNMGNTSFNEVMEAQLPSHGGPKPSAESDMGTRRDYIMAKYVEHRFARRCTPEPQRLWTAICNRDLLSVLEAFANGQDFGQPLPGPDAQAPEELVLHLAVKVANQASLPLVDFIIQNGGHLDAKAADGNTALHYAALYNQPDCLKLLLKGRALVGTVNEAGETALDIARKKHHKECEELLEQAQAGTFAFPLHVDYSWVISTEPGSDSEEDEEEKRCLLKLPAQAHWASGRLDISNKTYETVASLGAATPQGESEDCPPPLPVKNSSRTLVQGCARHASGDRSEVSSLSSEAPETPESLGSPASSSSLMSPLEPGDPSQAPPNSEEGLREPPGTSRPSLTSGTTPSEMYLPVRFSSESTRSYRRGARSPEDGPSARQPLPRRNVPVGITEGDGSRTGSLPASSVQLLQD

SEQ ID NO: 2952 - protein, 615 aa, Homo sapiens
MTVNRQMKRYNVPFLTFINKLDRMGSNPARALQQMRSKLNHNAAFMQIPMGLEGNFKGIVDLIEERAIYFDGDFGHFLRDFLPLLWNWDRRSGSQIVRYGEIPAELRAAATDHRQELIECVANSDEQLGEMFLEEKIPSISDLKLAIRRATLKRSFTPVFLGSALKNKGVQPLLDAVLEYLPNPSEVQNYAILNKEDDSKEKTKILMNSSRDNSHPFVGLAFKLEVGRFGQLTYVRSYQGELKKGDTIYNTRTRKKVRLQRLARMHADMMEDVEEVYAGDICALFGIDCASGDTFTDKANSGLSMESIHVPDPVISIAMKPSNKNDLEKFSKGIGRFTREDPTFKVYFDTENKETVISGMGELHLEIYAQRLEREYGCPCITGKPKVAFRETITAPVPFDFTHKKQSGGAGQYGKVIGVLEPLDPEDYTKLEFSDETFGSNIPKQFVPAVEKGFLDACEKGPLSGHKLSGLRFVLQDGAHHMVDSNEISFIRAGEGALKQALANATLCILEPIMAVEVVAPNEFQGQVIAGINRRHGVITGQDGVEDYFTLYADVPLNDMFGYSTELRSCTEGKGEYTMEYSRYQPCLPSTQEDVINKYLEATGQLPVKKGKAKN

SEQ ID NO: 2953 - protein, 440 aa, Homo sapiens [sequence omitted]

SEQ ID NO: 2954 - protein, 415 aa, Homo sapiens
MSVLPTSKPEKVLLRPGDFQSQWDEDDNEDESSSASDVMSHKRTASTDLKQLNQVNFTLPKKEGLSFLGGLRSKNDVLSRSNVCINGNHVYLEQPEAKGEIKDSSPSSSPSPKGFRKKHLFSSTENLAAGSWKEPAEGGGLSSDRQLSESSTKDSLKSMTLPSYRPAPLVSGDLRENMAPANSEATKEAKESKKPESRRSSLLSLMTGKKDVAKGSEGENPLTVPGREKEGMLMGVKPGEDASGPAEDLVRRSEKDTAAVVSRQGSSLNLFEDVQITEPEAEPESKSEPRPPISSPRAPQTRAVKPRLHPVKPMNATATKVANCSLGTATIISENLNNEVMMKKYSPSDPAFAYAQLTHDELIQLVLKQKETISKKEFQVRELEDYIDNLLVRVMEETPNILRIPTQVGKKAGKM

SEQ ID NO: 2955 - protein, 745 aa, Homo sapiens [sequence omitted]

SEQ ID NO: 2956 - protein, 114 aa, Homo sapiens [sequence omitted]

SEQ ID NO: 2957 - protein, 569 aa, Homo sapiens [sequence omitted]

SEQ ID NO: 2958 - protein, 180 aa, Homo sapiens [sequence omitted]

SEQ ID NO: 2959 - protein, 127 aa, Homo sapiens
MFQAAGAAQATPSHDAKGGGSSTVQRSKSFSLRAQVKETCAACQKTVYPMERLVADKLIFHNSCFCCKHCHTKLSLGSYAALHGEFYCKPHFQQLFKSKGNYDEGFGRKQHKELWAHKEVDPGTKTA

SEQ ID NO: 2960 - protein, 745 aa, Homo sapiens
MFPLRALWLVWALLGVAGSCPEPCACVDKYAHQFADCAYKELREVPEGLPANVTTLSLSANKITVLRRGAFADVTQVTSLWLAHNEVRTVEPGALAVLSQLKNLDLSHNFISSFPWSDLRNLSALQLLKMNHNRLGSLPRDALGALPDLRSLRINNNRLRTLAPGTFDALSALSHLQLYHNPFHCGCGLVWLQAWAASTRVSLPEPDSIACASPPALQGVPVYRLPALPCAPPSVHLSAEPPLEAPGTPLRAGLAFVLHCIADGHPTPRLQWQLQIPGGTVVLEPPVLSGEDDGVGAEEGEGEGDGDLLTQTQAQTPTPAPAWPAPPATPRFLALANGSLLVPLLSAKEAGVYTCRAHNELGANSTSIRVAVAATGPPKHAPGAGGEPDGQAPTSERKSTAKGRGNSVLPSKPEGKIKGQGLAKVSILGETETEPEEDTSEGEEAEDQILADPAEEQRCGNGDPSRYVSNHAFNQSAELKPHVFELGVIALDVAEREARVQLTPLAARWGPGPGGAGGAPRPGRRPLRLLYLCPAGGGAAVQWSRVEEGVNAYWFRGLRPGTNYSVCLALAGEACHVQVVFSTKKELPSLLVIVAVSVFLLVLATVPLLGAACCHLLAKHPGKPYRLILRPQAPDPMEKRIAADFDPRASYLESEKSYPAGGEAGGEEPEDVQGEGLDEDAEQGDPSGDLQREESLAACSLVESQSKANQEEFEAGSEYSDRLPLGAEAVNIAQEINGNYRQTAG

SEQ ID NO: 2961 - protein, 316 aa, Homo sapiens
MTVQDDMGTQDVGQGGICILVPRRAGGNVSLGEFVHVCGCVGVGWGADGWERIHVCEPLWILGCESTGGGASRCLGLGEPVCEPEFRSMRMEVSRPEPRPDGTGPGLGSQAGPRTPRPAPPPLAFPAGTHYLRGVNNARQPWHNAEGRLRYGLRPANPTEEGLASLHSVLFRKQPFLWRAALLYYTIHRAARMSFRQLFQDLERYVQDADVRWEYCVRAKRGQTDTSLPGCFSKDQVYLDGIVRILRHRQTIDFPLLTSLGKVSYEDVDHLRPHGVLDNTRVPHFMQDLARYRQQLEHIMATNRLDEAELGRLLPD

SEQ ID NO: 2962 - protein, 742 aa, Homo sapiens [sequence omitted]

SEQ ID NO: 2963 - protein, 100 aa, Homo sapiens
MRKLRLRASNPGPSGAPGTRRHFSTSGGGHHCARRWLRRVRSLVLFSRSRSQTPSCQNLDPNPPIARFLLPLERISEVPRRACLHGRDASSVWPPPERSD

SEQ ID NO: 2964 - protein, 106 aa, Homo sapiens
MQVSTHRWRSPRLSQDPPPCQATEGHRTTPTAHSLVWGHLLALSFFFFFFFSEMESLSVTQVGVWWHNLGSLQPPPPEFKQFSCLSLPSSWDYRHAPPHLANVLYF

SEQ ID NO: 2965 - protein, 354 aa, Homo sapiens
MDMMLLVQGACCSNQWLAAVLLSLCCLLPSCLPAGQSVDFPWAAVDNMMVRKGDTAVLRCYLEDGASKGAWLNRSSIIFAGGDKWSVDPRVSISTLNKRDYSLQIQNVDVTDDGPYTCSVQTQHTPRTMQVHLTVQVPPKIYDISNDMTVNEGTNVTLTCLATGKPEPFISWRHISPSAKPFENGQYLDIYGITRDQAGEYECSAENDVSFPDVRKVKVVVNFAPTIQEIKSGTVTPGRSGLIRCEGAGVPPPAFEWYKGEKKLFNGQQGIIIQNFSTRSILTVTNVTQEHFGNYTCVAANKLGTTNASLPLNPPSTAQYGITGSADVLFSCWYLVLTLSSFTSIFYLKNAILQ

SEQ ID NO: 2966 - protein, 106 aa, Homo sapiens
MSVFVYHLVTCQCLCLCVPVSQHLCISVAHAVSLCAMVCQCLCVDGWPMSDPRQGRPGWLDPAHLPSGSLALWVRVTEAFCGLKTGCSGSALRVLGPFHPLSPSGW

SEQ ID NO: 2967 - protein, 349 aa, Homo sapiens
MGTTEATLRMENVDVKEEWQDTSSPPNTLNFNGAHRKRKTLVAPEINISLDQSEGSLLSDDFLDTPDDLDINVDDIETPDETDSLEFLGNGNELEWEDDTPVATAKNMPGDSADLFGDGTTEDGSAANGRLWRTVIIGEQEHRIDLHMIRPYMKVVTHGGYYGEGLNAIIVFAACFLPDSSLPDYHYIMENLFLYVISSLELLVAEDYMIVYLNGATPRRRMPGIGWLKKCYQMIDRRLRKNLKSLIIVHPSWFIRTVLAISRPFISVKFINKIQYVHSLEDLEQLIPMEHVQIPDCVLQYEEERLKARRESARPQPEFVLPRSEEKPEVAPVENRSALVSEDQETSMS

SEQ ID NO: 2968 - protein, 482 aa, Homo sapiens
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDATQAGKMMDATGKALCSSAKQRLALCTPLSRLKQEVATFSQRAVSDTLMTINRMEQARTEYRGALLWMKDVSQELDPDTLKQMEKFRKVQMQVRNSKASFDKLKMDVCQKVDLLGASRCNMLSHSLTTYQRTLLGFWKKTARMMSQIHEACIGFHPYDFVALKQLQDTPSKISEDNKDEQIGGFLTEQLNKLVLSDEEASFESEQANKDHNEKHSQMREFGAPQFSNSENVAKDLPVDSLEGEDFEKEFSFLNNLLSSGSSSTSEFTQECQTAFGSPSASLTSQEPSMGSEPLAHSSRFLPSQLFDLGFHVAGAFNNWVSQEESELCLSHTDNQPVPSQSPKKLTRSPNNGNQDMSAWFNLFADLDPLSNPDAIGHSDDELLNA

SEQ ID NO: 2969 - protein, 137 aa, Homo sapiens
MLVPARVFFTDVPVIGRSGKSFSYNQDVVLLLLTDGVLFHLQSVTAYALMGKISPVTFSVASTVKHALSIWLSVIVFGNKITSLSAVGTALVTVGVLLYNKARQHQQEALQSLAAATGRAPDDTVEPLLPQDPRQHP

SEQ ID NO: 2970 - protein, 261 aa, Homo sapiens
MLRERELEREREQFRVASLHTRTRSLDFREIGPFQLEPSREPRTHLAYALDLGSSPVPSSTAPKTPSLSSTQPTRVWSGPPAVGQERLPQSSMPQQHEGPSLNPFDEEDLSSPMEEATTGPPAAGVSLDPSARILKEYNPFEEEDEEEEAVAGNPFIQPDSPAPNPFSEEDEHPQQRLSSPLVPGNPFEEPTCINPFEMDSDSGPEAEEPIEEELLLQQIDNIKAYIFDAKQCGRLDEVEVLTENLRELKHTLAKQKGGTD

SEQ ID NO: 2971 - protein, 148 aa, Homo sapiens
MPPVKRHRMASWIKSQDLSVCCIQETHLICKDTYRLKIKGWQKIYQTNGKQKKAEVAILVSDKTDFKPTKIKKHKEGHYIMVKDSIQQEELTILNIYAPNTGAPRLIKQVLRDRQRDLDSHTITVGDFNMPLSILDHQDRKLTRIFRT

SEQ ID NO: 2972 - protein, 314 aa, Homo sapiens
MILAHCSLDFLGSSDPPQPPMWLEPQARATMPGYFFVELGSRFVAQAGLELLGSSNPSHSASCSVENIGVGYYTCFSRFYKTADLCVEDRPGVCSLRCEDVLSRDFPWVSISFFLLSSKTNRRPAAVARASNPSTLGGCRWRITRPGVRDQPGRHGETLSLPKIRKLAGCDGGCLWSQLLGRLRQENCLGPRGGGCSEPRSCHCTPAWATGQDSVSKTNTIRKCSGGGGELLICEDRLKATPRVALSTSPSRIWLPASLKIVVWHKERCRRLVLSTLEFPAAQNLVPSPPPSQGAAILFGFSVCGPETNVFPKD

SEQ ID NO: 2973 - protein, 683 aa, Homo sapiens
MSAEYAPQGTCKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRRSPFASSSEHSSENGSLRFSTPPGELDGGISGRSGTGSGGSTPHISGPGPGRPSSKEGRRSDTCEYCGKVFKNCSNLTVHRRSHTGERPYKCELCNYACAQSSKLTRHMKTHGQVGKDVYKCEICKMPLSVYSTLEKHMKKWHSDRVLNNDIKTE

SEQ ID NO: 2974 - protein, 110 aa, Homo sapiens [sequence omitted]

SEQ ID NO: 2975 - protein, 106 aa, Homo sapiens
MTSISAGSLVLILIVRIRIVLYCIGIAPVANGIKFRALRWYLVFFLFWLSPPFSLSDCSPCGVHAEQTGRFAFPEFILCISTSVPLFMFPTSWGVPASSELDVFIL

SEQ ID NO: 2976 - protein, 331 aa, Homo sapiens
MPGCHGVVAPSSDDIFKLAEANACWALEDLRCMEEDTFIRTVELLGAVQGFNRPQLMTLKEKAIQVWDMPSYWREHHIVSLGRIALALNESELEQLDLSSIDTVASPSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 2977 - protein, 296 aa, Homo sapiens
MASWTSPWWVLIGMVFMHPPLPQTTAEKSPGAYFLPEFALSPQGSFLEDTTGEQFLTYRYDDQTSRNTRSDEDKDGNWDAWGDWSDCSRTCGGGASYSLRRCLTGRNCEGQNIRYKTCSNHDCPPDAEDFRAQQCSAYNDVQYQGHYYEWLPRYNDPAAPCALKCHAQGQNLVVELAPKVLDGTRCNTDSLDMCISGICQAVGCDRQLGSNAKEDNCGVCAGDGSTCRLVRGQSKSHVSPEKREENVIAVPLGSRSVRITVKGPAHLSSAADTQANRVWSGPPANSNRPAAERPDL

SEQ ID NO: 2978 - protein, 512 aa, Homo sapiens
MEMQSYYAKLLGELNEQRKRDFFCDCSIIVEGRIFKAHRNILFANSGYFRALLIHYIQDSGRHSTASLDIVTSDAFSIILDFLYSGKLDLCGENVIEVMSAASYLQMNDVVNFCKTYIRSSLDICRKMEKEAAVAAAVAAAAAAAAAAAAAAAHQVDSESPSSGREGTSCGTKSLVSSPAEGEKSVECLRESPCGDCGDCHPLELVVRDSLGGGSADSNLSTPPKRIEPKVEFDADEVEVDVGEQLQQYAAPLNLAHVEEALPSGQAVDLAYSNYHVKQFLEALLRNSAAPSKDDADHHFSRSLEGRPEGAGVAMSSMMDVQADWYGEDSGDVLVVPIKLHKCPFCPYTAKQKGILKRHIRSHTGERPYPCETCGKRFTRQEHLRSHALSVHRSNRPIICKGCRRTFTSHLSQGLRRFGLCDSCTCVTDTPDDDDDLMPINLSLVEASSESQEKSDTDNDWPIYVESEIGSHYVAQASLELLALSQPPASASQSAGITDGVSLCCPGRSTVA

SEQ ID NO: 2979 - protein, 781 aa, Homo sapiens
MDSFDLALLQEWDLESLWGEDILNQRNDSLVVEFQSSASRCRSVYEPDRNALRRKERERRNQETQQDDGTFNSSYSLFSEPYKTNKGDELSNRIQNTLGNYDEMKDFLTDRSNQSHLVGVPKPGVPQTPVNKIDEHFVADSRAQNQPSSICSTTTSTPAAVPVQQSKRGTMGWQKAGHPPSDGQQRATQQGSLRTLLGDGVGRQQPRAKQVCNVEVGLQTQERPPAMAAKHSSSGHCVQNFPPSLASKPSLVQQKPTAYVRPMDGQDQAPDESPKLKSSSETSVHCTSYRGVPASKPEPARAKAKLSKFSIPKQGEESRSGETNSCVEEIIREMTWLPPLSAIQAPGKVEPTKFPFPNKDSQLVSSGHNNPKKGDAEPESPDNGTSNTSMLEDDLKLSSDEEENEQQAAQRTALRALSDSAVVQQPNCRTSVPSSKGSSSSSSSGSSSSSSDSESSSGSDSETESSSSESEGSKPPHFSSPEAEPASSNKWQLDKWLNKVNPHKPPILIQNESHGSESNQYYNPVKEDVQDCGKVPDVCQPSLREKEIKSTCKEEQRPRTANKAPGSKGVKQKSPPAAVAVAVSAAAPPPAVPCAPAENAPAPARRSAGKKPTRRTERTSAGDGANCHRPEEPAAADALGTSVVVPPEPTKTRPCGNNRASHRKELRSSVTCEKRRTRGLSRIVPKSKEFIETESSSSSSSSDSDLESEQEEYPLSKAQTVAASASSGNDQRLKEAAANGGSGPRAPVGSINARTTSDIAKELEEQFYTLVPLAGTNFSPL

SEQ ID NO: 2980 - protein, 121 aa, Homo sapiens [sequence omitted]

SEQ ID NO: 2981 - protein, 268 aa, Homo sapiens
MHTQVCAHTYIHMHRHLCTHMQIHPQHPICATHRHRYMKTDAHTGLCTHVCMHRHLCTHMQMHPQYPICATHRHTYMETDAHTGLCTHVHMHRHLCTHMQMHPQYPICATHRHTYMETDAHTGLCTHVHMHRHLCTHMQMHPQYPICATHRHTYMETDVHTGLCTHVHMHRHLCTHMQMHPQYPICATHRHTYMETDAHTGLCTHVHMHRHLCTHMQMHPQYRICATHRHTYMETDVHTGLCAHVHMHRHLCTHTYRCTCNIPSVLPY

SEQ ID NO: 2982 - protein, 687 aa, Homo sapiens
MSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSESMIFETTTKNETIAQEDKIKLLKAAFLQYCRKDLGHAQMVVDELFSSHSDLDSDSELDRAVTQISVDLMDDYPASDPRWAESVPEEAPGFSNTSLIILHQLEDKMKAHSFLMDFIHQVGLFGRLGSFPVRGTPMATRLLLCEHAEKLSAAIVLKNHHSRLSDLVNTAILIALNKREYEIPSNLTPADVFFREVSQVDTICECLLEHEEQVLRDAPMDSIEWAEVVINVNNILKDMLQAASHYRQNRNSLYRREESLEKEPEYVPWTATSGPGGIRTVIIRQHEIVLKVAYPQADSNLRNIVTEQLVALIDCFLDGYVSQLKSVDKSSNRERYDNLEKGKRGKLLSQPISQHGQLANFLQAHEHLSWLHEINSQELEKAHATLLGLANMETRYFAKKKTLLGLSKLAALASDFSEDMLQEKIEEMAEQERFLLHQETLPEQLLAEKQLNLSAMPVLTAPQLIGLYICEENRRANEYDFKKALDLLEYIDEEEDININDLKLEILCKALQRDNWSSSDGKDDPIEVSKDSIFVKILQKLLKDGIQLSEYLPEVKDLLQADQLGSLNVNFC

SEQ ID NO: 2983 - protein, 109 aa, Homo sapiens [sequence omitted]

SEQ ID NO: 2984 - protein, 178 aa, Homo sapiens [sequence omitted]

SEQ ID NO: 2985 - protein, 342 aa, Homo sapiens [sequence omitted]

SEQ ID NO: 2986 - protein, 307 aa, Homo sapiens
MQTQDGEKFYECKACGKPFTESSYLTQHLRTHSRVLPIEHKKFGKAFAFSPDLAKHIRLRTRGKHYVCNECGKEFTCFPKLNIHIRVHTGEKPYECNKCGKAFTDSSGLIKHRRTHTGEKPYECKECGKAFANSSHLTVHMRTHTGEKPYQCKECGKAFINSSSFKSHMQTHPGVKPYDCQQCGKAFIRSSFLIRHLRSHSAERPFECEECGKAFRYSSHLSQHKRIHTGERPYKCQKCGQAFSISSGLTVHMRTHTGERPFECQECGKAFTRSTYLIRHLRSHSVEKPYKECGQTFSNSSCLTECV

SEQ ID NO: 2987 - protein, 902 aa, Homo sapiens
MVVSAGHWSSEKAEMNILEINQTLRPQLPENKQQLRNLKEKCFLTQLAGFLANRQKKYKYEECKDLIKFMLRNERQFKEEKLAEQLKQAEELRQYKVLVHSQERELTQLKEKLREGRDASRSLNEHLQALLTPDEPDKSQGQDLQEQLAEGCRLAQHLVQKLSPENDEDEDEDVQVEEDEKVLESSAPREVQKTEESKVPEDSLEECAITCSNSHGPCDSNQPHKNIKITFEEDEVNSTLVVDRESSHDECQDALNILPVPGPTSSATNVSMVVSAGPLSGEKAAINILEINEKLRPQLAEKKQQFRNLKEKCFLTQLAGFLANQQNKYKYEECKDLIKFMLRNERQFKEEKLAEQLKQAEELRQYKVLVHSQERELMQLKEKLREGRDASRSLNEHLQALLTPDEPDKSQGQDLQEQLAEGCRLAQHLVQKLSPENDEDEDEDVQVEEAEKVRKSSAPREVQKTEESKVPEDSLEECAITCSNSHGPCDSNQPHKNIKITFEEDEVNSTLVVDRESSHDECQDVLNILPVPGPTSSATNVSMVVSAGPLSSEKAEMNILEINEKLHPQLAEKKQQFRNLKEKCFLTQLAGFLANRQKKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYKSYSSTFHSLEEQQVCMAVDIGRHRWDQVKKEDHEATGPRLSRELLDEKGPEV

SEQ ID NO: 2988 - protein, 175 aa, Homo sapiens
MSLAQQAFQHDPVSSPSTQSTSNSSADPETSLAQQGPQHDPMAFPSTQSTCSSGGVPEMSLAQQAFQYQPVAFFSTQSTSSSGGDPETSQAQQAAQHDPVAYPYTQSNSSSGADPETSGSPPPQQHPVAFSTKSTSSSGRDPEMSLTQQQPSQEASVIQAGQPKALTSALPIRRL

SEQ ID NO: 2989 - protein, 411 aa, Homo sapiens
MASCQYSLLKSVQPDPASPIHGHNQIITYSRPIYFCVLCGLILLLDTGAKARHPPSYVVYGLKLFSPVFLQSARDYLIVFLYCFPAISLLGLFPQINTFCTYLLEQIDTLFFGGSAVSGITSAVYSVARSVLAAALLHAVCFSAVKEPWSMQHIPALFSAFCGLLVALSYHLSRQSSDPSVLMSFIQCRLFPKFLHQNLAESAADPLPKKMKDSVTDVLKWDLIVCAVVAVLSFAVSASTVFLSLRPFLSIVLFALAGAVGFVTHYVLPQLRKHHPWMWISHPILKNKEYHQREVRDVAHLMWFERLYVWLQCFEKYILYPALILNALTIDAFLISNHRRLGTHWDIFLMIIAGMKLLRTSFCNPVYQFINLSFTVIFFHFDYKDISESFLLDFFMVSILFSKDGTHTQRG

SEQ ID NO: 2990 - protein, 306 aa, Homo sapiens [sequence omitted]

SEQ ID NO: 2991 - protein, 752 aa, Homo sapiens
MSSAFGAFYAMSLSLWKIPNLKPIAMFWQLQACILKISFGAIQSVFPATSWSWTISKLKCLLKYLIISTVPQSLSRDRKQSLISQLQEKSWEYRSWKTLLIATSQIPRVPMYSVLLKREWLKKKKNEKRHEEPAITNGPRITNAFSIIETENSNNMFSPLDLRASFKKVSDSMRTASLCLERTDVCHEAEPVRTLAEHSYAVSSVAEAYRSQPVREHDGSSPGNTGKENCEALAAKPKTCRKPKTFSIPQDSDSATENIPPPPVSNLEVNQERSPQPAAVLTRSKSPNNEGDVHFSREDENQSSDVPGPPAAEVPPLVYNCSCCSKAFDSSTLLSAHMQLHKPTQEPLVCKYCNKQFTTLNRLDRHEQICMRSSHMPIPGGNQRFLENYPTIGQNGGSFTGPEPLLSENRIGEFSSTGSTLPDTDHMVKFVNGQMLYSCVVCKRSYVTLSSLRRHANVHSWRRTYPCHYCNKVFALAEYRTRHEIWHTGERRYQCIFCLETFMTYYILKNHQKSFHAIDHRLSISKKTANGGLKPSVYPYKLYRLLPMKCKRAPYKSYRNSSYENARENSQMNESAPGTYVVQNPHSSELPTLNFQDTVNTLTNSPAIPLETSACQDIPTSANVQNAEGTKWGEEALKMDLDNNFYSTEVSVSSTENAVSSDLRAGDVPVLSLSNSSENAASVISYSGSAPSVIVHSSQFSSVIMHSNAIAAMTSSNHRAFSDPAVSQSLKDDSKPEPDKVGRFASRPKSIK

SEQ ID NO: 2992 - protein, 890 aa, Homo sapiens
MCVRSCFQSPRLQWVWRTAFLKHTQRRHQGSHRWTHLGGSTYRAVIFDMGGVLIPSPGRVAAEWEVQNRIPSGTILKALMEGGENGPWMRFMRAEITAEGFLREFGRLCSEMLKTSVPVDSFFPLLTSERVAKQFPVMTEAITQIRAKGLQTAVLSNNFYLPNQKSFLPLDRKQFDVIVESCMEGICKPDPRIYKLCLEQLGLQPSESIFLDDLGTNLKEAARLGIHTIKVNDPETAVKELEALLGFTLRVGVPNTRPVKKTMEIPKDSLQKYLKDLLGIQTTGPLELLQFDHGQSNPTYYIRLANRDLVLRKKPPGTLLPSAHAIEREFRIMKALANAGVPVPNVLDLCEDSSVIGTPFYVMEYCPGLIYKDPSLPGLEPSHRRAIYTAMNTVLCKIHSVDLQAVGLEDYGKQGDYIPRQVRTWVKQYRASETSTIPAMERLIEWLPLHLPRQQRTTVVHGDFRLDNLVFHPEEPEVLAVLDWELSTLGDPLADVAYSCLAHYLPSSFPVLRGINDCDLTQLGIPAAEEYFRMYCLQMGLPPTENWNFYMAFSFFRVAAILQGVYKRSLTGQASSTYAEQTGKLTEFVSNLAWDFAVKEGFRVFKEMPFTNPLTRSYHTWARPQSQWCPTGSRSYSSVPEASPAHTSRGGLVISPESLSPPDRELYHRLKHFMEQRVYPAEPELQSRQASAARWSPSPLIEDLKEKAKAEGLWNLFLPLEADPEKKYGAGLTNVEYAHLCELMGTSLYAPEVCNCSAPDTGNMELLVRYGTEAQKARWLIPLLEGKARSCFAMTEPQVASSDATNIEASIREEDSFYVINGHKWWITGILDPRCQLCVFMGKTDPHAPRHRQQSVLLVPMDTPGIKIIRPLTVYGLEDAPGCFLPSFSL

SEQ ID NO: 2993 - protein, 163 aa, Homo sapiens
MSCRGRGAGGRWNSTSWSTGCKLPASPRRVSRCSPTGLIKLAFLFSKTRCKFFSLTETPEDYTIIVDEEGFLELPSSEHLSVADATWLALNVVSGGGSFSSSQPIGMTKIAKSVIAPLADQNISVFMLSTYQTDFILVLKRDLPFVTHTLSSEFTILWSVARL

SEQ ID NO: 2994 - protein, 371 aa, Homo sapiens [sequence omitted]

SEQ ID NO: 2995 - protein, 400 aa, Homo sapiens
MSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGYPSLQVELETPTGLHYTPPTPFQQDDYFSDISSIESPLRTPSRLSDGLVPSQGNIEHSADGPPVVTAEDASLEDSKLEDSVPLTEMPEAVDVDESQLENVCLSWQNETSSGNLESCAQARRVTGGLLDRLDDSPDQCRDSITSYLKGEAGKFEANGSHTEITPEAKTKSYFPESQNDVGKQSTKETLKPKIHGSGHVEEPASPLAAYQKSLEETSKLIIEETKPCVPVSMKKMSRTSPADGKPRLSLHEEEGSSGSEQKQGEGFKVKTKKEIRHVEKKSHS

SEQ ID NO: 2996 - protein, 105 aa, Homo sapiens [sequence omitted]

SEQ ID NO: 2997 - protein, 100 aa, Homo sapiens
MFLKALVKAESKFHVVGQRTEGRIQVSCGRTENGNLQNYTKPKMAHVPLCSFIYLFSRYLLNHLVWFGFEHALIHLITTTLRCSYCYNPHPKGVRNRVIK

SEQ ID NO: 2998 - protein, 302 aa, Homo sapiens
MAATLLMAGSQAPVTFEDMAMYLTREDWRPLDAAQRDLYRDVMQENYGNVVSLDFEIRSENEVNPKQEISEDVQFGTTSERPAENAEGNPESEEGFESGDRSERQWGDLTAEEWVSYPLQPVTDLLVHKEVHTGIRYHICSHCGKAFSQISDLNRHQKTHTGDRPYKCYECGKGLSRSSHLIQHQRTHTGERPYDCNECGKSFGRSSHLIQHQTIHTGEKPHKCNECGKSFCRLSHLIQHQRTHSGEKPYECEECGKSFSRSSHLAQHQRTHTGEKPYECTECEKSFSRSSALIKHKRVHTD

SEQ ID NO: 2999 - protein, 213 aa, Homo sapiens; identical to SEQ ID NO: 2579

SEQ ID NO: 3000 - protein, 287 aa, Homo sapiens
MKTLETQPLAPDCCPSDQDPAPAHPSPHASPMNKNADSELMPPPPERGDPPRLSPDPVAGSAVSQELREGDPVSLSTPLETEFGSPSELSPRIEEQELSENTSLPAEEANGSLSEEEANGPELGSGKAMEDTSGEPAAEDEGDTAWNYSFSQLPRFLSGSWSEFSTQPENFLKGCKWAPDGSCILTNSADNILRIYNLPPELYHEGEQVEYAEMVPVLRMVEGDTIYDYCWYSLMSSAQPDTSYTGVSVSMSLSAWPAAAGRTRFISGTHSLESSGLPFAPTTTWMS

SEQ ID NO: 3001 - protein, 118 aa, Homo sapiens
MGLVICSFLALKIVVSKRDHGRNHCNGSNSNTCHLYCALGLPGVSKYISIFDMCRTRYLGTCHTPLSRYVLASLELKGLELRTCSLFFIHMSLVGLHPDHTMTSYRARENNIIISSFA

SEQ ID NO: 3002 - protein, 124 aa, Homo sapiens [sequence omitted]

SEQ ID NO: 3003 - protein, 752 aa, Homo sapiens
MGTSALWALWLLLALCWAPRESGATGTGRKAKCEPSQFQCTNGRCITLLWKCDGDEDCVDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQSTATTVTYSETKDTNTTEISATSGLVPGGINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 3004 - protein, 118 aa, Homo sapiens
MMLRLLSSLLLVAVASGYGPPSSRPSSRVVNGEDAVPYSWPWQVSLQYEKSGSFYHTCGGSLIAPDWVVTAGHCISSSWTYQVVLDETPCYITGWGRLYTNGPLCASTLEPLVCGLWQ

SEQ ID NO: 3005 - protein, 601 aa, Homo sapiens
MMQESGTETKSNGSAIQNGSGGSNHLLECGGLREGRSNGETPAVDIGAADLAHAQQQQQQALQVARQLLLQQQQQQQVSGLKSPKRNDKQPALQQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 3006 - protein, 496 aa, Homo sapiens
MDWTWRVFCLLAVAPGAHSQEQLVQSGAEVKRPGASVKITCKAPGHTFSSYHYHWVRQAPGQGLEWLGIINPRGGQTTYAQKLQGRVTMTSDTSTATVNMELSSLRSEDTAVYYCVSAAYCSGDCYPGIFDLWGRGTLVTVSAASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPERDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 3007 - protein, 153 aa, Homo sapiens
MERHRRIHTGEKPYKCKVCDKAFRRDSHLAQHQRVHTGEKPYKCNECGKTFRQTSSLIIHRRLHTGEKPYKCNECGKTFSQMSSLVYHHRLHSGEKPSKCNECGKVFNQQAHLAQHQRVHTGEKPYKCNECGKTFSQMSNLVYHHRLHSGEKP

SEQ ID NO: 3008 - protein, 110 aa, Homo sapiens [sequence omitted]

SEQ ID NO: 3009 - protein, 136 aa, Homo sapiens [sequence omitted]

SEQ ID NO: 3010 - protein, 406 aa, Homo sapiens
MAASAPPPPDKLEGGGGPAPPPAPPSTGRKQGKAGLQMKSPEKKRRKSNTQGPAYSHLTEFAPPPTPMVDHLVASNPFEDDFGAPKVGVAAPPFLGSPVPFGGFRVQGGMAGQVPPGYSTGGGGGPQPLRRQPPPFPPNPMGPAFNMPPQGPGYPPPGNMNFPSQPFNQPLGQNFSPPSGQMMPGPVGGFGPMISPTMGQPPRAELGPPSLSQRFAQPGAPFGPSPLQRPGQGLPSLPPNTSPFPGPDPGFPGPGGEDGGKPLNPPASTAFPQEPHSGSPAAAVNGNQPSFPPNSSGRGGGTPDANSLAPPGKAGGGSGPQPPPGLVYPCGACRSEVNDDQDAILCEASCQKWFHRECTGMTESAYGLLTTEASAVWACDLCLKTKEIQSVYIREGMGQLVAANDG

SEQ ID NO: 3011 - protein, 243 aa, Homo sapiens
MSQSRLPKGSQPGAVELSGLCLRSCVLTTVAAAPGGLRPAPLHTWAAGLPRASPQTSGEGSPRGREGSLMPISFRSLRATRPTDVGLSCLDVQFLWLTPQARSSGTEGGLWAPVDFHSQDFTSLPRASDRTATSSHECRAWTKLERQRRLWQGPSWKPWQARACMCWLARAYFGVCVGDTGLLRDWRGSRVGSSLVEARPGTHSVVQIPAPLPAVSTVSSPVKWEYLCGGRVLRFPRANLPAV

SEQ ID NO: 3012 - protein, 120 aa, Homo sapiens
MARSNLPLALGLALVAFCLLALPRDARARPRERMVGELRDLSPDDPQVQKAAQAAVASYNMGSNSIYYFRDTHIIKAQSQVRRAGCWEGTPGPDGGGHRRCPSVHEGGLKAQSGYFHAIF

SEQ ID NO: 3013 - protein, 237 aa, Homo sapiens
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIRPLPRFALSPPHSSTCENRAPEASKGGRAQDSRGPGPGTEPALCGSGPSSPQQAPPAVHSGPC

SEQ ID NO: 3014 - protein, 122 aa, Homo sapiens
MKITRGVHRQVPSCQQLLQKPMFFFSPILRHSQNWSERGVKWDTSFKVGKPKKGASTSSLSSFSPAFFGRIRGTGAALGKVCPTRVSQLVARRGGGEGGSSSEPVTARMIEPASRLPRSPRT

SEQ ID NO: 3015 - protein, 420 aa, Homo sapiens
MGTSKEKAKTVTLKQALLGHTDTVTCATASLAYHIIVSGSRDRTCIIWDLNKLSFLTQLRGHRAPVSALCINELTGDIVSCAGIYIHVWSINGNPIVSVNTFTGRSQQIICCCMSEMNEWDTQNVIVTGHSDGVVRFWRMEFLQVPETPAPEPAEVLEMQEDCPEAQIGQEAQDEDSSDSEADEQSISQDPKDTPSQPSSTSHRPRAASCRATAAWCTDSGSDDSRRWSDQLSLDEKDGFIFLNYSEGQTRAHLQGPLSHPHPNPIEVRNYSRLKPGYRWERQLVFRSKLTMHTAFDRKDNAHPAEVTALGISKDHSRILVGDSRGRVFSWSVSDQPGRSAADHWVKDEGGDSCSGCSVRFSLTERRHHCRNCGQLFCQKCSRFQSEIKRLKISSPVRVCQNCYYNLQHERGSEDGPRNC

SEQ ID NO: 3016 - protein, 112 aa, Homo sapiens [sequence omitted]

SEQ ID NO: 3017 - protein, 574 aa, Homo sapiens
MNWNEKPKSATLPPLYPKSQPPFLHQSLINQITTTSQSSFSYPGSNQEACMYPGNSNPISQPLLNIQNYPQQISVSDMHNGTVVASHTSVERITYANVNGPKQLTHNLQMSSGVTQNVWLNSPMRNPVHSHIGATVSHQTDFGANVPNMPALQSQLITSDTYSMQMQMIPSNSTRLPVAYQGNQGLNQSFSEQQVDWTQQCISKGLTYPDYRPPPKLYRYSPQSFLPDSTIQKQNFIPHTSLQVKNSQLPNSVLTLPSRQTSAVPSQQYATQTDKRPPPPPYNCRYGSQPLQSTQHITKHLSMEVPQSREMLSSEIRTSFQQQWQNPNENVSTIGNFTNLKVNTNSKQPFNSPIRSSVDGVQTLAQTNEEKIMDSCNPTSNQVLDTSVAKEKLVRDIKTLVEIKQKFSELARKIKINKDLLMAAGCIKMTNTSYSEPAQNSKLSLKQTAKIQSGPQITPVMPENAERQTPTVVESAETNKTQCMLNSDIQEVNCRRFNQVDSVLPNPVYSEKRPMPDPSHDVKVLTSKTSAVEMTQAVLNTQLSSENVTKVEQNSPAVCETISVPKSMSTEEYK

SEQ ID NO: 3018 - protein, 842 aa, Homo sapiens
MDVAASQHMLVCALQELGNLIHNLGTTAAPLLQDSSTGLLDSILSVILHPSISVRLAAAWCLHCIAVALPSYLTPLLDRCLERLTGHKSSPEAVTGFSFAVAALLGAVKHCPLGIPHGKGKIIMTLAEDLLCSAAQNSRLSAQRTQAGWLLISALMTLGPAVVSHHLARVLLLWKCVFPASPKDLETEKSRGDSFTWQVTLEGRAGALCAIKSFVSHCGDLLTEEVTQRLLPPLPCAVDLLTQLSSILKMYGSPLKTPSVVYRQRLYELLILLPPETYEGNLCAILRELAADLTAPDIQVAASTFLLPPLCHQDDLLILSPFLQETDHRFIEEQLLLGNGVACGSLEYDPYSIYEKDVEGDSVPKPLPPALSVVSSASKLFGVVCAHVGETQRLLILEQLLDSIKHTKGARQQVVQLHVVSSVSSFLKYVAGSKGCLGPEEMKRFALTLVMGALESPNPLLRCAAAESWARLAQMVDDGAFTAGLAQVSFDKLKSARDVVTRTGHSLALGSLHRYLGGISSSQHLNSCIGILYTLAQDSTSPDVQTWALHSLSLIIDSAGPLYYVHVEPTLSLIIMLLLNVPPTHAEVHQSLGRCLNALITTLGPELQGNSTSISTLRTSCLLGCAVMQDNPDCLVQAQAISCLQQLHMFAPRHVNLSSLVSCLCVNLCSPYLLLRRAVLACLRQLVQREAAEVSEHAVMLAKDSREELTPDANIREVGLEGALLILLDKETDEGLCHDIKETLNYMLTSMAVEKLSLWLKLCKDVLAASADFTAVTCVDTMQEEEGDKGDDASVLTTRRDEKSHPFTNPRWATRVFAAECVCRIINQCENANSAHFDIALA

SEQ ID NO: 3019 - protein, 453 aa, Homo sapiens
MHVMNCVSLVSDKENGNIATAPGFMIGQTPPPAPPPPPPPPPPSPPCSCSREECPSSPPPPPPGLPPTTHMNGYSHLGKKKRMRSFFWKTIPEEQVRGKTNIWTLAARQEHHYQIDTKTIEELFGQQEDTTKSSLPRRGRTLNSSFREAREEITILDAKRSMNIGIFLKQFKKSPRSIVEDIHQGKSEHYGSETLREFLKFLPESEEVKKLKAFSGDVSKLSLADSFLYGLIQVPNYSLRIEAMVLKKEFLPSCSSLYTDITVLRTAIKELMSCEELHSILHLVLQAGNIMNAGGYAGNAVGFKLSSLLKLADTKANKPGMNLLHFVAQEAQKKDTILLNFSEKLHHVQKTARLSLENTEAELHLLFVRTKSLKENIQRDGELCQQMEDFLQFAIEKLRELECWKQELQDSAKWCNGKPVLLGGSRSLAPELPAARVAPTPSPLLLDSSGSHL

SEQ ID NO: 3020 - protein, 184 aa, Homo sapiens
MTLNDIKIIQVSCGHYHSLALSKDSQVFSWGKNSHGQLGLGKEFPSQASPQRVRSLEGIPLAQVAAGGAHSFALSLCGTSFGWGSNSAGQLALSGRNVPVQSNKPLSVGALKNLGVVYISCGDAHTAVLTQDGKVFTFGDNRSGQLGYSPTPEKRGPQLVERIDGLVSQIDCGRNSKHGFMTFF

SEQ ID NO: 3021 - protein, 702 aa, Homo sapiens [sequence omitted]

SEQ ID NO: 3022 - protein, 124 aa, Homo sapiens [sequence omitted]

SEQ ID NO: 3023 - protein, 345 aa, Homo sapiens
MEDPTLYIVERPLPGYPDAVDQIQLTQAQLEERQAEMEGAVQSIQGELSKLGKAHATTSNTVSKLLEKVRKVSVNVKTVRGSLERQAGQIKKLEVNEAELLRRRNFKVMIYQDEVKLPAKLSISKSLKESEALPEKEGEELGEGERPEEDAAALELSSDEAVEVEEVIEESRAERIKRSGLRRVDDFKKAFSKEKMEKTKVRTRENLEKTRLKTKENLEKTRHTLEKRMNKLGTRLVPAERREKLKTSRDKLRKSFTPDHVVYARSKTAVYKVPPFTFHVKKIREGQVEVLKATEMVEVGADDDEGGAERGEAGDLRRGSSPDVHALLEITEESDAVLVDKSDSD

SEQ ID NO: 3024 - protein, 427 aa, Homo sapiens
MPGLMPPGLLAAAVSGLGSRGLTLAPGLSPARPLFGSDFEKEKQQRNADCLAELNEAMRGRAEEWHGRPKAVREQLLALSACAPFNVRFKKDHGLVGRVFAFDATARPPGYEFELKLFTEYPCGSGNVYAGVLAVARQMFHDALREPGKALASSGFKYLEYERRHGSGEWRQLGELLTDGVRSFREPAPAEALPQQYPEPAPAALCGPPPRAPSRNLAPTPRRRKASPEPEGEAAGKMTTEEQQQRHWVAPGGPYSAETPGVPSPIAALKNVAEALGHSPKDPGGGGGPVRAGGASPAASSTAQPPTQHRLVARNGEAEVSPTAGAEAVSGGGSGTGATPGAPLCCTLCRERLEDTHFVQCPSVPGHKFCFPCSREFIKAQGPAGEVYCPSGDKCPLVGSSVPWAFMQGEIATILAGDIKVKKERDP

SEQ ID NO: 3025 - protein, 173 aa, Homo sapiens [sequence omitted]

SEQ ID NO: 3026 - protein, 107 aa, Homo sapiens
MRDQLILILSPAGIVSIFSLAALTCESWCLLIALICMSLMTNDAEHLSVCSFFSPLLNRILCFLTVEFRATFIHSRYNLLDQICNLQIFSPSLYLVFSSSLTIYFAE

SEQ ID NO: 3027 - protein, 632 aa, Homo sapiens
MSDCCSAPGISWEAGVGRPAVPGLELQIRRGAMSEETVSESQFSLKTAALRVFDLPLTWYYSLSQIKFSPVAKKLFVVTAVSAISVIFLAHHFKRKRGKKKGKILPWEPEHLILEYTKRAASDKGSSCSSSRQNLTLSLSSTKDKGSQVCNYANGGLFSKYSGSAQSLASVQSVNSCHSCACGNSNSWDKADEDDIKLVNIPVTTPENLYLMGMELFEEALRRWEQALTFRNRQAEDEACGSIKLGAGDAIAEENVDDIISTEFIHKLEALLQRAYRLQEEFEATLGASDPNSLADDIDKDTDITMKGNVEDFGLRDTLSIASTDSFASAAELAEHREVRHTYSLESLCHCPFYEEAMHLVEEGKIYSRVLRTEMLECLGDSDFLAKLHCIRQAFQVILSESANRIFLAESGRKILSALIVKARKNPKKFEDVFDEMIYFLEQTDHWGSTEMELAARGVKNLNFYDVVLDFILMDSFEDLENPPTSIQNVVNNRWLNSSFKETAVASSCWSVLKQKRQQMKIPDGFFAHFYAICEHISPVLAWGFLGPRNSLYDLCCFFKNQVLLFLKDIFDFEKVRYSSTETLAEDLMQLLIRRTELLMAYLEADALRHTSSCLSSHGHVMSTGLLEAKVQ

SEQ ID NO: 3028 - protein, 285 aa, Homo sapiens
MTPGTASELRREPPGRREQPPTPKAHIASRSSGPGKEHASGSPGLHLTPGREGPPAQTSLPASSGLDDLDLLGKTLLQQSLPPESQQVRWEKQQPTPRLTLRDLQNKSSSCSSPSSSATSLLHTVSPEPPRPPQQPVPTELSLASITVPLESIKPSNILPVTVYDQHGFRILFHFARDPLPGRSDVLVVVVSMLSTAPQPIRNIVFQSAVPKVMKVKLQPPSGTELPAFNPIVHPSAITQVLLLANPQKEKVRLRYKLTFTMGDQTYNEMGDVDQFPPPETWGSL

SEQ ID NO: 3029 - protein, 224 aa, Homo sapiens [sequence omitted]

SEQ ID NO: 3030 - protein, 112 aa, Homo sapiens
MSHHAWPHVHFFFFLRQSLALLPRLECSGAISARCKLRLPDSRHSPASASRVAGTTGARHHAWLIFCMFGRDGVSLCWPGWSRSPDLMICPPWPPKVLGITGVSHRAGPKYF

SEQ ID NO: 3031 - protein, 357 aa, Homo sapiens
MTSQPLRLAEEYGPSPGESELAVNPFDGLPFSSRYYELLKQRQALPIWAARFTFLEQLESSPTGVVLVSGEPGSGKSTQIPQWCAEFALARGFQKGQVTVTQPYPLAARSLALRVADEMDLTLGREVGYSIPQEDCTGPNTLLRFCWDRLLLQEVASTRGTGAWGVLVLDEAQERSVASDSLQGLLQDARLEKLPGDLRVVVVTDPALEPKLRAFWGNPPIVHIPREPGERPSPIYWDTIPPDRVEAACQAVLELCRKELPGDVLVFLPSEEEISLCCESLSREVESLLLQGLPPRVLPLHPDCGRAVQAVYEDMDARKVVVTHWLADFSFSLPSIQHVIDSGLELRSVSEREIAVG

SEQ ID NO: 3032 - protein, 216 aa, Homo sapiens [sequence omitted]

SEQ ID NO: 3033 - protein, 433 aa, Homo sapiens
MALDLRTIFQCEPSENNLGSENSAFQQSQGPAVQREEGISEFSRMVLNSFQDSNNSYARQELQRLYRIFHSWLQPEKHSKDEIISLLVLEQFMIGGHCNDKASVKEKWKSSGKNLERFIEDLTDDSINPPALVHVHMQGQEALFSEDMPLRDVIVHLTKQVNAQTTREANMGTPSQTSQDTSLETGQGYEDEQDGWNSSSKTTRVNENITNQGNQIVSLIIIQEENGPRPEEGGVSSDNPYNSKRAELVTARSQEGSINGITFQGVPMVMGAGCISQPEQSSPESALTHQSNEGNSTCEVHQKGSHGVQKSYKCEECPKVFKYLCHLLAHQRRHRNERPFVCPECQKGFFQISDLRVHQIIHTGKKPFTCSMCKKSFSHKTNLRSHERIHTGEKPYTCPFCKTSYRQSSTYHRHMRTHEKITLPSVPSTPEAS

SEQ ID NO: 3034 - protein, 258 aa, Homo sapiens
MTHDKSWRRCSISGSTKCRCGSRIAGPNALGSGGSRSSSSSSRSILSSSILSSSIPSSSSSSSSPSSSHSSSSPSSSHSSSSPSSSSSTSSPSSSSSSSSSSSPSSSNSSSSSSSSSPSSSSSSSSSSPSSSSSSPSSSSSSSSSSPSSSSSSPSSSSSSSSSSSSSPSSSSPSSSGSSPSSSNSSPSSSSSSPSSSSSSPSPRSSSPSSSSSSTSSPSTSSPSSSSPSSSSPSSSCPSAALGRRPQSPQSSHCAPFP

SEQ ID NO: 3035 - protein, 158 aa, Homo sapiens [sequence omitted]

SEQ ID NO: 3036 - protein, 317 aa, Homo sapiens
MTGMCYAPHQVLSYINGVTTSKPGVSLVYSMPSRNLSLRLEGLQEKDSGPYSCSVNVQDKRGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTISKNGTLSSVTSARALRPPHGPPRPGALTPTPSLSSQALPSPRLPTTDGAHPQPISPIPGGVSSSGLSRMGAVPVMVPAQSQAGSLV

SEQ ID NO: 3037 - protein, 214 aa, Homo sapiens
MPSPWGWFAVTACGAQRNNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDAEPVLISLRDGYVPPKHRELRVTKRNILDVRPPSGPRRSQSASDAPLSQHTLETLLEEIKALRERVQAQEQRITALENMLCELVDGTD

SEQ ID NO: 3038 - protein, 125 aa, Homo sapiens
MGTTRSIPRDSPLGCLLSYWSKFKFGLKKKKLILYCNTIWVKYKLDDEYIWPKHGSIYYSDILRLGLFCKREGKWEEIPYVQAFMALYWITLLPGIRMPCIRDPHLAAPHRKFISLPRVSSVPQS

SEQ ID NO: 3039 - protein, 131 aa, Homo sapiens
MGRDRWVEEWKMEDGEGQMSGGVADGGGWLEGQMLGDCWGCRCGTGRGQVEGKQHTDADRWPERLIVQWQRPRPGGCRPPTHGCARSSTAPPAGCSSPPAGSPRCSPGLCRSSTAGQCLWGGVGGASEAAP

SEQ ID NO: 3040 - protein, 476 aa, Homo sapiens
MRRAKVLDWGLQEQLWPHMEALRPRPSVYIPEFIAANQSARADNLIPGSRAQQVLSHPASLASCHLFFATWFPLFAPPRESRPHLTPGELSSPGLCESESMYNQLPYTLSILPTPSPSNPQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGDEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 3041 - protein, 229 aa, Homo sapiens
MPAAGPPLLLLGTPGSGKTALLFAAALEAAGEGQGPVLFLTRRPLQSMPRGTGTTLDPMRLQKIRFQYPPSTRELFRLLCSAHEAPGPAPSLLLLDGLEEYLAEDPEPQEAACLIALLLDTAAHFSHRLGPGRDCGLMVALQTQEEAGSGDVLHLALLQRYFPAQCWLQPDAPGPGEHGLRACLEPGGLGPRTEWWVTFRSDGEMMIAPWPTQAGDPSSGKGSSSGGQP

SEQ ID NO: 3042 - protein, 109 aa, Homo sapiens
MASLLKKSKCLCDAEHRSQTHTRISRSSSSRCCFSLSSCWSRELRAQRCSEIISCEQDHTPHHRELAAAQESRSGRMEKGLASRSLGSLPNASRLRWGTKLRGPSAPLP

SEQ ID NO: 3043 - protein, 217 aa, Homo sapiens
MAHKHWGRNRRGGSKGTRPLTSDPTTSREAISVVMVVPGLALPAPTPTTQSLHPVTPPSCDLPLPSISHAFPSPPSGSLPSLWPPVPTSHAPSRGNLCQGSLHFLAPASLPGTQAGPGTLVLNKGTRLNDVGGNLPSVGTGANTTHCQHGPRATPPQASTSSPEEARGSTGHAPEWEVTHGEGSLVPRGLAVSLLRCRAHYGPRRGLSRVISSSQQL

SEQ ID NO: 3044 - protein, 222 aa, Homo sapiens [sequence omitted]

SEQ ID NO: 3045 - protein, 155 aa, Homo sapiens [sequence omitted]

SEQ ID NO: 3046 - protein, 277 aa, Homo sapiens [sequence omitted]

SEQ ID NO: 3047 - protein, 158 aa, Homo sapiens
MESHSVTQAGVQWCGLGSLQPLPPGFKRFFCLSLLSSWDYRRVPPPLANFCIFFSFFFEKESLSVTQAGVQWHDLGSLQAAPPGFTPFSCLSLPSSWNYRRPPPCPANFFVFLVEMGFCHIGQAGLELLTSSDPPTSASQSAGITGMSHRTWPDLCMS

SEQ ID NO: 3048 - protein, 229 aa, Homo sapiens
MSACAPWIVPPAQLQGSWAAGTRLRGSWALAHRDNMAAGSSWSCSRPRVPVTQLSRSLQVHSLMILPASSSAPCPHCPLAPLWLLNLLSSCPPALSCLPRTLVPACRGLPLSSVPSSPASRPKLPLHSPSSWSIPPEGSWGPLPTTLPLPWGLHVCRAGSTNLLSQQPLGKGWLWIPALTLSWPFLCSPLLKSTSNLVFGAGLAPSLGSGSSLSTRASPPSLLGAALRG

SEQ ID NO: 3049 - protein, 106 aa, Homo sapiens
MTSPLCNLSLWGLYQRHGTSVWYPDCEISLWAKEGPTDKVASQPHPRNPRDFTPAGCHWGTELSQLSLPSCLAFVNHQSGERVSGLARIWAGWKSLSRSEIKGLGI

SEQ ID NO: 3050 - protein, 300 aa, Homo sapiens
MEDILEELLQHREPKALQLYLRKALSNSLHPLGKLLRTLMLTFQATYAGVGANKHLQELAQEEVKQHAQELWAAYRGLLRVALERKGQALEEDEDTETRDLQVHGLVLPLMLPSFYSELFTLYLLLHEREDSFYSQGIANLSLFPDTQLLEFLDVQKHLWPLKDLTLTSNQRYSLVRDKCFLSATECLQKIMTTVDPREKLEVLERTYGEIEGTVSRVLGREYKLPMDDLLPLLIYVVSRARIQHLGAEIHLIRDMMDPNHTGGLYDFLLTALESCYEHIQKEDMRLHRLPGHWHSRELW

SEQ ID NO: 3051 - protein, 118 aa, Homo sapiens
MGCTGWRRLGNRQGGQLGFRERQVHAGRSDPVRSLGASGWVGSRHSHSHRIPEHCYKALSVCPSHRIPEHCCHCLNVCPPHRIPEVCCWGLNVCPPSRIPEHCCEGLNVCPSHMILEY

SEQ ID NO: 3052 - protein, 867 aa, Homo sapiens
MYHRVLVHSNCLSLQEVEDFCRLRCLCVAFQLHLPLSQRACSRVITCSWIRNSDSFLKMNKWYEYFILSNLNVFGCWNLNLNHVSDLYDEQLLKNIAFYYEFESTQEPHLNLGDSIRRDYEDLWNVVSHLVKEFNLGKSFPLRTTRRHFLRQEKSVIQEISLEKMPSVGFIPMTSAVIDEFVGDMMKDLPILKSDDPVVPSLFKQKTSDELLHWHAQRLLSDDYDRIKCHVDEQSRDPHVLDFLKKIQDYQQFYGKSLESISTKVIVTQTTRPKEDSSGASGEILQNTKPHQITKKSKKKSFLKEDQNKAQQNDDLLFSIEEEMKNNLHSGIRKLEDYLTSCASNSVKFGVEMLGLIACFKAWKKHCRGEGKISKDLSIAVQMMKRIHSLLERYPEILEAEHHQYIAKCLKYLGFNDLANSLDPTLIGDDKNKKKYSIDIGPARFQLQYMGHYLIRDERKDRDPRVQDFIPNAWQQELLDVVDKNESAVIVAPTSSGKTYASYYCMEKVLRESDVGVVVYVAPAKSLVGQVAATVENRFTKTLPAGRTLCGAFTRDYRHNVLNCQVHYLGREVGAKFWELLLVIIRCPFLVLSATINNPNLLTKWLQSVKQYWKQADKIMEEKCISEKQADKCLNFLQDHSYKNQSYEVRLVLCGERYNDLEKHICSVKHDDVYFDHFHPCAALTTDIIEKYGFPPDLTLTPQESIQLYDTMAQVWETWPRAQELCPEEFILFKNKIVIKKLDARKYEENLKAELTNWIKNGQVKKVKRVLKNLSPDSLSSSKDMVKMFPLLVEKLRQMDKLPAIFFLFKNDDVGKRAGSVCTFLEKTETKSHPHTECHSYVFAIDEVLEKVRKTQKRITKKNPKKA

SEQ ID NO: 3053 - protein, 588 aa, Homo sapiens [sequence omitted]

SEQ ID NO: 3054 - protein, 134 aa, Homo sapiens
MSGLGSGRGRQGTLASSPLSLPLLLAGVTGILATELFDQMAGPAACMVCGALMWIMLILVGLGFPFIMEALSHFLYVPFLGVCVCGAIYTGLFLPETKGKTFQEISKELHRLNFPRRAQGPTWRSLEVIQSTEL

SEQ ID NO: 3055 - protein, 113 aa, Homo sapiens
MLRHGWRTGAIIPELEREIRIINTEQYMHSLTWQQALTGLLERMQTYQDAESRQVLAAWMKERQELSCLLNYRVDFTFYPRRTPLQHEAPLWMDQLCTGCMKTPFLGDMAHIR

SEQ ID NO: 3056 - protein, 233 aa, Homo sapiens
METSASSSQPQDNSQVHRETEDVDYGETDFHKQDGKAGLFSQEQYERNKSSSSSSSSSSSSSSSSSSSSSESNDEDQQPRATGKHRRSLGAGYPHGNGSPGPGHGEPDVLKDELQLYGDAPGEVVPSGESGLRRRGSDPASGEVEASQLRRLNIKKDDEFFHFVLLCFAIGALLVCYHYYADWFMSLGVGLLTFASLETVGIYFGLVYRIHSVLQGFIPLFQKFRLTGFRKTD

SEQ ID NO: 3057 - protein, 187 aa, Homo sapiens
MNGMSVLMKETLKSSVTPSPYEETGERQPSVNWAVSPHQTQNQWARWSWTSQPLELHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 3058 - protein, 463 aa, Homo sapiens
MRPWPLGKALSGADVGECSSGICDEASCIHGGTCTAIKADSYICLCPLGFKGRHCEDAFTLTIPQFRESLRSYAATPWPLEPQHYLSFMEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKAIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 3059 - protein, 518 aa, Homo sapiens
MIPQTPHHCSPGAAMSVQVAAPGSAGLGPERLSPEELVRQTRQVVQGLEALRAEHHGLAGHLAEALAGQGPAAGLEMLEEKQQVVSHSLEAIELGLGEAQVLLALSAHVGALEAEKQRLRSQARRLAQENVWLREELEETQRRLRASEESVAQLEEEKRHLEFLGQLRQYDPPAESQQSESPPRRDSLASLFPSEEEERKGPEAAGAAAAQQGGYEIPARLRTLHNLVIQYAGQGRYEVAVPLCRQALEDLERSSGHCHPDVATMLNILALVYRDQNKYKEATDLLHDALQIREQTLGPEHPAVAATLNNLAVLYGKRGRYREAEPLCQRALEIREKVLGADHPDVAKQLNNLALLCQNQGKFEDAERHYARALSIYEALGGPHDPNVAKTKNNLASAYLKQNKYQQAEELYKEILHKEDLPAPLGAPNTGTAGDAEQALRRSSSLSKIRESIRRGSEKLVSRLRGEAAAGAAGMKRAMSLNTLNVDAPRAPGTQFPSWHLDKAPRTLSASTQDLSPH

SEQ ID NO: 3060 - protein, 105 aa, Homo sapiens [sequence omitted]

SEQ ID NO: 3061 - protein, 214 aa, Homo sapiens
MCIIFFKFDPRPVSKNAYRLILAANRDEFYSRPSKLADFWGNNNEILSGLDMEEGKEGGTWLGISTRGKLAALTNYLQPQLDWQARGRGTYGLSNALLETPWRKLCFGKQLFLEAVERSQALPKDVLIASLLDVLNNEEAQLPDPAIEDQGGEYVQPMLSKYAAVCVRCPGYGTRTNTIILVDADGHVTFTERSMMDKDLSHWETRTYEFTLQS

SEQ ID NO: 3062 - protein, 178 aa, Homo sapiens
MTSPMSSSTLAHSLAAIEALADGPTSTSTCLEAQGGPSSPVQLPPASGAEEPDLQSLEAMMEVVVVQQFKCKMCQYRSSTKATLLRHMRERHFRPVAAAAAAAGKKGRLRKWSTSTKTQEEEGPEEEDDDDIVDAGAIDDLEEDSDYNPAEDEPRGRQLRLQRTTPSPPSKSLHWQMQ

SEQ ID NO: 3063 - protein, 280 aa, Homo sapiens
MLSLLNRRQEERLREQEERLREQEERQREQEDRLHEQEERLREQEERLCEQEERLCEQEERLREHEERLCEQEERLCEQEERLREQEERLHEQEERLREQEERLCEQEERLREHEERLCEQEERLREQEERLCEQEERLREQEERLCEQEERLREQEERLCEQEKLPGQERLLEEVEKLLEQERRQEEQERLLERERLLEEVEKLLEQERQQEEQERLLERERLLEEVEKLLEQERRQEEQERLLERERLLDEVEELLDEVEELLEQERLRQQDERLWQQ

SEQ ID NO: 3064 - protein, 216 aa, Homo sapiens
MERSWASVADPSLPQLKSFLRECKVANYCRQVQQLLGKVQENSAYICSRRQRVSFGVSEQQAVEAWEKLTREEGTPLTLYYSHWRKLRDREIQLEISGKERLEDLNFPEIKRRKMADRKDEDRKQFKDLFDLNSSEEDDTEGFSERGILRPLSTRHGVEDDEEDEEEGEEDSSNSEGEWSWDGDPDAEAGLAPGELQQLAQGPEDELEDLQLSEDD

SEQ ID NO: 3065 - protein, 303 aa, Homo sapiens
MRITCNPKVEVAGLQPGLQSNTPTQKKKRAGISTSILSLGNRSEAMVLTVSRLGQMWLWLSPSAALDPWQRHPWCREALGWPCGCSHLASLSLRQESLSRLLSTCGLVQSVELQEKPDLAESPKESRSKFFHPKPVPGFQVAYVVFQKPSGVSAALALKGPLLVSTESHPVKSGIHKWISDYADSVPDPEALRVEVDTFMEAYDQKIAEEEAKAKEEEGVPDEEGWVKVTRRGRRPVLPRTEAASLRVLERERRKRSRKELLNFYAWQHRESKMEHLAQLRKKFEEDKQRIELLRAQRKFRPY

SEQ ID NO: 3066 - protein, 274 aa, Homo sapiens
MDRPGFVAALVAGGVAGVSVDLILFPLDTIKTRLQSPQGFNKAGGFHGIYAGVPSAAIGSFPNAAAFFITYEYVKWFLHADSSSYLTPMKHMLAASAGEVVACLIRVPSEVVKQRAQVSASTRTFQIFSNILYEEGIQGLYRGYKSTVLREIPFSLVQFPLWESLKALWSWRQDHVVDSWQSAVCGAFAGGFAAAVTTPLDVAKTRIMLAKAGSSTADGNVLSVLHGVWRSQGLAGLFAGVFPRMAAISLGGFIFLGAYDRTHSLLLEVGRKSP

SEQ ID NO: 3067 - protein, 359 aa, Homo sapiens
MAINRFRLENVTPEGDWQREWMGDGEGHFEGAVGSTMAPEERSGGSGWWEEARRNWFSVCPLSRRRRSLGRKGRMGGQVGCQGLPLTPSFPLFTLSSLPQDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 3068 - protein, 343 aa, Homo sapiens
MASVDSSWISWGVGVFLLKPLKWTLSNMLGDNKVPAEEVLVAVELLKEKAEEVYRLYQNSPLSSHPVVALSELSTLCANSCPDERTFYLVLLQLQKEKRVTVLEQNGEKIVKFARGPRAKVSPVNDVDVGVYQLMQSEQLLSRKVESLSQEAERCKEEARRACRAGKKQLALRSLKAKQRTEKRIEALHAKLDTVQGILDRIYASQTDQMVFNAYQAGVGALKLSMKDVTVEKAESLVDQIQELCDTQDEVSQTLAGGVTNGLDFDSEELEKELDILLQDTTKEPLDLPDNPRNRHFTNSVPNPRISDAELEAELEKLSLSEGGLVPSSKSPKRQLEPTLKPL

SEQ ID NO: 3069 - protein, 282 aa, Homo sapiens
MDPVNDTKVTQHIKELLERNTKKKSKLRKKPKPYVEEPDGVAISTYAKYCYHKLQKAALTGAKKGLKKPNVEEIRHAKNAVFSPSMFGSALQEVMGMQRERYPERQLPWVQTRLSEEVLALNGDQTEGIFRVPGDIDEVNALKLQVDQWKVPTGLEDPHVPASLLKLWYRELEEPLIPHEFYEQCIAHYDSPEAAVAVVHALPRINRMVLCYLIRFLQVFVQPANVAVTKMDVSNLAMVMAPNCLRCQSDDPRVIFENTRKEMSFLRVLIQHLDTSFMEGVL

SEQ ID NO: 3070 - protein, 148 aa, Homo sapiens [sequence omitted]

SEQ ID NO: 3071 - protein, 108 aa, Homo sapiens
MLFIDSSRSFNERIFLCCIVGSLKRFSVEFPLSFQLTNKKIIMKWRCGNWPEEHYAMVALNFVPTLGQTELQLKEFLSICKEENMKFCWQKQHFEEIKGSLQLTPLNG

SEQ ID NO: 3072 - protein, 113 aa, Homo sapiens
MNEHSPARPHHGAGLGHEQEPGSDTGHGADAPGGVHPQQETHRHRHGVQSHLCECPGQADSETGRGHVGASDWGLWGLGEMAKGHPQKLMIMFHSFFFEMESHSCHPGWSAMV

SEQ ID NO: 3073 - protein, 104 aa, Homo sapiens [sequence omitted]

SEQ ID NO: 3074 - protein, 407 aa, Homo sapiens [sequence omitted]

SEQ ID NO: 3075 - protein, 127 aa, Homo sapiens
MELDEVHCCPGRDSGGGFIKGPMLQGLQGEGKLAPIPKPTLPSPSRLTLFVSSSQMEDHGFPARRNGLTQASFIYQMPAGWGSPGGLFLPCQPVPTPVVLKPPLPPCPISWGESGPAVDGIRRTPAP

SEQ ID NO: 3076 - protein, 180 aa, Homo sapiens
MHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPFCNILQHHPGRQEHYPAWLSRGRVVFSKKE

SEQ ID NO: 3077 - protein, 162 aa, Homo sapiens
MLQHPQVKGPGTGLWGISLGADICLSMASFLKNDSDTVSINGSGISGNRGINCKQNSIPPLGYDLRRIKVAFSGLVDVVDIKNDLVGGYKNPSMISMEEAQGPIIFIVGQDDHNWRSELYAQSLNDYGPMERKNPRSSDTLGLGFTLSLLTSPCAQLPFTNY

SEQ ID NO: 3078 - protein, 439 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFLKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTT

SEQ ID NO: 3079 - protein, 274 aa, Homo sapiens
MGVSAQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDGEDPCFEFRQQQLTVHRVHVTFLPHEPPPPRPHDVTLVAQLSMDRLQMLEALCRHWPGPMSLALYLTDAEAQQFLHFVEASPVLAARQDVAYHVVYREGPLYPVNQLRNVALAQALTPYVFLSDIDFLPAYSLYDYLREARAGFNSSSTCGCAHPSHQARWPMVV

SEQ ID NO: 3080 - protein, 167 aa, Homo sapiens
MHCPTTIAACPTIMCSTLARLVATPASPIQQLAWPDTTHPTCTLGQRATHHGPCPTASVPCWAPGPRSPRLCSTTSCPGPSWHPSRSARTGRSVSACCAPRPTHSSATQASMMLPAPTACSRPVCCLRASEVLRCATALQMTLWPGPASAAPATLSCRHHCPRFPAP

SEQ ID NO: 3081 - protein, 163 aa, Homo sapiens [sequence omitted]

SEQ ID NO: 3082 - protein, 501 aa, Homo sapiens [sequence omitted]

SEQ ID NO: 3083 - protein, 487 aa, Homo sapiens
MAAAALRAPTQVTVSPETHMDLTKGCVTFEDIAIYFSQDEWGLLDEAQRLLYLEVMLENFALVASLGCGHGTEDEETPSDQNVSVGVSQSKAGSSTQKTQSCEMCVPVLKDILHLADLPGQKPYLVGECTNHHQHQKHHSAKKSLKRDMDRASYVKCCLFCTSLKPFRKWEVGKDLPAMLRLLRSLVFPGGKKPGTITECGEDIRSQKSHYKSGECGKASRHKHTPVYHPRVYTGKKLYECSKCGKAFRGKYSLVQHQRVHTGERPWECNECGKFFSQTSHLNDHRRIHTGERPYECSECGKLFRQNSSLVDHQKIHTGARPYECSQCGKSFSQKATLVKHQRVHTGERPYKCGECGNSFSQSAILNQHRRIHTGAKPYECGQCGKSFSQKATLIKHQRVHTGERPYKCGDCGKSFSQSSILIQHRRIHTGARPYECGQCGKSFSQKSGLIQHQVVHTGERPYECNKCGNSFSQCSSLIHHQKCHNT

SEQ ID NO: 3084 - protein, 237 aa, Homo sapiens
MALEAAGGPPEETLSLWKWEQARLKAHVVDRDTEAWQRDPAFSGLQRVGGVDVSFVKGDSVRACASLVVLSFPELEVLLVDGNGVLHHRGFGVACHLGVLTDLPCVGVAKKLLQVDGLENNALHKEKIRLLQTRGDSFPLLGDSGTVLGMALRSHDRSTRPLYISVGHRMSLEAAVRLTCCCCRFRIPEPVRQADICSREHIRKSLGLPGPPTPRSPKAQRPVACPKGDSGESSALC

SEQ ID NO: 3085 - protein, 132 aa, Homo sapiens [sequence omitted]

SEQ ID NO: 3086 - protein, 110 aa, Homo sapiens [sequence omitted]

SEQ ID NO: 3087 - protein, 373 aa, Homo sapiens [sequence omitted]

SEQ ID NO: 3088 - protein, 109 aa, Homo sapiens
MKCNLFIFYYGYCFMFQVPNFAFSQITNIILCFPSKIIWFYVFSISKYSLIFLLIYLLKKFEGFAIMLGIFLDATLLLISNLIILCSENIFCMLSTLLNLLRLVGGSSI

SEQ ID NO: 3089 - protein, 136 aa, Homo sapiens [sequence omitted]

SEQ ID NO: 3090 - protein, 262 aa, Homo sapiens
MKDFQRELEDARASRDEIFATAKENEKKAKSLEADLMQLQEDLAAAERARKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRRGNETSFVPSRRSGGRRVIENADGSEEETDTRDADFNGTKASE

SEQ ID NO: 3091 - protein, 116 aa, Homo sapiens
MRRGCPCRNAPEAATRERVTRTTSVDLAGPRAPFKIVPGESPWRCSGGSWSPTLLTGETTQLLRGKTAEEHVRTVPSATKAAPESGTAVRGGTCPGSLMGTHSPLHPQRGTCPNEN

SEQ ID NO: 3092 - protein, 602 aa, Homo sapiens [sequence omitted]

SEQ ID NO: 3093 - protein, 153 aa, Homo sapiens [sequence omitted]

SEQ ID NO: 3094 - protein, 135 aa, Homo sapiens
MHSVERPYKCKICGRGFYSAKSFQTHEKSYTGEKPYECKQCGKAFVSFTSFRYHERTHTGENPYECKQFGKAFRSVKNLRFHKRTHTGEKPCECKKCGKAFHNFSSLQIHERMHRGEKLCECKHCGKAFISAKIL

SEQ ID NO: 3095 - protein, 263 aa, Homo sapiens
MDFISIQQLVSGERVEGKVLGFGHGVPDPGAWPSDWRRGPQEAVAREKLKLEEEKKKKLERFNSTRFNLDNLADLENLVQRRKKRLRHRVPPRKPEPLVKLHRTALHWACLKGHSQLVNKLLVAGATVDARDLLDRTPVFWACRGGHLVILKQLLNQGARVNARDKIGSTPLHVAVRTRHPDCLEHLIECGAHLNAQDKEGDTALHEAVRHGSYKAMKLLLLYGAELGVRNAASLTPVQLARDWQRGIREALQAHVAHPRTRC

SEQ ID NO: 3096 - protein, 547 aa, Homo sapiens [sequence omitted]

SEQ ID NO: 3097 - protein, 129 aa, Homo sapiens
MNVTRSSVTVQTLYNIKEFILERSLTSVMNVASSSIEFHSLHDIREYILERNLTNVMSVAKSSLKILTLQIITESTLERNLTNVMSVARSSTKMHTLHDIRKFIVERNLTNVRNVAKHFQGVQALLLIL

SEQ ID NO: 3098 - protein, 104 aa, Homo sapiens
MAGIGGLQKMKAPHTGVLHLGSVWVFLGPFLLGVGYTLTFNPLSGCMSTVRWLNSNITANRTLSRSVCHVTPLHRSLSPHDGEYLRQMLLNSSSRAGEAGSWGY

SEQ ID NO: 3099 - protein, 164 aa, Homo sapiens [sequence omitted]

SEQ ID NO: 3100 - protein, 717 aa, Homo sapiens [sequence omitted]

SEQ ID NO: 3101 - protein, 182 aa, Homo sapiens
MVIFFTSGTTGFPKMAKHSHGLALQPSFPGSRKLRSLKTSDVSWCLSDSGWIVATIWTLVEPWTAGCTVFIHHLPQFDTKVIIQTLLKYPINHFWGVSSIYRMILQQDFTSIRFPALEHCYTGGEVVLPKDQEEWKRRTGLLLYENYGQSETGLICATYWGMKIKPGFMGKATPPYDVQVWS

SEQ ID NO: 3102 - protein, 142 aa, Homo sapiens
MPLPSHSHSSNPQSACAWPMAPMGALAAWRSGMAGAGAPCVMTAGTCAMPPWPAGSWAAEGHWPPREAPSSGRGQGLCGSASWLAGATRGSWASATTGAGRPTSAPTRRTRASSAQVSVWLTPGTTQHLPWMGLPGQGCCWS

SEQ ID NO: 3103 - protein, 206 aa, Homo sapiens [sequence omitted]

SEQ ID NO: 3104 - protein, 167 aa, Homo sapiens; identical to SEQ ID NO: 3080

SEQ ID NO: 3105 - protein, 127 aa, Homo sapiens [sequence omitted]

SEQ ID NO: 3106 - protein, 160 aa, Homo sapiens
MPCPSSSQTCGERRPSSRWRMPCSTCRRSLETSSAGVLQCQVPCSRAPAGIWLHLHGRPGPWPAETPPPQDPEQAPPPGRAGPAGEAEGLSCVREHQAGARGRCRRGTWGSSQQHQLCQLLAALQHHREPVEEVCLPGPPGWCCNKDPCDAGGRDRGEAV

SEQ ID NO: 3107 - protein, 225 aa, Homo sapiens
MVIFLHTCCHLNVVFLLFSKIFSLDLGGISTVVLNGYDVVKECLVHQSEIFADRPCLPLFMKMTKMGGLLNSRYGRGWVDHRRLAVNSFRYFGYGQKSFESKILEETKFFNDAIETYKGRPFDFKQLITNAVSNITILIIFGGRFTYEDTDFQHMIELFSENVELAASASVFLYNAFPWIGILPFGKHQQLFRNAAGETQKCSILSDFWTAVDILPRRRLWFLFP

SEQ ID NO: 3108 - protein, 274 aa, Homo sapiens
MPLSPALCALGRSPPLPQGQRQTLLFSATMPKKIQNFAKSALVKPVTINVGRAGAASLDVIQEVEYVKEEAKMVYLLECLQKTPPPVLIFAEKKADVDAIHEYLLLKGVEAVAIHGGKDQEERTKAIEAFREGKKDVLVATDVASKGLDFPAIQHVINYDMPEEIENYVHRIGRTGRSGNTGIATTFINKACDESVLMDLKALLLEAKQKVPPVLQVLHCGDESMLDIGGERGCAFCGGLGHRITDCPKLEAMQTKQVSNIGRKDYLAHSSMDF

SEQ ID NO: 3109 - protein, 106 aa, Homo sapiens [sequence omitted]

SEQ ID NO: 3110 - protein, 251 aa, Homo sapiens [sequence omitted]

SEQ ID NO: 3111 - protein, 232 aa, Homo sapiens
MAYVALSDKPHLSGEVGEEACSSWNPPLFSPRPLPRLWPLPGTPFLPIRALPFSASSSGKSSLVPSPSSSAHSGFRTPCLGPDCLLCTQGCELHEGRNHMAVHSCVARAWPGDPQEVRHLNPLLCDPGSQVEPSWPWHPGLEQAAASWVGNHVSPAHRQALRGHSLGSALRALMPGRHCPLCVPCKRGCDLRGGRGKHGPRPCCPLLRKFPVLPVHPWPFPCAVWDSGWSCR

SEQ ID NO: 3112 - protein, 128 aa, Homo sapiens
MGPAAGHAAPRGPPVPATTAGAALRAGASEPRQTQLGAPLALGEARGGPQDPSGEGAISPCPQGYKEVSGPVHGQMGPGKTLRVGIQWTRRSQMCCFYGCPLPPPVHPLCPGNKEPLRTQESPHPPSC

SEQ ID NO: 3113 - protein, 108 aa, Homo sapiens [sequence omitted]

SEQ ID NO: 3114 - protein, 266 aa, Homo sapiens [sequence omitted]

SEQ ID NO: 3115 - protein, 357 aa, Homo sapiens
MGTIQEAGKKTDVGVREIAEAPELGAALRHGELELKEEWQDEEFPRLLPEEAGTSEDPEDPKGDSQAAAGTPSTLALCGQRPMRKRLSAPELRLSLTKGPGNDGASPTQSAPSSPDGSSDLEIDELETPSDSEQLDSGHEFEWEDELPRAEGLGTSETAERLGRGCMWDVTGEDGHHWRVFRMGPREQRVDMTVIEPYKKVLSHGGYHGDGLNAVILFASCYLPRSSIPNYTYVMEHLFRYMVGTLELLVAENYLLVHLSGGTSRAQVPPLSWIRQCYRTLDRRLRKNLRALVVVHATWYVKAFLALLRPFISSKFTRKIRFLDSLGELAQLISLDQVHIPEAVRQLDRDLHGSGGT

SEQ ID NO: 3116 - protein, 475 aa, Homo sapiens
MAVWATVFLEFWKRRRAVIAYDWDLIDWEEEEICVVIAAVFGIVIYRVVTVSTFAAFKWALIRNNSQVATTGTAVCINFCIIMLLNVLYEKVALLLTNLEQPRTESEWENSFTLKMFLFQFVNLNSSTFYIAFFLGRFTGHPGAYLRLINRWRLEECHPSGCLIDLCMQMGIIMVLKQTWNNFMELGYPLIQNWWTRRKVRQEHGPERKISFPQWEKDYNLQPMNAYGLFDEYLEMILQFGFTTIFVAAFPLAPLLALLNNIIEIRLDAYKFVTQWRRPLASRAKDIGIWYGILEGIGILSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 3117 - protein, 776 aa, Homo sapiens [sequence omitted]

SEQ ID NO: 3118 - protein, 128 aa, Homo sapiens [sequence omitted]

SEQ ID NO: 3119 - protein, 262 aa, Homo sapiens
MCLTDEWGFLFFFFFLGVPEAEVTWFRNKSKLGSPHHLHEGSLLLTNVSSSDQGLYSCRAANLHGELTESTQLLILDPPQVPTQLEDIRALLAATGPNLPSVLTSPLGTQLVLGPGNSALLGCPIKGHPVPNITWFHGGQPIVTATGLTHHILAAGQILQVANLSGGSQGEFSCLAQNEAGVLMQKASLVIQDYWWSVDRLATCSASCGNRGVQQPRLRCLLNSTEVNPAHCAGKVRPAVQPIACNRRDCPSRAMGLASGLT

SEQ ID NO: 3120 - protein, 288 aa, Homo sapiens
MDAELAEVRALQAEIAALRRACEDPPAPWEEKSRVQKSFQAIHQFNLEGWKSSKDLKNQLGHLESELSFLSTLTGINIRNHSKQTEDLTSTEMTEKSIRKVLQRHRLSGNCHMVTFQLEFQILEIQNKERLSSAVTDLNIIMEPTECSELSEFVSRAEERKDLFMFFRSLHFFVEWFEYRKRTFKHLKEKYPDAVYLSEGPSSCSMGIRSASRPGFELVIVWRIQIDEDGKVFPKLDLLTKVPQRALELDKNRAIETAPLSFRTLVGLLGIEAALESLIKSLCAEENN

SEQ ID NO: 3121 - protein, 119 aa, Homo sapiens
MDIKIGNKPAGCIQTLLRSDVVPMTTENFLYMCTHLKDSASREAASTALSPSSFARAVISQTTVAPGVCAGMALSVPWHIWPSWRPQKGRTSTLFYGGRNGYSRNKESQQLPASQGPGS

SEQ ID NO: 3122 - protein, 256 aa, Homo sapiens
MASGRPEELWEAVVGAAERFRARTGTELVLLTAAPPPPPRPGPCAYAAHGRGALAEAARRCLHDIALAHRAATAARPPAPPPAPQPPSPTPSPPRPTLAREDNEEDEDEPTETETSGEQLGISDNGGLFVMDEDATLQDLPPFCESDPESTDDGSLSEETPAGPPTCSVPPASALPTQQYAKSLPVSVPVWGFKEKRTEARSSDEENGPPSSPDLDRIAASMRALVLREAEDTQVFGDLPRPRLNTSDFQKLKRKY

SEQ ID NO: 3123 - protein, 112 aa, Homo sapiens
MSHCTRPIVSFFCCVWVILASRNEFGSIPSSSLFVLFCFMHLSMIHIEFSSKVIRSWTFLWKRNGKRCKVFVSFFFFFFLALSPRLVCGGSVLAHCSLRLSGPSNSPASTSK

SEQ ID NO: 3124 - protein, 103 aa, Homo sapiens
MWGWLGVLRGPISSLNLPPPQVYDPFRFDPENAQKRSPMAFIPFSAGPRNCIGQKFAMAEMKVVLALTLLRFRILPDHREPRRTPEIVLRAEDGLWLRVEPLG

SEQ ID NO: 3125 - protein, 228 aa, Homo sapiens [sequence omitted]

SEQ ID NO: 3126 - protein, 119 aa, Homo sapiens
MSTLSFSQKQLIPRMLIARLELSLPCTLSLLSLLSLTWPFSPYSCPQRTQNCDDAQQSPGRGHSEDSGPWVSGQPLSEHLGGWWEVVEAPTQHQHSWQSSLTLFLRSPATSSGFQFPNV

SEQ ID NO: 3127 - protein, 211 aa, Homo sapiens
MSETDHIASTSSDKNVGKTPELKEDSCNLFSGNESSKLENESKLLSLNTDKTLCQPNEHNNRIEAQENYIPDHGGGEDSCAKTDTGSENSEQIANFPSGNFAKHISKTNETEQKVTQILVELRSSTFPESANEKTYSESPYDTDCTKKFISKIKSVSASEDLLEEIESELLSTEFAEHRVPNGMNKGEHALVLFEKCVQDKYLQQEHIIKK

SEQ ID NO: 3128 - protein, 133 aa, Homo sapiens
MAARTKSSLPEKAEPPRAREGGRGGTAKGRRDGRMPCEQSQGGEEKKLLSGWGWAEGMVQGLMSLPPNAGGLAGWVRPLTGMGHNPWLTINGQSSWVRWLMPVIPTLWEAKVGGSRGQEFETSLANIVKPRLN

SEQ ID NO: 3129 - protein, 167 aa, Homo sapiens
MACGATLKRPMEFEAALLSPGSPFQTQTPPQSLQQPAPPGSERRLPTPEQIFQNIKQEYSRYQRWRHLEVVLNQSEACASESQPHSSALTAPSSPGSSWMKKDQPTFTLRQVGIICERLLKDYEDKIREEYEQILNTKLAEQYESFVKFTHDQIMRRYGTRPTSYVS

SEQ ID NO: 3130 - protein, 200 aa, Homo sapiens
MCVGCPNNHSFSRTVAHGGRALASAWPPQAQFLPVGGRSRPGSCPSASSPGPELVPVGLSRPSSPGHLHGPSSCLTTTTFGPAPAQLLAAVVGPRLPCVQASRTHLRLPGGPERPGSCLPAASPGPAAASRRPPQATFPSASRQPRQARLPPAGGLLRRLISCPAAASPGQAPACRQAPQAQLLRPEGLSRPGSCLAAAS

SEQ ID NO: 3131 - protein, 235 aa, Homo sapiens
MDLSLHVASLCLPHHPSPAQLKPAGALCRQAMGDCDLPEFCTGTSSHCPPDVYLLDGSPCARGSGYCWDGACPTLEQQCQQLWGPGERTRAPLHPAPHPLVGPVFYCGEDGQGKLRPAERSPSPSCPQPGPCFLRLPPSSRGLFPGGELCGRCSWKLRPGQRGPLPALCREGCPVWEAAVPGWKAQPARTAHGASGLYRSPRWPGSDLSGSLGTPQCPAGPAWPGPGRARHPVWT

SEQ ID NO: 3132 - protein, 106 aa, Homo sapiens
MAKFLSQDQINDGNGELDFSTFLTIMHMQIKQEDPKKEILLAMLMVDKEKKGYVMASDLRSKLTSLGEKLTHKEVDDLFREADIEPNGKVKYDEFIHKITLPGRDY

SEQ ID NO: 3133 - protein, 194 aa, Homo sapiens
MFAPFLLFCLCWERHCGEGCLAYGSHCPLLDKPPELWSLAVSCAFHTQVVSAQATLCLFHAEEIPFQAMSVFLLPHRKFLSMFILQAECRVLGSGPHLLQRLLQPLPLSTQVMKLDEGLHPPESGQGPVCSVSPSNCSYSEISIVLPPLDSQGSQGSGGSEGSPFPSSPKSSSHITSDTSFPTSWKKELSFVLK

SEQ ID NO: 3134 - protein, 102 aa, Homo sapiens [sequence omitted]

SEQ ID NO: 3135 - protein, 294 aa, Homo sapiens
MGAVTGVVTALVTKFTKLDCFPLLETALFFLMSWSTFLLAEACGFTGVVAVLFCGITQAHYTFNNLSVESRSRSKQLFEAENFIFSCMILALFTFQKHVFSPVFIIGAFVAVFLGRAAHIYPLSFFLSLGRRHKIGWNFQHTMMFSGLRGAMAFALAICDTASYARQMTFPTTPFIVFFTIWIIGGGTTPMLSWLNIRVSIKEPSKEDHNEHHRQYFRVGVDPDQDPPPNNDSFQVLQGDSPDSARGNWTKQESTWIFRRWYSFDHNYLKPILTHSGSPLTTTLPPGGDTAAPR

SEQ ID NO: 3136 - protein, 202 aa, Homo sapiens
MISSSLSGRVPVILGNLMGVGAAVRRMGFSLILPTSPSPAHSGSAPSAGPARGVSGVLGRRRPVSEAYRAPGPRWVLLEVLESGNTGSSRETGERVAGGLAAGRVRRHLHGWDAAWRGVMKPPALVSLAGQPSPSAAVTASGFPRVYPWEMKKSRVAPCFPSSLAREVFGTGVFPRCLLSAGTAPRVFTCINSFNPCINPMK

SEQ ID NO: 3137 - protein, 163 aa, Homo sapiens [sequence omitted]

SEQ ID NO: 3138 - protein, 111 aa, Homo sapiens [sequence omitted]

SEQ ID NO: 3139 - protein, 232 aa, Homo sapiens
MAQSDFLYPENPKRREEVNRLHQQLLDCLSDSFDVTNKLTEVLNMHLGCRLASIEMKRDGTIKENCDLIIQAIMKIQKELQKVDEALKDKLEPTLYRKLQDIKEKETDKIAIVQKVISVILGEATSAASAVAVKLVGSNVTTGIINKLVTVLAQIGASLLGSIGVAVLGLGIDMIVRAILGAVEKTQLQAAIKSYEKHLVEFKSASEKYNHAITEVINSETPNEMNSRFICH

SEQ ID NO: 3140 - protein, 383 aa, Homo sapiens
MLRSRRGTEQVPSPRFPVGLPRASTRPPAGGLHGGPLRNHEWAVPFPTQVVREKLRKYVFDRVNMHNLLIHLVRRRGQKLESMQLELDSLRSQPDASKEELRLLQIIRQLENNIEKTMIKIITSQNIHLLYLDLLDYLKTVLAGYPIELDKLQNLVVNYCSELSDMKIMSQDAMMITDEVKRNMRQREASFIEERRARENRLNQQKKLIDKIHTKETSEKYRRGQMDLDFPSNLMSTETLKLRRKETSTAEMEYQSGVTAVVEKVKSAVRCSHVWDITSRFLAQRNTEENLELQMEDCEERRVQLKALVKQLELEEAVLKFRQKPSSIRCPGLPGLRATHPSLTKAPGCSQAGSWEYTHCQQACVSHRGARGLHLHTPELLSP

SEQ ID NO: 3141 - protein, 170 aa, Homo sapiens [sequence omitted]

SEQ ID NO: 3142 - protein, 247 aa, Homo sapiens
MSTAAVPELKQISRVEAMRLGPGWSHSCHAMLYAANPGQLFGRIPMRFSVLMQMRFDGLLGFPGGFVDRRFWSLEDGLNRVLGLGLGCLRLTEADYLSSHLTEGPHRVVAHLYARQLTLEQLHAVEISAVHSRDHGLEVGPPPGPRPPPRGLALAPWKAPMGNTSPEGPLAGLGRVSLSPAMGWGEGSGAGRPGKEGRGWGPALGLPQGCVTSALLPAIANPGSGGVGSVGRKGWGRSGDCLGSWET

SEQ ID NO: 3143 - protein, 142 aa, Homo sapiens [sequence omitted]

SEQ ID NO: 3144 - protein, 162 aa, Homo sapiens [sequence omitted]

SEQ ID NO: 3145 - protein, 200 aa, Homo sapiens
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 3146 - protein, 586 aa, Homo sapiens
MIIVFFSLPNIGDFSRAWDVLLDHIQSAALSKNNEVSLAALKSFQEILQIVSPVRDSDKPETPPVVNVPVPVLIGPISGMSRPFVRTDSIGEKLGRYSSSEPPIVTDELEDLNLWWAAWNTWYRIGSESTKPPITFDKLTFIPSQPFLTALIQIFPALYQHIKTGFNMDDLQKLGVILHSAISVPISSDASPFILPSYTEAVLTSLQEAVLTALDVLQKAICVGPENMQIMYPAIFDQLLAFVEFSCKPPQYGQLETKHIANAKYNQAEWVALNYVPFAERSLEVVVDLYQKTACHKAVVNEKVLQNIIKTLRVPLSLKYSCPSESTWKLAVSSLLRVLSIGLPVARQHASSGKFDSMWPELANTFEDFLFTKSIPPDNLSIQEFQRNENIDVEVVQLISNEILPYANFIPKEFVGQIMTMLNKGSIHSQSSSFTEAEIDIRLREEFSKMCFETLLQFSFSNKVTTPQEGYISRMALSVLLKRSQDVLHRYIEDERLSGKCPLPRQQVTEIIFVLKAVSTLIDSLKKTQPENVDGNTWAQVIALYPTLVECITCSSSEVCSALKEALVPFKDFMQPPASRVQNGES

SEQ ID NO: 3147 - protein, 111 aa, Homo sapiens [sequence omitted]

SEQ ID NO: 3148 - protein, 577 aa, Homo sapiens
MLLLSTRYYYSSPPDTTPPLHQMLLVSTRCSSSPPDAPPLVEMLLVSSRCSSSPPGAPRLHRMLLVSAGCSSSSPNTTPPLRQILILLSARYYSTSPPDPTPPLRQILLLSARSYSSSPPDPTPPLCQILLLVSTRCSSSSPPDAPRLREMLLLSARCSSSPPDAPPLLEMLLLSSRCSSSPPAAPRLCRLLLVSAGCFSSPPDAPPLCQTLLLVSARHYSSSPPDTTPRLCQTLLLVSARHYSSSLPDAPPLHEMLLLSTRCSSSPPDAPPLHEMLLVSARCSSAPRDAPPLHRMLLVSAGCSSSPPDAPRLRRMLLLSAGCSSSPPDTTPPLHQILLLLSARYYSSPPDTTPPLRQMLLVSARCSSSPRDAPRLHRMLLLSTRCCSSPRDAPHLHRMLLVSTSCCSSPPAAPHPHWMLLIPAGCSSSPPDPTPPLRQILLLVSARSSSSSPPDPPPRLRQMLLLVSARCSSSLPDAPPPHEMLLRMLLVSTSCSSSPPAGGLQPLPALASCSVACWVGTEAPGAQQGRLSPLWASCGLQLLEAPPPGRSERCRAGMEHLLCHQSPCRSQEHGGRS

SEQ ID NO: 3149 - protein, 127 aa, Homo sapiens
MLTSVMSVERPLAGHHPLHAIVDVILESNLTNVKNVTKLSVSNQTLKDIGEFILERNHTSVMSVARPLVGSHTSHAIIDFILERKLTSVMSAARPLVGSHPLPAIVDFILERNLTSVRSVARPSISS

SEQ ID NO: 3150 - protein, 357 aa, Homo sapiens
MSLQNLGMLRNGGLLFRMTLLTSGGAGMLYMRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSIGYCVLLTFGFGALSKHTKKKKLIAAVVLGILFINTLRCVLRNGEWRSEEQLFRSALSVCPLNAKVHYNIGKNLADKGNQTAAIRYYREAVRLNPKYVHAMNNLGNILKERNELQEAEELLSLVVQIQPDFAAAWMNLGIVQNSLKRFEAAEQSYRTAIKHRRKYPDCYYNLGRLVSAGCPVPVEGKMGYFSYL

SEQ ID NO: 3151 - protein, 354 aa, Homo sapiens
MGNQLDRITHLNYSELPTGDPSGIEKDELRVGVAYFFSDDEEDLDERGQPDKFGVKAPPGCTPCPESPSRHHHHLLHQLVLNETQFSAFRGQECIFSKVSGGPQGADLSVYAVTALPALCEPGDLLELLWLQPAPEPPAPAPHWASRARRSAGRTRRASPPGAALASGSSRREGRCRQARSPRSSSTISRCTWERTRSTPPGFTAWKTSSARSAVSTPAAACECSRSSPTSWTTRSSRLGAAGPSASPAPRSLPFPAPGLRSQRFSTSAPPRHARPPPVARARAAPPHPQASGRKSQELPQGRKGAAASAWLTATAVVTVLGDPACAFPLRCKPGTGKGLRGERTWPSPRVHGQ

SEQ ID NO: 3152 - protein, 549 aa, Homo sapiens
MPVDLGQALGLLPSLAKAEDSQFSESDAALQEELSSPETARQLFRQFRYQVMSGPHETLKQLRKLCFQWLQPEVHTKEQILEILMLEQFLTILPGEIQMWVRKQCPGSGEEAVTLVESLKGDPQRLWQWISIQVLGQDILSEKMESPSCQVGEVEPHLEVVPQELGLENSSSGPGELLSHIVKEESDTEAELALAASQPARLEERLIRDQDLGASLLPAAPQEQWRQLDSTQKEQYWDLMLETYGKMVSGAGISHPKSDLTNSIEFGEELAGIYLHVNEKIPRPTCIGDRQENDKENLNLENHRDQELLHASCQASGEVPSQASLRGFFTEDEPGCFGEGENLPEALQNIQDEGTGEQLSPQERISEKQLGQHLPNPHSGEMSTMWLEEKRETSQKGQPRAPMAQKLPTCRECGKTFYRNSQLIFHQRTHTGETYFQCTICKKAFLRSSDFVKHQRTHTGEKPCKCDYCGKGFSDFSGLRHHEKIHTGEKPYKCPICEKSFIQRSNFNRHQRVHTGEKPYKCSHCGKSFSWSSSLDKHQRSHLGKKPFQ

SEQ ID NO: 3153 - protein, 113 aa, Homo sapiens
MKEKMLRPAREKGRVTHKGKPIRLTGDLSAETLQARREWGPIFNILKEKNFQPRITYPAKLSFISEGEIKSFTDKQMLRDFVTTRPTLQELLKEALNMERNNQYQPLQNHAKL

SEQ ID NO: 3154 - protein, 166 aa, Homo sapiens [sequence omitted]

SEQ ID NO: 3155 - protein, 454 aa, Homo sapiens [sequence omitted]

SEQ ID NO: 3156 - protein, 200 aa, Homo sapiens; identical to SEQ ID NO: 3145

SEQ ID NO: 3157 - protein, 117 aa, Homo sapiens
MRDSDDSPPQKMSPGLFPPLHLDLRSSKSLHLQIIIPFLSLALAPTLSGKKVCSCVMIIWLGHLFSGHFPFTSSIRSKTKSHGSSREYILCLFPLLNPHFTISIVPTYWYSVATGFR

SEQ ID NO: 3158 - protein, 268 aa, Homo sapiens
MEMKKKINLELRNRSPEEVTELVLDNCLCVNGEIEGLNDTFKELEFLSMANVELSSLARLPSLNKLRKLELSDNIISGGLEVLAEKCPNLTYLNLSGNKIKDLSTVEALQNLKNLKSLDLFNCEITNLEDYRESIFELLQQITYLDGFDQEDNEAPDSEEEDDEDGDEDDEEEEENEAGPPEGYEEEEEEEEEEDEDEDEDEDEAGSELGEGEEEVGLSYLMKEEIQDEEDDDDYVEEGEEEEEEEEGGLRGEKRKRDAEDDGEEEDD

SEQ ID NO: 3159 - protein, 494 aa, Homo sapiens [sequence omitted]

SEQ ID NO: 3160 - protein, 362 aa, Homo sapiens
MAEVPPGPSSLLPPPAPPAPAAVEPRCPFPAGAALACCSEDEEDDEEHEGGGSRSPAGGESATVAAKGHPCLRCPQPPQEQQQLNGLISPELRHLRAAASLKSKVPSVAEVAATTATPDGGPRATATKGAGVHSGERPPHSLSSNARTAVPSPVEAAAASDPAAARNGLAEGTEQEEEEEDEQVRLLSSSLTADCSLRSPSGREVEPGEDRTIRYVRYESELQMPDIMRLITKDLSEPYSIYTYRYSIHNWPQLCFLAMVGEECVGAIVCKLDMHKKMFRRGYIAMLAVDSKYRRNGIGTNLVKKAIYAMVEGDCDEVVLETEITNKSALKLYENLGFVRDKRLFRYYLNGVDALRLKLWLR

SEQ ID NO: 3161 - protein, 804 aa, Homo sapiens [sequence omitted]

SEQ ID NO: 3162 - protein, 707 aa, Homo sapiens [sequence omitted]

SEQ ID NO: 3163 - protein, 302 aa, Homo sapiens
MGDDSEWLKLPVDQKCEHKLWKARLSGYEEALKIFQKIKDEKSPEWSKFLGLIKKFVTDSNAVVQLKGLEAALVYVENAHVAGKTTGEVVSGVVSKVFNQPKAKAKELGIEICLMYIEIEKGEAVQEELLKGLDNKNPKIIVACIETLRKALSEFGSKIILLKPIIKVLPKLFESREKAVRDEAKLIAVEIYRWIRDALRPPLQNINSVQLKELEEEWVKLPTSAPRPTRFLRSQQELEAKLEQQQSAGGDAEGGGDDGDEVPQIDAYELLEAVEILSKLPKTFMTKLRQKNGKREKRPWSL

SEQ ID NO: 3164 - protein, 313 aa, Homo sapiens
MIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIEVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 3165 - protein, 424 aa, Homo sapiens
MQQYSQKEASNSQNSQAKIITGKTGVLPPPTLPKPKLPKHIKDNKNDFSPKVELATSLSDMECKITTSKDQEKVMVMTSSEHTETKQNVISKSLDERKQLSIDSANCLSHTVPGTSAPRKKQIAPLIKSHSFPESSGQQNPKPYMRKFKTPLMIAEEKYRQQKEEIEKQKQESSYYNIVKTQSQNQHITEVEKEMPLQKTNEEVSLSGIDSECTVVQPSPGSQSNARILGVCSDNQLSTTSPETVAAKRLHHVLAASEDKDKMKKEVLQSSRDIMQSKSACEIKQSHQECSTQQTQQKKYLEQLHLPQSKPISPNFKVKTIKLPTLDHTLNETDHSYESHKQQSEIDVQTFTKKQYLKTKKTEASTECSHKQSLAERHYQLPKKEKRVTVQLPTESIQKNQEDKLKMVPRKQREFSGSDRGKLP

SEQ ID NO: 3166 - protein, 438 aa, Homo sapiens [sequence omitted]

SEQ ID NO: 3167 - protein, 243 aa, Homo sapiens
MMEAIKKKMQMLKLDKENALDRAEQAEAEQKQAEERSKQLEDELAAMQKKLKGTEDELDRAQERLATALQKLEEAEKAADESERGMKVIENRALKDEEKMELQEIQLKEAKHIAEEADRKYEEVARKLVIIEGDLERTEERAELAESKCSELEEELKNVTNNLKSLEAQAEKYSQKEDKYEEEIKILTDKLKEAETRAEFAERSVAKLEKTIDDLEDELYAQKLKYKAISEELDHALNDMTSI

SEQ ID NO: 3168 - protein, 200 aa, Homo sapiens
MQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 3169 - protein, 381 aa, Homo sapiens
MAPGEKESGEGPAKSALRKIRTATLVISLARGWQQWANENSIRQAQEPTGWLPGGTQDSPQAPKPITPPTSHQKAQSAPKSPPRLPEGHGDGQSSEKAPEVSHIKKKEVSKTVVSKTYERGGDVSHLSHRYERDAGVLEPGQPENDIDRILHSHGSPTRRRKCANLVSELTKGWRVMEQEEPTWRSDSVDTEDSGYGGEAEERPEQDGVQVAVVRIKRPLPSQVNRFTEKLNCKAQQKYSPVGNLKGRWQQWADEHIQSQKLNPFSEEFDYELAMSTRLHKGDEGYGRPKEGTKTAERAKRAEEHIYREMMDMCFIICTMARHRRDGKIQVTFGDLFDRYVRISDKVVGILMRARKHGLVDFEGEMLWQGRDDHVVITLLK

SEQ ID NO: 3170 - protein, 354 aa, Homo sapiens [sequence omitted]

SEQ ID NO: 3171 - protein, 122 aa, Homo sapiens [sequence omitted]

SEQ ID NO: 3172 - protein, 268 aa, Homo sapiens
MSPLEDLSLPPSTDKSEKAEIKPEIPTTSTSVSEYLILAQKQKTQAYLEPESEDLIPSHLTSEVEKGEREASSSVAAIPAALPAQSSIVKEETKPASPHSVLPDSVPAIKKEQEPTAALTLKAADEQMALSKVRKEEIVPDSQEATAHVSQDQKMEPQPPNVPESEMKYSVLPDMVDEPKKGVKPKLVLNVTSELEQRKLSKNEPEVIKPYSPLKETSLSGPEALSAVKMEMKHDSKITTTPIVLHSASSGVEKQVEHGPPALAFSAL

SEQ ID NO: 3173 - protein, 128 aa, Homo sapiens
MCDIAAILDMYTLMSNKQYYDALCSGEICNTEGISSVVQPDKYKPVPDEPPNPTNIEEILKRVRSNDKELEEVNLNNIQDIPIPMLSELCEAMKANTYVRSFSLVATRSGDPIANWLTCCVRIVASRA

SEQ ID NO: 3174 - protein, 356 aa, Homo sapiens
MEHSLTPVTQCSMELFIVWNPDFAVEKEVLDLCSEHLVLRLRRQPIEKLVEPKHCFTSPDYQQQCHEMAERLEDSVLKGMQAASSKMVSAEISENRKRQWPTKSQTDRGASAGKRRCFWLGMEGLETAEGSNSDSSDDDSEEAPSTSGMGFHAPKIGSNGVEMAAKFPSGSQRARVVNTDHGSPEQLQIPVTDSGRHILEDSCAELGESKEHMESRMVTETEETQEKKAESKEPIEEEPTGAGLNKDKETEERTDGERVAEVAPEERENVAVAKLQESQPGNAVIDKETIDLLAFTSVAELELLGLEKLKCELMALGLKCGGTLQERAARLFSVRGLAKEQIDPALFAKPLKGKKK

SEQ ID NO: 3175 - protein, 100 aa, Homo sapiens
MASFLAVVGAPGGVNSCVFDRFHYSVKMGDRSVYNENTSVVVSVQRAFVHPKFSTVTTIRNDLALLQLQHPVNFTSNIQPICIPQENFQVEGRFWGPLGL

SEQ ID NO: 3176 - protein, 575 aa, Homo sapiens
MRCGRRSRVEELLRCGADPNLVLEDGAAAVHLAAGARHPRGLRCLGALLRQGGDPNVRSVEALTPLHVAAAWGCRRGLELLLSQGADPALRDQDGLRPLDLALQQGHLECARVLQDLDTRTRTRTRIGAETQEPEPAPGTPGLSGPTDETLDSIALQKQPCRGDNRDIGLEADPGPPSLPVPLETVDKHGSSASPPGHWDYSSDASFVTAVEVSGAEDPASDTPPWAGSLPPTRQGLLHVVHANQRVPRSQGTEAELNARLQALTLTPPNAAGFQSSPSSMPLLDRSPAHSPPRTPPPGASDCHCLWEHQTSIDSDMATLWLTEDEASSTGGREPVGPCRHLPVSTVSDLELLKGLRALGPEFSGHSLELAAALRTGCIPDVQADEDALAQQFERPDPARRWRGGVVKSSFTYLLLDPRETQDLPARAFSLTPAERLQTFIRAIFYVGKGTRARPYVHLWEALGHHGRSRKQPHQACPKVRQILDIWASGCGVVSLHCFQHVVAVEAYTREACIVEALGIQTLTNQKQGHCYGVVAGWPPARRRRLGVHLLHRALLVFLAEGERQLHPQDIQARG

SEQ ID NO: 3177 - protein, 470 aa, Homo sapiens
MFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFMRYHYNGSLMDGTLFDSSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 3178 - protein, 113 aa, Homo sapiens
MLTGPDPNPLPLRPAPPRSYPRPHPTSLTSTLLGSSSTYFSSNTLLMMGPRTPCRYCIPATWGPPQVTLILSPPVPLQLPTFSRQPPLHRLPAVSAQEGDRYTSRANCLFMNE

SEQ ID NO: 3179 - protein, 149 aa, Homo sapiens [sequence omitted]

SEQ ID NO: 3180 - protein, 183 aa, Homo sapiens
MAGITTIEAVKRKIQVLQQQADDAEERAERLQREVEGEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 3181 - protein, 151 aa, Homo sapiens
MATVKCGVGSMRSKPFARAVPACPPTCSPALAGPPPPSFPERAASSEGSPTHSPPHPPQRLQPPVRVVPKPTRALSTLRQLHVQPPTRSQPHWRRTHHRSPFTRFTGSAAPTPSAQLHAASPHSPQRLQHPQCAQLCQSLPRVPPLHHFGP

SEQ ID NO: 3182 - protein, 221 aa, Homo sapiens [sequence omitted]

SEQ ID NO: 3183 - protein, 363 aa, Homo sapiens
MEHELVLDGAVVSASFDDSVDMGVVGTTAGTLWFVSWAEGTSTRLISGHRSKVNEVVFSPGESHCATCSEDGSVRVWALASMELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKECEDLGVEGTDLWLAASGDQRVSVWASDWLRNHCELVDWLSFPMPATTETQGHLPPSLAAFCPWDGALLMYVGPGVYKEVIIYNLCQKQVVEKIPLPFFAMSLSLSPGTHLLAVGFAECMLRLVDCAMGTAQDFAGHDNAVHLCRFTPSARLLFTAARNEILVWEVPGL

SEQ ID NO: 3184 - protein, 327 aa, Homo sapiens [sequence omitted]

SEQ ID NO: 3185 - protein, 243 aa, Homo sapiens
MILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKKTKCIKRRPPWQICSKFGALPFVAEKMRQHRDPHILQKPFNVTETRCLPKPSRTTSWCKAIPPDSEKSISICDNLSELLMAMQDELDQMSMEHQELLKQMKETESHSVCDDIECELECLLKKMEIKGEQISKLKKHQDSVRRL

SEQ ID NO: 3186 - protein, 173 aa, Homo sapiens
MGTGLVAVWHRPGTFLKEVGAGSDCSDVQSLWDASSALSSLPLPLGRVSNTNKRKARPPSQVSCEGVGARESLSLLLLRVFVCLFVCLFQILMDDKTTRICHLLAKRKPPPPHPSSMPGHSWGQSDVAGVGMPKMKLGRMTQSGRRGLGLQVSALASVGPHSFASFAPCLSFL

SEQ ID NO: 3187 - protein, 368 aa, Homo sapiens
MAQEIDLSALKELEREAILQVLYRDQAVQNTEEERTRKLKTHLQHLRWKGAKNTDWEHKEKCCARCQQVLGFLLHRGAVCRGCSHRVCAQCRVFLRGTHAWKCTVCFEDRDVKIKTGEWFYEERAKKFPTGGKHETVGGQLLQSYQKLSKISVVPPTPPPVSESQCSRSPGRLQEFGQFRGFNKSVENLFLSLATHVKKLSKSQNDMTSEKHLLATGPRQCVGQTERRSQSDTAVNVTTRKVSAPDILKPLNQEDPKCSTNPILKQQNLPSSPAPSTIFSGGFRHGSLISIDSTCTEMGNFDNANVTGEIEFAIHYCFKTHSLEICIKACKNLAYGEEKKKKCNPYVKTYLLPDRSSQRPQGSRLQQA

SEQ ID NO: 3188 - protein, 384 aa, Homo sapiens
METKLPPASTPTSPSSPGLSPVPPPDKVDGFSRRSLRRARPRRSHSSSQFRYQSNQQELTPLPLLKDVPASELHELLSRKLAQCGVMFDFLDCVADLKGKEVKRAALNELVECVGSTRGVLIEPVYPDIIRMISVNIFRTLPPSENPEFDPEEDEPNLEPSWPHLQLVYEFFLRFLESPDFQPSVAKRYVDQKFVLMLLELFDSEDPREREYLKTILHRVYGKFLGLRAYIRKQCNHIFLRFIYEFEHFNGVAELLEILGSIINGFALPLKTEHKQFLVRVLIPLHSVKSLSVFHAQLALGKGTQRLACPCLGQCEVLPYPHHGVHGLFILAQLTLYTDTVLGAHSSLPSLCTSLSPFYLLGRGRGRAQARRDSQCPGVRGGSQ

SEQ ID NO: 3189 - protein, 377 aa, Homo sapiens
MIFSAAQHSNAAITEMERLQDLWEVYQRLGLEDDIVDPSNTLLREGPVLKISFRRNDPMERYLFLFNNMLLYCVPRVIQVGAQFQVRTRIDVAGMKVRELMDAEFPHSFLVSGKQRTLELQARSQEEMISWMQAFQAAIDQIEKRNETFKAAAQGPEGDIQEQELQSEELGLRAPQWVRDKMVTMCMRCQEPFNALTRRRHHCRACGYVVCARCSDYRAELKYDDNRPNRVCLHCYAFLTGNVLPEAKEDKRRGILEKGSSATPDQSLMCNFLQLIGDKWGKSGPRGWCVIPRDDPLVLYVYAAPQDMRAHTSIPLLGYQVTVGPQGDPRVFQLQQSGQLYTFKAETEELKGRWVKAMERAASGWSPSWPNDGDLSD

SEQ ID NO: 3190 - protein, 175 aa, Homo sapiens
MTFDGEVKTDVNKIEEFLEEKLAPPRYPKLGTQHPESNSAGNDVFAKFSAFIKNTKKDANEIHEKNLLKALRKLDNYLNSPLPDEIDAYSTEDVTVSGRKFLDGDELTLADCNLLPKLHIIKIVAKKYRDFEFPSEMTGIWRYLNNAYARDEFTNTCPADQEIEHAYSDVAKRMK

SEQ ID NO: 3191 - protein, 498 aa, Homo sapiens
MALPTLPSYWCSQQRLNQQLARQREQEARLRQQWEQNSRYFRMSDICSSKQAEWSSKTSYQRSMHAYQREKMKEEKRRSLEARREKLRQLMQEEQDLLARELEELRLSMNLQERRIREQHGKLKSAKEEQRKLIAEQLLYEHWKKNNPKLREMELDLHQKHVVNSWEMQKEEKKQQEATAEQENKRYENEYERARREALERMKAEEERRQLEDKLQAEALLQQMEELKLKEVEATKLKKEQENLLKQRWELERLEEERKQMEAFRQKAELGRFLRHQYNAQLSRRTQQIQEELEADRRILQALLEKEDESQRLHLARREQVMADVVWMKQAIEEQLQLERAREAELQMLLREEAKEMWEKREAEWARERSARDRLMSEVLTGRQQQIQEKIEQNRRAQEESLKHREQLIRNLEEVRELARREKEESEKLKSARKQELEAQVAERRLQAWEADQQEEEEEEEARRVEQLSDALLQQEAETMAEQGYRPKPYGHPKIAWN

SEQ ID NO: 3192 - protein, 257 aa, Homo sapiens [sequence omitted]

SEQ ID NO: 3193 - protein, 137 aa, Homo sapiens [sequence omitted]

SEQ ID NO: 3194 - protein, 424 aa, Homo sapiens
MLSEQTAALGTGWESMNVQLDGAEPQVERGSQEERPWRTVPGPLEHLCCDLEEEPQSLQEKAQSAPWVPAIPQEGNTGDWEMAAALLAAGSQGLVTIKDVSLCFSQEEWRSLDPSQTDFYGEYVMQENCGIVVSLRFPIPKLDMLSQLEGGEEQWVPDPQDLEERDILRVTYTGDGSEHEGDTPELEAEPPRMLSSVSEDTVLWNPEHDESWDSMPSSSRGMLLGPPFLQEDSFSNLLCSTEMDSLLRPHTCPQCGKQFVWGSHLARHQQTHTGERPYSCLKCEKTFGRRHHLIRHQKTHLHDKTSRCSECGKNFRCNSHLASHQRVHAEGKSCKGQEVGESPGTRKRQRAPPVPKCHVCTECGKSFGRRHHLVRHWLTHTGEKPFQCPRCEKSFGRKHHLDRHLLTHQGQSPRNSWDRGTSVF

SEQ ID NO: 3195 - protein, 125 aa, Homo sapiens [sequence omitted]

SEQ ID NO: 3196 - protein, 189 aa, Homo sapiens
MSPRLECSGAISAPCNFPLSGSSDSPASASRVAGTTGTRHHAQLIFVFLVETGFRHIGQAALELLTSGDPPTSASQSAGITVLSHRTRPSLFLRQDLLFPRLECSGVITAHCSLNPLGSSSPPTSDSGVAGPTRPHHHTWLIFVFVEMGILPCHPGWSRTPELKQSSHLGLSKRWDYRHEPPHLATTSF

SEQ ID NO: 3197 - protein, 175 aa, Homo sapiens
MRLPGAPALPDADFLVHLHFLVQTSWFICNFLVRIPWASALPDAPALLVILEKTFPEHATCRGCWVSGYLCWTAPGNCICSANVGFLKIENTYRQIHHTHMHRHTHTHTDKSITHTCTDTHTQSQRHRLTSRALRLFILNAITDTSKFGAAVFFYVYCLFADSVYKFFPFLPPFR

SEQ ID NO: 3198 - protein, 254 aa, Homo sapiens
MSTACWVRRLCRQQFGGPAGLSLASTVFGRNRSGDSLPASDRPPISSPLATSGTIFSAISCFWDLPAPFLWLAPSCQPTMSSQIRQNYSTDVEAAVNSLVNLYLQASYTYLSLGFYFDRDDVALEGVSHFFRELAEEKREGYERLLKMQNQRGGRALFQDIKKPAEDEWGKTPDAMKAAMALEKKLNQALLDLHALGSARTDPHLCDFLETHFLDEEVKLIKKMGDHLTNLHRLGGPEAGLGEYLFERLTLKHD

SEQ ID NO: 3199 - protein, 113 aa, Homo sapiens
MDMKGLWKVQSHLLMRGMTEPSLQSDLWTCSQFLEKCGPCSSVTENTEFQRASLGQGLCKRVVRGTSNPGNLVAGRGLGPLPHAPWDLHCDCPTPSAQLLPHQLPCIALSWDP

SEQ ID NO: 3200 - protein, 113 aa, Homo sapiens [sequence omitted]

SEQ ID NO: 3201 - protein, 125 aa, Homo sapiens [sequence omitted]

SEQ ID NO: 3202 - protein, 174 aa, Homo sapiens [sequence omitted]

SEQ ID NO: 3203 - protein, 615 aa, Homo sapiens
MTQAAVRPWAPCLENMTTAPNGLGPGPAAPCAGSDLKDAKMVTSLACGNGVCGCSPGGDTDTQEAKLSPAKLVRLFSTSRKRTGAHPERPHSMVLVGNSSTWNTLASFRKMGSFKKLKSSVLKGIQSREGSNACSKGEASEHGLGKSIPNGAVPGAQASRGSPLAPGPACGALRPAEWGTLDGSDLEDTDDAFQRSTHRSRSLRRAYGLGRICLLDAPQNHATPTIATGQVPAVCEILVKDPENNSMGYRRSKSTDNLAFLKKSSFKRKSTSNLADLRTAHDARVPQRTLSSSSTDSQKLGSGRTKRWRSPIRAKDFDRVFKLVSNVTEAAWRRESPRSGAPSPGEASLRLQAHSRLHDDYSRRVSRSTEQDSRRGGAVMHGTTATCTVVPGFGSATSKGPHLDADTAVFPLETKSSWAVESDSSCTCSSLPSPIVQDVLSKDSCDPNAGSQLTFDPEQPPTPLRPTTPKPQSPQSPQSPGAGSASCHSNHSALSANSEESEGRAEEPAQREPGPVSLQDPLEATHGDEGSKDLLVNIGVAAGPEEKEKEEVRAAARSLMWATLLREGSLHRCCPWSLTCQGQWPSADLVALTVLVGMGVVKLLFTKFRSNLYLL

SEQ ID NO: 3204 - protein, 406 aa, Homo sapiens [sequence omitted]

SEQ ID NO: 3205 - protein, 244 aa, Homo sapiens [sequence omitted]

SEQ ID NO: 3206 - protein, 553 aa, Homo sapiens
MDSVASEDVAVNFTLEEWALLDPSQKKLYRDVMRETFRNLACVGKKWEDQSIEDWYKNQGRILRNHMEEGLSESKEYDQCGEAFSQILNLNLNKKIPTIVRPCECSLCGKVFMHHSSLSRHIRSHLGHKPYDYQEYGEKPYKCKQCGKAFSSCQSFRRHERTHTGEKPYACPECGKAFISLPSVRRHMIKHTGDGPYKCQECGKAFDRPSLFQIHERTHTGEKPYECQECAKAFISLPSFQRHMIRHTGDGPYKCQECGKAFDRPSLFRIHERTHTGEKPHECKQCGKAFISFTNFQSHMIRHTGDGPYKCKVCGRAFIFPSYVRKHERTHTGEKPYECNKCGKTFSSSSNVRTHERTHTGEKPYECKECGKAFISLPSVRRHMIKHTGDGPYKCQVCGRAFDCPSSFQIHERTHTGEKPYECQVCGKAFISLKRIRKHMILHTGDGPYKCQVCGKAFDCPSSVRTHERTHTGEKPYECKECGKAFNYASSIRIHERTHTGEKPYECKQCGKTFSYSSSFQRHERAHNGDKPYVKNVGKLSFITQPSNTCENE

SEQ ID NO: 3207 - protein, 315 aa, Homo sapiens
MKGWPESGQETPLGYSNGGGIFLLELRTLEGAKAHAGPLTLAEVPLPAHLLLCSSTSLWKKTTSPCGRRSSPCRPSWRGGAGPCTCMSACAPWIVPPAQLQGSWAAGTRLRGSWALAHRDNMAAGSSWSCSRPRVPVTQLSRSLQVHSLMILPASSSAPCPHCPLAPLWLLNLLSSCPPALSCLPRTLVPACRGLPLSSVPSSPASRPKLPLHSPSSWSIPPEGSWGPLPTTLPLPWGLHVCRAGSTNLLSQQPLGKGWLWIPALTLSWPFLCSPLLKSTSNLVFGAGLAPSLGSGSSLSTRASPPSLLGAALRG

SEQ ID NO: 3208 - protein, 640 aa, Homo sapiens [sequence omitted]

SEQ ID NO: 3209 - protein, 574 aa, Homo sapiens
MENWPTPSELVNTGFQSVLSQGNKKPQNRKEKEEKVEKRSNSDSKENRETKLNGPGENVSEDEAQSSNQRKRGWKRDREKRDDQDDVSSVRSEGGNIRGSFRGRGRGRGRGRGRGRGNPRLNFDYSYGYQEHGERTDQPFQTELNTSMMYYYDDGTGVQVYPVEEALLKEYIKRQIEYYFSVENLERDFFLRGKMDEQGFLPISLIAGFQRVQALTTNLNLILEVLKDSTEVEIVDEKMRKKIEPEKWPIPGPPPRSVPPTDFSQLIDCPEFVPGQAFCSHTESAPNSPRIGSPLSPKKNSETSILQAMSRGLSTSLPDLDSEPWIEVKKRHQPAPVKLRESVSVPEGSLNQLCSSEEPEQEELDFLFDEEIEQIGRKNTFTDWSDNDSDYEIDDQDLNKILIVTQTPPYVKKHPGGDRTGTHMSQAKITSELAKVINDGLYYYEQDLWMEEDENKHTAIKQEVENFKKLNLISKEQFENLTPELPFEPNQEVPVAPSQSRQDLTDELAQKLFDVSEITSAAMVHSLPTAVPESPRIHPTRTPKTPRTPRLQDPNKTPRFYPVVKEPKAIDVKS

SEQ ID NO: 3210 - protein, 625 aa, Homo sapiens [sequence omitted]

SEQ ID NO: 3211 - protein, 386 aa, Homo sapiens
MAQWHCSQRTQAGGHGVGERLAQCQDQSSRHAAELRDFKNKMLPLLEVAEKEREALRTEADTISGRVDRLEREVDYLETQNPALPCVEFDEKVTGGPGTKGKGRRNEKYDMVTDCGYTISQVRSMKILKRFGGPAGLWTKDPLGQTEKIYVLDGTQNDTAFVFPRLRDFTLAMAARKASRVRVPFPWVGTGQPVYGGFLYFARRPPGRPGGGGEMENTLQLIKFHLANRTVVDSSVFPAEGLIPPYGLTADTYIDLAADEEGLWAVYATREDDRHLCLAKLDPQTLDTEQQWDTPCPRENAEAAFVICGTLYVVYNTRPASRARIQCSFDASGTLTPERAALPYFPRRYGAHASLRYNPRERQLYAWDDGYQIVYKLEMRKKEEEV

SEQ ID NO: 3212 - protein, 721 aa, Homo sapiens
MEEGNNNEEVIHLNNFHCHRGQEWINLRDGPITISDSSDEERIPMLVTPAPQQHEEEDLDDDVILTETNKPQRSRPNLIKPAAQWQDLKRLGEERPKKSRAAFESDKSSYFSVCNNPLFDSGAQDDSEDDYGEFLDLGPPGISEFTKPSGQTEREPKPGPSHNQAANDIVNPRSEQKVIILEEGSLLYTESDPLETQNQSSEDSETELLSNLGESAALADDQAIEEDCWLDHPYFQSLNQQPREITNQVVPQERQPEAELGRLLFQHEFPGPAFPRPEPQQGGISGPSSPQPAHPLGEFEDQQLASDDEEPGPAFPMQESQEPNLENIWGQEAAEVDQELVELLVKETEARFPDVANGFIEEIIHFKNYYDLNVLCNFLLENPDYPKREDRIIINPSSSLLASQDETKLPKIDFFDYSKLTPLDQRCFIQAADLLMADFKVLSSQDIKWALHELKGHYAITRKALSDAIKKWQELSPETSGKRKKRKQMNQYSYIDFKFEQGDIKIEKRMFFLENKRRHCRSYDRRALLPAVQQEQEFYEQKIKEMAEHEDFLLALQMNEEQYQKDGQLIECRCCYGEFPFEELTQCADAHLFCKECLIRYAQEAVFGSGKLELSCMEGSCTCSFPTSELEKVLPQTILYKYYERKAEEEVAAAYADELVRCPSCSFPALLDSDVKRFSCPNPHCRKETCRKCQGLWKEHNGLTCEELAEKDDIKYRTSIE

SEQ ID NO: 3213 - protein, 209 aa, Homo sapiens
MCGPPQEEGTLIIEGLLNIAWGLRRPIRLQMQDDREQVHLPSTSWMPRRPSCPLKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGERTKIKRLRVPADFQNPAWAM

SEQ ID NO: 3214 - protein, 562 aa, Homo sapiens
MDPQPPPPAQGSPPHRGRGRGRGRGRGRGRGRGRGGAGAPRAPLPCPTCGRLFRFPYYLSRHRLSHSGLRPHACPLCPKAFRRPAHLSRHLRGHGPQPPLRCAACPRTFPEPAQLRRHLAQEHAGGEVELAIERVAKETAEPSWGPQDEGSEPPTTAAAGATEEEAVAAWPETWPAGEPSTLAAPTSAAEPRESESEEAEAGAAELRAELALAAGRQEEKQVLLQADRTLLCLRCREAFATKGELKAHPCLRPEGEQEGEGGPPPRPKRHQCSICLKAFARPWSLSRHRLVHSTDRPFVCPDCGLAFRLASYLRQHRRVHGPLSLLAPLPAAGKKDDKASGARNSAKGPEGGEGAECGGASEGGEGQNGGDAAPARPPAGEPRFWCPECGKGFRRRAHLRQHGVTHSGARPFQCVRCQREFKRLADLARHAQVHAGGPAPHPCPRCPRRFSRAYSLLRHQRCHRAELERAAALQALQAQAPTSPPPPPPPLKAEQEEEGLPLPLANIKEEPPSPGTPPQSPPAPPVFLSASCFDSQDHSAFEMEEEEVDSKAHLRGLGGLAS

SEQ ID NO: 3215 - protein, 580 aa, Homo sapiens
MWRPVQLCHFHSALLHRRQKPWPSPAVFFRRNVRGLPPRFSSPTPLWRKVLSTAVVGAPLLLGARYVMAEAREKRRMRLVVDGMGRFGRSLKVGLQISLDYWWCTNVVLRGVEENSPGYLEVMSACHQRAADALVAGAISNGGLYVKLGQGLCSFNHLLPPEYTRTLRVLEDRALKRGFQEVDELFLEDFQALPHELFQEFDYQPIAAASLAQVHRAKLHDGTSVAVKVQYIDLRDRFDGDIHTLELLLRLVEVMHPSFGFSWVLQDLKGTLAQGLDFENEGRNAERCARELAHFPYVVVPRVHWDKSSKRVLTADFCAGCKVNDVEAIRSQGLAVHDIAEKLIKAFAEQIFYTGFIHSDPHPGNVLVRKGPDGKAELVLLDHGLYQFLEEKDRAALCQLWRAIILRDDAAMRAHAAALGVQDYLLFAEMLMQRPVRLGQLWGSHLLSREEAAYMVDMARERFEAVMAVLRELPRPMLLVLRNINTVRAINVALGAPVDRYFLMAKRAVRGWSRLAGATYRGVYGTSLLRHAKVVWEMLKFEVALRLETLAMRLTALLARALVHLSLVPPAEELYQYLET

SEQ ID NO: 3216 - protein, 127 aa, Homo sapiens
MDGYDCSVQWRLRHVFSAHLSLSLSHHGEFHGSAGFPCAASKLKLHFLPQGISIILEIIGFWLSTNTQPRNTCRLTASGEDLNQCGTGGQMLQAPVSGGQFGKTFRRLSEGSGRKEVHGSSLNSMPQ

SEQ ID NO: 3217 - protein, 531 aa, Homo sapiens
MCQLLESTVIQPQGDSPVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 3218 - protein, 159 aa, Homo sapiens
MLPESFSEEDLFIEIAGLSYSGDFRMVVGEDKTKVLNIVKPNIAHFRELYGSILQENPQVVYKSQQGWLEIDKSPEGQFTQLMTLPKTLQQQINHIMDPPGKNRDVEETLFQVAHDPDCGDVVRLGTFMNLMLRKCQPWGKADFVCDWNVLFLPFCLAR

SEQ ID NO: 3219 - protein, 211 aa, Homo sapiens
MLRQSCSFPVTSLPALGGVCGREGAGAEVPPAACGCEGRDPDTERSCGRSSTGGCSPCSGPGPSSPRTSRGALSPSLGRLFPHIQVVIKLRIQLAPAVHLALPTCSLLTSSPPLEGCCHRLNEEAEVQRGFRPIAVELEFENQPLGAETRLRNGRRAGVKRSEGRGQVRPGQVRSTGPEGGLTRMERKAARLQWDSGSIKMSENEQLWEEP

SEQ ID NO: 3220 - protein, 180 aa, Homo sapiens
MEVVQVLTKPAGNPSCMYPQGTFVIPLLVTAHRDPTQFKDPDCFNPTNFLDKGKFQGNDAFMPFASGAGRGGRGPAWTGSGVPGAHCAPVYPAKQMCLGTGLAHSGIFLFLTATLQRFCLLPVVRPGTINLTCSALAWAVSPQTSSSSQWPAEVRLHYGGLTGPQTSIPSSVNKGPKLQM

SEQ ID NO: 3221 - protein, 158 aa, Homo sapiens
MWFSWLQGTPLPLQDSGKLHVGTSTGPHQHCAVYSGGSSDMVCELLGVRGMDILYIGDHIFGDILKSKKRQGWRTCLVVPELSWELDIWAQEKERLEELKRLDTHLADIYQHMDGSSCELQVINFTKREIQMPHESVVEQEQANLDPASCLLSCNQRG

SEQ ID NO: 3222 - protein, 206 aa, Homo sapiens
MSGFTALHWAAKSGDGEMALQLVEVARRSGAPVDVNARSHGGYTPLHLAALHGHEDAAVLLVVRLGAQVHVRDHSGRRAYQYLRPGSSYALRRLLGDPGLRGTTEPDATGGGSGSLAARRPVQVAATILSSTTSAFLGVLADDLMLQDLARGLKKSSSFSKFLSASPMAPRKKTKIRGGLPAFSEISRRPTPGPLAGLVPSLPPTT

SEQ ID NO: 3223 - protein, 492 aa, Homo sapiens; identical to SEQ ID NO: 1974

SEQ ID NO: 3224 - protein, 533 aa, Homo sapiens [sequence omitted]

SEQ ID NO: 3225 - protein, 141 aa, Homo sapiens [sequence omitted]

SEQ ID NO: 3226 - protein, 629 aa, Homo sapiens [sequence omitted]

SEQ ID NO: 3227 - protein, 645 aa, Homo sapiens [sequence omitted]

SEQ ID NO: 3228 - protein, 133 aa, Homo sapiens
MAGRPGSQEQSKDRGTGSLPPPSQRPLGPSPEGAGPSPPPPGIPRGGGSSSSEGPHSYFLSLVDSQLLRRGFPLTPLIQRHLPPRTSALAERTHRYRFSRLPPPTPFRTPGRPNIPPYTCPCSPGWDWSCFPP

SEQ ID NO: 3229 - protein, 153 aa, Homo sapiens [sequence omitted]

SEQ ID NO: 3230 - protein, 107 aa, Homo sapiens [sequence omitted]

SEQ ID NO: 3231 - protein, 485 aa, Homo sapiens [sequence omitted]

SEQ ID NO: 3232 - protein, 122 aa, Homo sapiens [sequence omitted]

SEQ ID NO: 3233 - protein, 508 aa, Homo sapiens
MESGLNWLLLVAVLKGVQCEVQILESGGGLVQPGGSLTLSCAASGFIFSNYVMTWVRQAPGKGLEWVSSTAASGANTFYADSVKGRFTVSRDNSENMMYLQMSSLRGEDTGIYYCAKDGDVPNLGVAWIVAGPGNVRPRKWFDSWGQGTLVAVSSPSPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 3234 - protein, 107 aa, Homo sapiens
MGSWSRKRWWPEVNCSENLSPSASFAKLWPQGHMTGAPPSLGRSPHGNEGLTVNPPLILLHLQSNEKRFQSAKDTLSPLPDPCDPRSSCLVTVSPNEPHLNQAPFSP

SEQ ID NO: 3235 - protein, 123 aa, Homo sapiens
MLGPNAQVTVVVAQPGPDHLDHLLLDTQHCQHSSCGSAACTQLTWVPCLGGSHKASIKMSAQAVVSTEAPWERPCFQAHLGCLQNSVLCSCRMEGFSLFLAMLWGGVGELPSDPRGHLQFLAT

SEQ ID NO: 3236 - protein, 123 aa, Homo sapiens [sequence omitted]

SEQ ID NO: 3237 - protein, 109 aa, Homo sapiens [sequence omitted]

SEQ ID NO: 3238 - protein, 256 aa, Homo sapiens
MQAVVPLNKMTAISPEPQTLASTEQNEVPRVVTSGEQEAILRGNAADAESFRQRFRWFCYSEVAGPRKALSQLWELCNQWLRPDIHTKEQILELLVFEQFLTILPGEIRIWVKSQHPESSEEVVTLIEDLTQMLEEKDPVSQDSTVSQEENSKEDKMVTVCPNTESCESITLKDVAVNFSRGEWKKLEPFQKELYKEVLLENLRNLEFLDFPVSKLELISQLKWVELPWLLEEVSKSSRLDIHGAVKKMQMFSEAE

SEQ ID NO: 3239 - protein, 135 aa, Homo sapiens [sequence omitted]

SEQ ID NO: 3240 - protein, 184 aa, Homo sapiens
MASERLPNRPACLLVASGAAEGVSAQSFLHCFTMASTAFNLQVATPGGKAMEFVDVTESNARWVQDFRLKAYASPAKLESIDEPICAVGHGVAALCCATNEDRSWVFDSYSLTGPSVCELVRAPGFARLPLVVEDFVKDSGACFSASEPDAVHVVLDRHLVTGQNASSTVPAVQNLLFLCGSRK

SEQ ID NO: 3241 - protein, 137 aa, Homo sapiens
MILPTKAMATQELTVKRKLSGNTLQVQASSPVALGVRIPTVALHMMELFDTTVEQLYSIFTVKELTNKKIIMKWRCGNWPEEHYAMVALNFVPTLGQTELQLKEFLSICKEENMKFCWQKQHFEEIKGSLQLTPLNG

SEQ ID NO: 3242 - protein, 364 aa, Homo sapiens
MFADLDYDIEEDKLGIPTVPGKVTLQKDAQNLIGISIGGGAQYCPCLYIVQVFDNTPAALDGTVAAGDEITGVNGRSIKGKTKVEVAKMIQEVKGEVTIHYNKLQADPKQGMSLDIVLKKVKHRLVENMSSGTADALGLSRAILCNDGLVKRLEELERTAELYKGMTEHTKNLLRAFYELSQTHRAFGDVFSVIGVREPQPAASEAFVKFADAHRSIEKFGIRLLKTIKPMLTDLNTYLNKAIPDTRLTIKKYLDVKFEYLSYCLKVKEMDDEEYSCIVSVGGGGGLVLPPTWSARDSRWLRPTRERPGGLGWTLVPGDLGPSSQSRSLGLGVLGTRPGTTPSVWGTLGGKSDFLHSYEALLSV

SEQ ID NO: 3243 - protein, 491 aa, Homo sapiens
MEFWLSWVFLVAILEGVQCDVQLVESGGGSIQPGGSLRLSCTASGFSLSTYYMVWVRQAPGKGLEWVSLMYSGGTTLNADSVEGRLTVSRAPSENTLYLQLTGVRVDDTAVYFCARGAREGVWNLDLWGRGTLVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAATSILRVAAEDWKKGDTFSCMVGHEALPLAFTQKTIDRLAGKPTHVNVSVVMAEVDGTCY

SEQ ID NO: 3244 - protein, 127 aa, Homo sapiens
MARLPKLAVFDLDYTLWPFWVDTHVDPPFHKSSDGTVRDRRGQDVRLYPEVPEVLKRLQSLGVPGAAASRTSEIEGANQLLELFDLFRYFVHREIYPGSKITHFERYAEIREEQGEKVSERPGKPRY

SEQ ID NO: 3245 - protein, 113 aa, Homo sapiens [sequence omitted]

SEQ ID NO: 3246 - protein, 139 aa, Homo sapiens [sequence omitted]

SEQ ID NO: 3247 - protein, 151 aa, Homo sapiens [sequence omitted]

SEQ ID NO: 3248 - protein, 138 aa, Homo sapiens [sequence omitted]

SEQ ID NO: 3249 - protein, 105 aa, Homo sapiens [sequence omitted]

SEQ ID NO: 3250 - protein, 119 aa, Homo sapiens
MTRGHCLATAETRRGSAVPTCLSEAALGRRSVRLRLGLSIIRKSLSNSSAEDAGRAVGTAGAAPGVHTRAGLCRGAGSLCFTLRPSWSPWFGPSPPRGPGVHLGWGVPMAASLSCLSPH

SEQ ID NO: 3251 - protein, 213 aa, Homo sapiens [sequence omitted]

SEQ ID NO: 3252 - protein, 136 aa, Homo sapiens [sequence omitted]

SEQ ID NO: 3253 - protein, 102 aa, Homo sapiens [sequence omitted]

SEQ ID NO: 3254 - protein, 189 aa, Homo sapiens [sequence omitted]

SEQ ID NO: 3255 - protein, 256 aa, Homo sapiens
MVPSDPPDKSADELLATHSHSWNQHLQAFAQPGTHFPTSNCTPTPPTPVLPGPASLCSPASPELRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLWGLYLACPGVCGCGPAGSCSPPSCCCPSSRWWPACSSSRTSTWWPATPPPGNSSPHTASPISASAPATPSTEA

SEQ ID NO: 3256 - protein, 162 aa, Homo sapiens
MESGPWLNSVTAGSTGRLCTGMYPRWLLQLHASAAHFPEPPEAALWAGTQAQVPQDQPAMSPHVLRPLYPQMSLTLSPSNHVPKNLFFFFFFFEMEPHSVAQAGVHWHHLGSWQLPPPGFKQFSASASQIAGITGTCHHARLIFVFLVEMGFHHLGQAGLNS

SEQ ID NO: 3257 - protein, 124 aa, Homo sapiens [sequence omitted]

SEQ ID NO: 3258 - protein, 151 aa, Homo sapiens [sequence omitted]

SEQ ID NO: 3259 - protein, 103 aa, Homo sapiens
MNKHECIWRMRHLGIWKVRHPGREMKMESHSVAQAGVQWCDLGSLQPPPPGFKRFSCLSLLSGWDYRFKLQDVQNQTRRRINEMDICKTRQDSHLATANYLAS

SEQ ID NO: 3260 - protein, 134 aa, Homo sapiens
MIPVRGLWYCYLQVKKVRLREAERLGPKSQCPAECGAASWISWVLQHQQLLASEWATKDGRGTWGSKPSCMVPALSATSQLLQLGRLNSDLQFVRQRAKKSVSSPSLLQFWCCLSRLSFHALNQKINSTNINIT

SEQ ID NO: 3261 - protein, 119 aa, Homo sapiens [sequence omitted]

SEQ ID NO: 3262 - protein, 419 aa, Homo sapiens
MVCLCEWGATRHAHVQQRAHYPCPPSPTYKWKRQVTQRNPVGQKKRKMSLLFDHLEPMELAEHLTYLEYRSFCKILFQDYHSFVTHGCTVDNPVLERFISLFNSVSQWVQLMILSKPTAPQRALVITHFVHVAEKLLQLQNFNTLMAVVGGLSHSSISRLKETHSHVSPETIKLWEGLTELVTATGNYGNYRRRLAACVGFRFPILGVHLKDLVALQLALPDWLDPARTRLNGAKMKQLFSILEELAMVTSLRPPVQANPDLLSLLTVSLDQYQTEDELYQLSLQREPRSKSSPTSPTSCTPPPRPPVLEEWTSAAKPKLDQALVVEHIEKMVESVFRNFDVDGDGHISQEEFQIIRGNFPYLGAFGDLDQNQDGCISREEMVSYFLRSSSVLGGRMGFVHNFQESNSCAPSPAATAKP

SEQ ID NO: 3263 - protein, 471 aa, Homo sapiens
MAKRKEENFSSPKNAKRPRQEELEDFDKDGDEDECKGTTLTAAEVGIIESIHLKNFMCHSMLGPFKFGSNVNFVVGNNGSGKSAVLTALIVGLGGRAVATNRGSSLKGFVKDGQNSADISITLRNRGDDAFKASVYGNSILIQQHISIDGSRSYKLKSATGSVVSTRKEELIAILDHFNIQVDNPVSVLTQEMSKQFLQSKNEGDKYKFFMKATQLEQMKEDYSYIMETKERTKEQIHQGEERLTELKRQCVEKEERFQSIAGLSTMKTNLESLKHEMAWAVVNEIEKQLNAIRDNIKIGEDRAARLDRKMEEQQVRLNEAEQKYKDIQDKLEKISEETNARAPECMALKADVVAKKRAYNEAEVLYNRSLNEYKALKKDDEQLCKRIEELKKSTDQSLEPERLERQKKISWLKERVKAFQNQENSVNQEIEQFQQAIEKDKEEHGNIYLPLKKILNTMRNFLKGANYIIK

SEQ ID NO: 3264 - protein, 349 aa, Homo sapiens [sequence omitted]

SEQ ID NO: 3265 - protein, 117 aa, Homo sapiens
MLCSVEYPIVTRVRRMCTSWGTTWREGTTLGIRSNPLQLKPHSFPTDPVFQAQGLPLHQPTFRKCLRAAGLRSQSSVISVMVPSRMPGVSVGEVNGGGQGQESLLRVCLCVCTTLLL

SEQ ID NO: 3266 - protein, 503 aa, Homo sapiens
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPLLLLFLGLACCACCCWAPRSDLKDRPARDGATVSRMKLQVWGTLTSLGSTLPCRSLSSHKLPWVTVSHHDPEVPFNHSFIEPPSAGWATDDSFSSDPESGEADEVPAYCVPPQEGMVPVAQAGSSEASLAAGAFPPPEDASTPFAIPRTSSLARAKRPSVSFAEGTKFAPQSRRSSGELSSPLRKPKRLSRGAQSGPEGREAEESTGPDEAEAPESFPAAASPGDSATGHRRPPLGSRTVAEHVEAIEGSVQESSGPVTTIYMLAGKPRGSEGPVRSVFRHFGSFQKGQAEAKVKRAIPKPPRQALNRKKGSPGLASGSVGQSPNSAPKAGLPGATGPMAVRPEEAVRGLGAGTESSRRAQEPVSGCGSPEQDPQKQAEEERQEEPEYENVVPISRPPEP

SEQ ID NO: 3267 - protein, 739 aa, Homo sapiens
MDSAAKDEMQPALSPGPEWPEQERAEQLARGAALKWASGIFYRPEQLARLGQYRSREVQRTCSLESRLKSVMQSYLEGVQTGVWQLAQAIEVVQGTREALSQARGLLQGMSQALQTLEPLRERVAQHKQLQALSHLLPRLRAVPAAVSHTQTLIDGQQFLEAYVSLRELEQLREDTWAPLGGLELPVFQGLDLLFEALGQAVEAAAGAAGKLAREDPALLVAAVRVAEVETGRTTPLGQVPRDWRQRCLRALQEGLEQAHFGSPLLPAPGALPGWLEALRVALPVELATAEALVAPCCPPQYNVVQLWAHTLHSGLRRSLQNLLAGPELEAADAFALLHWALHVYLGQEMMGSLELGPEADVSQLEPLLTLENIEQLEATFVANIQASVSQWLQNALDGEVAEWGREHGPNTDPSGSYYSPMPAIVLQILEENIRVASLVSESLQQRVHGMALSELGTFLRSFSDALIRFSRDHFRGKSMAPHYVPYLLAALNHKSALSSSVSVLQLDGAPSGALAPVEAALDELQRRIYRLVLEALQAELQPLFADLPSRQWLSSPELLQSVCERTGRFCRDFWRVRNPTVQLLLAEAERAVVLQYLSALMQGRLVCRGADERTQAAERLRHDAAQLQQLFLSLGLEENAHCAPVLLALRELLNLRDPALLGLEVAGLRQQFPDVSEDHVSALLGLRGDLSREQHLAALPPSPRASRRVLFSLVPAPALAPASCLPSGSCARALLLAE

SEQ ID NO: 3268 - protein, 639 aa, Homo sapiens
MALPRLGTQSTGPGRCLSPNLQAQEAPAPVTTSSSTSTLSSSPWSAQPTWKSDPGFRITVVTWNVGTAMPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 3269 - protein, 227 aa, Homo sapiens
MEDKKPFILSSMRLPLLDTNSKVKRAVVQVISAMAHHGYLEQPGGEAMIEYIVQQCALPPEQEPEKPGPGSKDPKADSVRAISVRTLYLVSTTVDRMSHVLWPYLLQFLTPVRFTGALTPLCRSLVHLAQKRQEAGADAFLIQYDAHASLPSPYAVTGRLLVVSSSPYLGDGRGAAALRLLSVLHPNIHPLLGQHWETTVPLLLGYLDGEARVRMGCIALWGGQVSE

SEQ ID NO: 3270 - protein, 106 aa, Homo sapiens
MGFNELSSWLRLPGVRLEVSTLTQQEAMPPPDHRDHGGRRKGFLGASTWLISLMMPNSLTNLTIVLGGNWGLLIGRGSLSRVCLAKGLSDVHLRHAASGFLVIITL

SEQ ID NO: 3271 - protein, 391 aa, Homo sapiens
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGIYNVGPENPSRICIVIEPAQLLKGDVMVKCYHKKYRSATRDVIFRLQFHTGAVQGYGLVFGKEDLDNASKDDRFPDYGKVELVFSATPEKIQGSEHLYNDHGVIVDYNTTDPLIRWDSYENLSADGEVLHTQGPVDGSLYAKVRKKSSSDPGIPGGPQAIPATNSPANVLFELIGQV

SEQ ID NO: 3272 - protein, 223 aa, Homo sapiens
MWKPSPSSSPASWSCTALRAPQSCLRAATVRPVTLQARADSPTVPEPVHRPQDPWHIPGVPEPVHRPQDPWHIPGVPEPVHRPQDPWHIPGVPEPVHRPQDPWHIPGVPEPVHRPQDPWPWLQLVPPAELAYCLLMLLLAHCMKQQARPGHPDFLHREAWACLSAAGGLASPGLLLWATARPRASGEAGPGRALVGADAACCPRHSVLSLVDIPSGQVLPQGQ

SEQ ID NO: 3273 - protein, 113 aa, Homo sapiens [sequence omitted]

SEQ ID NO: 3274 - protein, 270 aa, Homo sapiens [sequence omitted]

SEQ ID NO: 3275 - protein, 113 aa, Homo sapiens
MRLPPRARLTFPHQCREWSCWRTHTPAVRAPFPGAAPGNYGSTGSSQEEGSWRSHPAIQPSQTADLRAPPGRFPPPRVESFRGSPNSSTSSSISGSQAWEAPRHRFNWLGWED

SEQ ID NO: 3276 - protein, 614 aa, Homo sapiens [sequence omitted]

SEQ ID NO: 3277 - protein, 344 aa, Homo sapiens
MLCGSGAQPPGPSLPSSLSSCMDASLAIKPVFERFQSVIITSGTLSPLDIYPKILDFHPVTMATFTMTLARVCLCPMIIGRGNDQVAISSKFETREDIAVIRNYGNLLLEMSAVVPDGIVAFYTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHREDQLGLSLLSLEQLESEETLKRIEQIAQQL

SEQ ID NO: 3278 - protein, 502 aa, Homo sapiens
MVAFLEQRASALLASCSKNCTNSPAIVRFSGQSRGVPAVSESYSAPGACEEPTERGNLEVGEPQSEPVRVLDMVAKLESECLKRQGQREPGSLSRNNSFRRNVGRVLLANSTQADEGKTKKGVLEAPDTQVNPVGSVSVDCGPSRADRCSPKEDQAWDGASQDCPPLPAGVSFHIDSAELEPGSQTAVKNSNRYDVEMTDELVGLPFSSHTYSQASELPTDAVDCMSRELVSLTSRNPDQRKESLCISITVSKVDKDQPSILNSCEDPVPGMLFFLPPGQHLSDYSQLNESTTKESSEASQLEDAAGGDSASEEKSGSAEPFVLPASSVESTLPVLEASSWKKQVSHDFLETRFKIQQLLEPQQYMAFLPHHIMVKIFRLLPTKSLVALKCTCCYFKFIIEYYNIRPADSRWVRDPRYREDPCKQCKKKYVKGDVSLCRWHPKPYCQALPYGPGYWMCCHRSQKGFPGCKLGLHDNHWVPACHSFNRAIHKKAKGTEAEEEY

SEQ ID NO: 3279 - protein, 104 aa, Homo sapiens [sequence omitted]

SEQ ID NO: 3280 - protein, 1098 aa, Homo sapiens
MGSKERFHWQSHNVKQSGVDDMVLLPQITEDAIAANLRKRFMDDYIFTYIGSVLISVNPFKQMPYFTDREIDLYQGAAQYENPPHIYALTDNMYRNMLIDCENQCVIISGESGAGKTVAAKYIMGYISKVSGGGEKVQHVKDIILQSNPLLEAFGNAKTVRNNNSSRFGKYFEIQFSRGGEPDGGKISNFLLEKSRVVMQNENERNFHIYYQLLEGASQEQRQNLGLMTPDYYYYLNQSDTYQVDGTDDRSDFGETLSVMQVIGIPPSIQQLVLQLVAGILHLGNISFCEDGNYARVESVDLLAFPAYLLGIDSGRLQEKLTSRKMDSRWGGRSESINVTLNVEQAAYTRDALAKGLYARLFDFLVEAINRAMQKPQEEYSIGVLDIYGFEIFQKNGFEQFCINFVNEKLQQIFIELTLKAEQEEYVQEGIRWTPIQYFNNKVVCDLIENKLSPPGIMSVLDDVCATMHATGGGADQTLLQKLQAAVGTHEHFNSWSAGFVIHHYAGKVSYDVSGFCERNRDVLFSDLIELMQTSEQAFLRMLFPEKLDGDKKGRPSTAGSKIKKQANDLVATLMRCTPHYIRCIKPNETKRPRDWEENRVKHQVEYLGLKENIRVRRAGFAYRRQFAKFLQRYAILTPETWPRWRGDERQGVQHLLRAVNMEPDQYQMGSTKVFVKNPESLFLLEEVRERKFDGFARTIQKAWRRHVAVRKYEEMREEASNILLNKKERRRNSINRNFVGDYLGLEERPELRQFLGKRERVDFADSVTKYDRRFKPIKRDLILTPKCVYVIGREKVKKGPEKGQVCEVLKKKVDIQALRGVSLSTRQDDFFILQEDAADSFLESVFKTEFVSLLCKRFEEATRRPLPLTFSDTLQFRVKKEGWGGGGTRSVTFSRGFGDLAVLKVGGRTLTVSVGDGLPKSSKPTRKGMAKGKPRRSSQAPTRAAPAPPRGMDRNGVPPSARGGPLPLEIMSGGGTHRPPRGPPSTSLGASRRPRARPPSEHNTEFLNVPDQGMAGMQRKRSVGQRPVPGVGRPKPQPRTHGPRCRALYQYVGQDVDELSFNVNEVIEILMEDPSGWWKGRLHGQEGLGSPSARSPA

SEQ ID NO: 3281 - protein, 594 aa, Homo sapiens [sequence omitted]

SEQ ID NO: 3282 - protein, 432 aa, Homo sapiens
MREVNSRCYQPEPFACGIEHCSVHYVSDSGDGVYAGRPLSVIQMVAFLEQRASALLASCSKNCTNSPAIVRFSGQSRGVPAVSESYSAPGACEEPTERGNLEVGEPQSEPVRVLDMVAKLESECLKRQGQREPGSLSRNNSFRRNVGRVLLANSTQADEGKTKKGVLEAPDTQVNPVGSVSVDCGPSRADRCSPKEDQAWDGASQDCPPLPAGVSFHIDSAELEPGSQTAVKNSNRYDVEMTDELVGLPFSSHTYSQASELPTDAVDCMSRELVSLTSRNPDQRKESLCISITVSKVDKDQPSNLNSCEDPVPGMLFFLPPSQHLSDYSQLNESTTKESSEASQLEDAAGGDSASEEKSGSAEPFVPPASSVESTLPVLEASSWKKQVSHDFLETRFKIQQLLEPQQYMAFLPPPHYGKNLQVTSHQEFSGP

SEQ ID NO: 3283 - protein, 627 aa, Homo sapiens
MVVQPDRIRCGAETTVYVIVRCKLDDRVATEAEFSPEDSPSVRMEAKVENEYTISVKAPNLSSGNVSLKIYSGDLVVCETVISYYTDMEEIGNLLSNAANPVEFMCQAFKIVPYNTETLDKLLTESLKNNIPASGLHLFGINQLEEEDMMTNQRDEELPTLLHFAAKYGLKNLTALLLTCPGALQAYSVANKHGHYPNTIAEKHGFRDLRQFIDEYVETVDMLKSHIKEELMHGEEADAVYESMAHLSTDLLMKCSLNPGCDEDLYESMAAFVPAATEDLYVEMLQASTSNPIPGDGFSRATKDSMIRKFLEGNSMGMTNLERDQCHLGQEEDVYHTVDDDEAFSVDLASRPPVPVPRPETTAPGAHQLPDNEPYIFKVFAEKSQERPGNFYVSSESIRKGPPVRPWRDRPQSSIYDPFAGMKTPGQRQLITLQEQVKLGIVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSPSNRSSTRSLLSVSSGMEGDNEDNEVPEVTRSRSPGPPQVDGTPTMSLERPPRVPPRAASQRPPTRETFHPPPPVPPRGR

SEQ ID NO: 3284 - protein, 258 aa, Homo sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEMLWHGGPWKCHRHL

SEQ ID NO: 3285 - protein, 295 aa, Homo sapiens
MDLANHGLILLQQLNAQREFGFLCDCTVAIGDVYFKAHKSVLASFSNYFKMLFVHQTSECVRLKPTDIQPDIFSYLLHLMYTGKMAPQLIDPVRLEQGIKFLHAYPLIQEASLASQGAFSHPDQVFPLASSLYGIQIADHQLRQATKIASAPEKLGRDPRPQTSRISQEQVPEASQLSQLTSNLAQVNRTNMTPSDPLQTSLSPELVSTPVPPPPPGEETNLEASSSDEQPASLTIAHVKPSITKRNGSFPKYYACHLCGRRFTLRSSLREHLQIHTGVPFTSSQQGESRVPLTL

SEQ ID NO: 3286 - protein, 218 aa, Homo sapiens [sequence omitted]

SEQ ID NO: 3287 - protein, 182 aa, Homo sapiens
MERGVVGGSLEGVEGPSGGVLSSHITSLYSQDNMWRCPRQVSTVVCVHEPRCQPPDCHGHGTCVDGHCQCTGHFWRGPGCDELDCGPSNCSQHGLCTETGCRCDAGWTGSNCSEECPLGWHGPGCQRPCKCEHHCPCDPKTGNCSVSRGTYPSKGRGMGRRSCSGPFSLSLVCYSKAVSPAT

SEQ ID NO: 3288 - protein, 105 aa, Homo sapiens
MASLTGSRLCSVTSSEGPSLPPEAACVSGSPSPQNASFRGMLLCPCSMIPHLLFLVTALSCWGPKLLPPKSPLYLLGTFLRVRTPSASLAWDSSWTQSHGPQPAK

SEQ ID NO: 3289 - protein, 474 aa, Homo sapiens [sequence omitted]

SEQ ID NO: 3290 - protein, 167 aa, Homo sapiens [sequence omitted]

SEQ ID NO: 3291 - protein, 406 aa, Homo sapiens
MLSSAGGAPEGKDDKKDTDVGGGGKGTGGASAEGGPTGLAHGRISCGGGINVDVNQHPDGGPGGKALGSDCGGSSGSSSGSGPSAPTSSSVLGSGLVAPVSPYKPGQTVFPLPPAGMTYPGSLAGAYAGYPPQFLPHGVALDPTKPGSLVGAQLAAAAAGSLGCSKPAGSSPLAGASPPSVMTASLCRDPYCLSYHCASHLAGAAAASASCAHDPAAAAAALKSGYPLVYPTHPLHGVHSSLTAAAAAGATPPSLAGHPLYPYGFMLPNDPLPHICNWVSANGPCDKRFATSEELLSHLRTHTAFPGTDKLLSGYPSSSSLASAAAAAMACHMHIPTSGAPGSPGTLALRSPHHALGLSSRYHPYSKSPLPTPGAPVPVPAATGPYYSPYALYGQRLTTASALGYQ

SEQ ID NO: 3292 - protein, 287 aa, Homo sapiens
MKMTLIGGSTTSAASSPPTTIPMTLTRMRPTSLTPMGWMKGQPTPTALHPLQIPATAPRKVFSKLRHLERLYLDHNNLTRMPGPLPRSLRELHLDHNQISRVPNNALEGLENLTALYLQHNEIQEVGSSMRGLRSLILLDLSYNHLRKVPDGLPSALEQLYMEHNNVYTVPDSYFRGAPKLLYVRLSHNSLTNNGLASNTFNSSSLLELDLSYNQLQKIPPVNTNLENLYLQGNRINEFSISSFCTVVDVVNFSKLQVLRLDGNEIKRSAMPADAPLCLRLASLIEI

SEQ ID NO: 3293 - protein, 107 aa, Homo sapiens
MERGVGGSFKCTITNRSPSWKNSQMLRKIFPVAKRFSSLVFVKMSFRSLSSLTLTDVGPLAKGLPTYLIEFISGRNSSMPSEDELQVTAFLLPLNSECFSSVWLSMY

SEQ ID NO: 3294 - protein, 238 aa, Homo sapiens
MCRLQDQGLILYHQHQHSCCESPTRLAQQSHMDAFERSFCIFRLPQPPGAAVGGSTRPCPSWKAVRVDLVVAPVSQFPFALLGWTGSKLFQRELRRFSRKEKGLWLNSHGLFDPEQGSSSGKTPRSRKSCFCCRRHFSKRLQRKTSSDTWALSTFLQSRETPEPACVPHFHSGNWAAPNLATECLQADMLPPDPHLHPSPPRPGSSGGQLCLQDQLSPCWCAAGCDEVGALSASLITV

SEQ ID NO: 3295 - protein, 678 aa, Homo sapiens [sequence omitted]

SEQ ID NO: 3296 - protein, 791 aa, Homo sapiens [sequence omitted]

SEQ ID NO: 3297 - protein, 103 aa, Homo sapiens
MAASQQQASAASSAAGVSGPSSAGGPGPQQQPQPPAQLVGPAQSGLLQQQQQDFDPVQRYKMLIPQLKESLQTLMKVAAQNLIQNTNIDNVGAHSRQARRSAA

SEQ ID NO: 3298 - protein, 379 aa, Homo sapiens
MANDVDKELMKQILCLVNVSHNGVSESELMELYPEMSWTFLTSLIHSLYKMCLLTYGCGLLRFQHLQAWETVRLEYLEGPTVTSSYRQKLINYFTLQLSQDRVTWRSADELPWLFQQQGSKQKLHDCLLNLFVSQNLYKRGHFAELLSYWQFVGKDKSAMATEYFDSLKQYEKNCEGEDNMSCLADLYETLGRFLKDLGLLSQAIVPLQRSLEIRETALDPDHPRVAQSLHQLASVYVQWKKFGNAEQLYKQALEISENAYGADHPYTARELEALATLYQKQNKYEQAEHFRKKSFKIHQKAIKKKGNLYGFALLRRRALQLEELTLGKDTPDNARTLNELGVLYYLQNNLEGNLTKLYLCMNWLLKFDRNLLAQSTLV

SEQ ID NO: 3299 - protein, 444 aa, Homo sapiens [sequence omitted]

SEQ ID NO: 3300 - protein, 120 aa, Homo sapiens
MVPWTPRPTRSLRGVPTQGFSLHCAALLSPEFPVCQNPTWSPRPRANATSSMKPATSFAHPWALTLFSQRTGTGTVCPCSSNSGTKRTLAEARPRRAEGCRFQVQVRFEFHSQLPSFSGL

SEQ ID NO: 3301 - protein, 116 aa, Homo sapiens [sequence omitted]

SEQ ID NO: 3302 - protein, 142 aa, Homo sapiens [sequence omitted]

SEQ ID NO: 3303 - protein, 166 aa, Homo sapiens [sequence omitted]

SEQ ID NO: 3304 - protein, 150 aa, Homo sapiens
MIHHSVSDYKATLRCWALGFYPVEITLTWQQDGEDQTQDMELVETRPAGDGNFQKWAAVVVPSGEEQRYMCHVQHEGLPKPLTLRWKQSSQPTIPIVGIVAGLVLLGAVVTGAVVSAVMCRKNSDRVSYSEAASSNHAQGSDVSLTACKV

SEQ ID NO: 3305 - protein, 269 aa, Homo sapiens
MVSHGSSPSLLEALSSDFLACKICLEQLRAPKTLPCLHTYCQDCLAQLADGGRVRCPECRETVPVPPEGVASFKTNFFVNGLLDLVKARACGDLRAGKPACALCPLVGGTSTGGPATARCLDCADDLCQACADGHRCTRQTHTHRVVDLVGYRAGWYDEEARERQAAQCPQHPGEALRFLCQPCSQLLCRECRLDPHLDHPCLPLAEAVRARRPGLEGLLAGVDNNLVEPEAARRVEKEALARLREQAARVGTQVEEACLLRTESCKAE

SEQ ID NO: 3306 - protein, 253 aa, Homo sapiens
MNACSQASDFSAQSVAISLVMDLVGLTQSVAMVTGENINSVEPAQPLSPNQGRVAVVIRPPLTQGNLRYIAEKTEFFKHVALTLWDQLGDGTPQHHQKSVELFYQLHNLVPSSSICEDVISQQLTHKDKKIRMEAHAKFAVLWHLTRDLHINKSSSFVRSFDRSLFIMLDSLNSLDGSTSSVRQAWLNQVLQRHDIARVLEPLLLLLLHPKTQRVSVQRVQAERYWNKSPCYPGEESDKHFMQIFGFGSRIAL

SEQ ID NO: 3307 - protein, 358 aa, Homo sapiens
MGSAYAIITALLTKFTKLCEFPMLETGLFFLLSWSAFLSAEAAGLTGIVAVLFCGVTQAHYTYNNLSSDSKIRTKQLFEFMNFLAENVIFCYMGLALFTFQNHIFNALFILGAFLAIFVARACNIYPLSFLLNLGRKQKIPWNFQHMMMFSGLRGAIAFALAIRNTESQPKQMMFTTTLLLVFFTVWVFGGGTTPMLTWLQIRVGVDLDENLKEDPSSQHQEANNLDKNMTKAESARLFRMWYSFDHKYLKPILTHSGPPLTTTLPEWCGPISRLLTSPQAYGEQLKEDDVECIVNQDELAINYQEQASSPCSPPARLGLDQKASPQTPGKENIYEGDLGLGGYELKLEQTLGQSQLN

SEQ ID NO: 3308 - protein, 357 aa, Homo sapiens
MQLRNVSEQELDSVAMKLLHQVSKLCGKCSPTDVDILQPSFNFLYWSLHQTTPSSQKRAAAVLLSSTGLMELLEKMLALTLAKADSPRTALLCSAWLLTASFSAQQHKGSLQVHQTLSVEMDQVLKALSFPKKKAALLSAAILCFLRTALRQSFSSALVALVPSGAQPLPATKDTVLAPLRMSQVRSLVIGLQNLLVQKDPLLSQACVGCLEALLDYLDARSPDIALHVASQPWNRFLLFTLLDAGENSFLRPEILRLMTLFMRYRSSSVLSHEEVGDVLQGVALADLSTLSNTTLQALHGFFQQLQSMGHLADHSMAQTLQASLEGLPPSTSSGQPPLQDMLCLGGVAVSLSHIRN

SEQ ID NO: 3309 - protein, 109 aa, Homo sapiens
MCKSSSLKCGQRSAPCRPQPSLVSPLPGLCIPRLPFLPLPFSVTPHTTVLRLKGLSWFICKMFLAFTCASWASDCVEAFRVHCYTGPSPCYCPHATVLASLGRRHWIWD

SEQ ID NO: 3310 - protein, 144 aa, Homo sapiens
MLNRIIWLQAVLEIITNKTTQALTVLAWQETLMRNAIYQNRLALDYLLAAEGGVCEKFDLTNYCLHIDDQGQVVEDIVKDITKLAHAPVQVWHGLNLGAMFGNWFPAIGGFKTLIIRVIIVIGTCLLLPCLIPVILQMIKNFVA

SEQ ID NO: 3311 - protein, 154 aa, Homo sapiens
MNVLLSLLQMTQLVLPGMVERSKGAILNISSGSGMLPVPLLTIYSATKTFVDFFSQCLHEEYRSKGVFVQSVLPYFVATKLAKIRKPTLDKPSPETFVKSAIKTAGLQSRTNGYLIHALMGLIISNLPSWIYLKIVMNMNKSTRAHYLKKTKKN

SEQ ID NO: 3312 - protein, 117 aa, Homo sapiens [sequence omitted]

SEQ ID NO: 3313 - protein, 381 aa, Homo sapiens
MMGLGNGRRSMKSPPLVLAALVACIIVLGFNYWIASSRSVDLQTRIMELEGRVRRAAAERGAVELKKNEFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSESQPRLQAAGLPHTEVPQGKGNVLGNSKSQTPAPSSEVVLDSKRQVEKEETNEIQVVNEEPQRDRLPQEPGREQVVEDRPVGGRGFGGAGELGQTPQVQAALSVSQENLEMEGPERDQLVIPDGQEEEQEAAGEGRNQQKLRGEDDYNMDENEAESETDKQAALAGNDRNIDVFNVEDQKRDTINLLDQREKRNHTL

SEQ ID NO: 3314 - protein, 146 aa, Homo sapiens
MEKENQELTLYFGGLMHTTKHYSVCWLLPSLKAHSTSFCRCQLSAQLSVPHPIFWALGFPTLAYKQTRGSTDTDPTQGKLQHRGRWPVRWGRSCSPRGIPVAECLSSLLQERFSKADSSSADSEGHLQLLRVYNVLFHQNGVLRAF

SEQ ID NO: 3315 - protein, 132 aa, Homo sapiens [sequence omitted]

SEQ ID NO: 3316 - protein, 146 aa, Homo sapiens
MSPALHTRLCSKTLRMCRSHRHIRFRRRQRGYLAWCGGRAGAVPAEGPAVCAGHARGHGGRPAAAAPRKAAPAGSMRHPAPGPDCPRHQHQGQKQYNIHVGTAGSKDKRPKISGLRMEHSHEPAHDKTHPCFSGSRLYVKASCRGC

SEQ ID NO: 3317 - protein, 428 aa, Homo sapiens
MKLVEEAVQLQYQNACVQQGNCTKPFMFDISRIFTCCLPGLPETSSCVCPGYITVVSVSNNPVIKELQNQPVRIVLIEGDLTENYRHLGFNKSANIKTVLDSMRLQEDSSEELWANHVLQVLIQFKVNLVLVQGNVSERLIEKCINSKRLVIGSVNGSVMQAFAEAAGAVQVAYITQVNEDCVGDGVCVTFWRSSPLDVVDRNNRIAILLKTEGINLVTAVLTNPVTAQMQIKEDRFWTCAYRLYYALKEEKVFLGGGAVEFLCLSCLHILAEQSLKKENHACSGWLHNTSSWLASSLAIYRPTVLKFLANGWQRYLSTLLYNTANYSSEFEASTYIQHHLQNATDSGSPSSYILNEYSKLNSRIFNSDISNKLEQIPRVYDVVTPKIEAWRRALDLVLLVLQTDSEIITGHGHTQINSQELTGFLFL

SEQ ID NO: 3318 - protein, 524 aa, Homo sapiens
MAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSQLTPGTPPPSALHACTTGEEILAQYLQQQQPGVMSSSHLLLTPCRVAPPYPHLSSSCSPPAVESIPVFGALCSSSSLHQTLEALARDLTKLDLRRWASFMDAGVEHDDVAELLQELQSLAQCYQGGDSLVD

SEQ ID NO: 3319 - protein, 340 aa, Homo sapiens [sequence omitted]

SEQ ID NO: 3320 - protein, 325 aa, Homo sapiens
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYRLGLGHNQIRMIENGSLSFLPTLRELHLDNNKLARVPSGLPDLKLLQVVYLHSNNITKVGVNDFCPMGFGVKRAYYNGISLFNNPVPYWEVQPATFRCVTDRLAIQFGNYKK

SEQ ID NO: 3321 - protein, 161 aa, Homo sapiens
MSLPSILSGQCHKLMIYIERLHLIENNILRTTLLFYFSNNVLNILINTFSNIVVLISALSVLERMLFITGWFLDCPSGVKLGHSNHMLAGNHNNVKSRHWVFNCNYIDIILYIKQSVTGSSIVHVRKMFASYNTWKQSYIFNVSHYCDTPKKAGDGEKEEL

SEQ ID NO: 3322 - protein, 117 aa, Homo sapiens [sequence omitted]

SEQ ID NO: 3323 - protein, 245 aa, Homo sapiens
MGRWETPPWILPGLPYSAWGFPLILPSKPQSLRSSSAPPASGGLSPVKCKGTAEPTGLAVKAGGPEPARATAMAPRGPERGRAGRGPGQNDLAGEERKKGGEEMHRTAGLHREGKMMKEEEEGGGPGAAPYSSRPRVPGPAGADGLGPFPGLGWRGVGGSPSTLLGDRERGYRERGGAVSRLNPETPTPSSPLPQEGGRQLWVKPEGGMPEGKGKPGADPLPAPDPTLHLPVTASLTGNGGELLN

SEQ ID NO: 3324 - protein, 602 aa, Homo sapiens
MRGGRARPAWESFMGLPPRSSAKWGAGQSLDRLCCAPGSRGLAGAPGRMRAPPAGRSQPAGGPGDSLPHPPGGLGPGGSAWARRAEAAASRARGGGRGGPGITWAEAGPGAPGGLSPESGRRQRERWRLLAFPPSRAWAPSRTGERQPGERAHLRLSARPALPGAGLLSAPLSARNPGLVRGPAPWSLASAGAPPRAALSPAGALLLQPPARRVLCPRSEGGSRTGRAGPSGWAPPRGARSAESTDRLKGMALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERGGTPAFLPSSLSPQSSLPASRALATPPKLHTCEKCSTSIANQAVRIQEGRYRHPGCYTCADCGLNLKMRGHFWVGDELYCEKHARQRYSAPATLSSRA

SEQ ID NO: 3325 - protein, 110 aa, Homo sapiens [sequence omitted]

SEQ ID NO: 3326 - protein, 110 aa, Homo sapiens
MSYLLSTADINVTQKSFNFAKKFSLPLYFVSAADGTNVVKVWLTAEVASKLFNDAIRLAVSYKQNSQDFMDEIFQELENFSLEQEEEDVPDQEQSSSIETPSEEVASPHS

SEQ ID NO: 3327 - protein, 181 aa, Homo sapiens [sequence omitted]

SEQ ID NO: 3328 - protein, 138 aa, Homo sapiens
MHSSPLSLCQWVWSQPCNQPLSLPSPILWPMECPIQPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 3329 - protein, 489 aa, Homo sapiens
MDWTWRVFCLLAVAPGAHSQVQLVQSGAEVRKPGASVRVSCKAFGFTFNTYQIHWVRQAPGQGLEWMGVVSPGGGSATYAQRFQGRVTITRDTSTSTVYMDLDSLRSDDSAVYYCARVVSELSFSGGGLTLLDRIKVPNNHYSYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3330 - protein, 354 aa, Homo sapiens
MANKGNKKRRQFSLEEKMKVVGAVDSGKRKGDVAKEFGITPSTLSTFLKDRTKFEEKVREASVGPQRKRMRSALYDDIDKAVFAWFQEIHAKNILVTGSVIRKKALNLANMLGYDNFQASVGWLNRFRDRHGIALKAVCREDSDRLMNGLGIDKINEWHAGEIIKLIADYSPDDIFNADETGVFFQLLPQHTLAAKGDHCRGGKKAKQRLTALFCCNASGTEKMRPLIVGRSASPHCLKNIHSLPCDYRANQWAWMTRDLFNEWLMQVDARMKRAERRILLLIDNCSAHNMLPHLERIQVGYLPSNCTAVLQPLNLGIIHTMKVLYRSHLLKQILLKLNSSEDQKRWTSSRPST

SEQ ID NO: 3331 - protein, 155 aa, Homo sapiens [sequence omitted]

SEQ ID NO: 3332 - protein, 177 aa, Homo sapiens [sequence omitted]

SEQ ID NO: 3333 - protein, 117 aa, Homo sapiens [sequence omitted]

SEQ ID NO: 3334 - protein, 137 aa, Homo sapiens [sequence omitted]

SEQ ID NO: 3335 - protein, 798 aa, Homo sapiens
MKRQKIQRELMKLEQENMEKREEIIIKKEVSPEVVRSKLSPSPSLRKSSKSPKRKSSPKSSSASKKDRKTSAVSSPLLDQQRNSKTNQSKKKGPRTPSPPPPIPEDIALGKKYKEKYKVKDRIEEKTRDGKDRGRDFERQREKRDKPRSTSPAGQHHSPISSRHHSSSSQSGSSIQRHSPSPRRKRTPSPSYQRTLTPPLRRSASPYPSHSLSSPQRKQSPPRHRSPMREKGRHDHERTSQSHDRRHERREDTRGKRDREKDSREEREYEQDQSSSRDHRDDREPRDGRDRRDARDTRDRRELRDSRDMRDSREMRDYSRDTKESRDPRDSRSTRDAHDYRDREGRDTHRKEDTYPEESRSYGRNHLREESSRTEIRNESRNESRSEIRNDRMGRSRGRVPELPEKGSRGSRGSQIDSHSSNSNYHDSWETRSSYPERDRYPERDNRDQARDSSFERRHGERDRRDNRERDQRPSSPIRHRGRNDELERDERREERRVDRVDDRRDERARERDRERERDRERERERERERDREREKERELERERAREREREREKERDRERDRDRDHDRERERERERDREKEREREREERERERERERERERERERERERARERDKERERQRDWEDKDKGRDDRREKREEIREDRNPRDGHDERKSKKRYRNEGSPSPRQSPKRRREHSPDSDAYNSGDDKNEKHRLLSQVVRPQESRSLSPSHLTEDRQGRWKEEDRKPERKESSRRYEEQELKEKVSSVDKQREQTEILESSRMRAQDIIGHHQSEDRETSDRAHDENKKKAKIQKK

SEQ ID NO: 3336 - protein, 163 aa, Homo sapiens
MRRTGSHAQCTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 3337 - protein, 608 aa, Homo sapiens
MDNSYAFNQRSTCNGIPSEKKNSFLVSEDHGQKILSVLQNFREQNVFYDFKIIMKDEIIPCHRCVLAACSDFFRAMFEVNMKERDDGSVTITNLSSKAVKAFLDYAYTGKTKITDDNVEMFFQLSSFLQVSFLSKACSDFLIKSINLVNCLQLLSISDSYGSTSLFDHALHFVQHHFSLLFKSSDFLEMNFGVLQKCLESDELNVPEEEMVLKVVLSWTKHNLESRQKYLPHLIEKVRLHQLSEETLQDCLFNEESLLKSTNCFDIIMDAIKCVQGSGGLFPDARPSTTEKYIFIHKTEENGENQYTFCYNIKSDSWKILPQSHLIDLPGSSLSSYGEKIFLTGGCKGKCCRTVRLHIAESYHDATDQTWCYCPVKNDFFLVSTMKTPRTMHTSVMALDRLFVIGGKTRGSRDIKSLLDVESYNPLSKEWISVSPLPRGIYYPEASTCQNVIYVLGSEVEITDAFNPSLDCFFKYNATTDQWSELVAEFGQFFHATLIKAVPVNCTLYICDLSTYKVYSFCPDTCVWKGEGSFECAGFNAGAIGIEDKIYILGGDYAPDEITDEVQVYHSNRSEWEEVSPMPRALTEFYCQVIQFNKYRDPWFSNLCA

SEQ ID NO: 3338 - protein, 152 aa, Homo sapiens
MRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 3339 - protein, 114 aa, Homo sapiens [sequence omitted]

SEQ ID NO: 3340 - protein, 787 aa, Homo sapiens
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSHDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKEKVKLDAEREKLERLQELYSEQKTQLDNCPESMREQLQQQLKRDADLLDVESKHFEDLEFQQLEHESRLDEEKENLTQQLLREVAEYQRNIVSRKEKISALKKQANHIVQQAQREQDHFV

SEQ ID NO: 3341 - protein, 142 aa, Homo sapiens; identical to SEQ ID NO: 2330

SEQ ID NO: 3342 - protein, 353 aa, Homo sapiens
MTQGPAAWNVPPGVYAVVDLYGQAAQATIVDDVEVAPVPEPLPEGNNQVSPSSPSSGAGGSDLRFHQLHGSNAVITNGGRTALRHNCRSEFNDAIVISNRALRDGELFEIVIQKMVDRWSGSIEAGVTAIRPEDLEFPNTMTDIDYDTWMLSGTAIMQDGNTMRNNYGCDLDALGTGARIGMMRTAKGDLHYFINGQDQGAACSGLPPGKEVYAVVDLYGQCVQVSITNATGPMDNSLATSNTATEKSFPLHSPVAGVAHRFHSTCGKNVTLEEDGTRAVRAAGYAHGLVFSTKELRAEEVFEVKVEELDEKWAGSLRLGLTIRLYLQHHTPHPIVGEGIPCVSQANKIYLPL

SEQ ID NO: 3343 - protein, 224 aa, Homo sapiens
MPLTPEPPSGRVEGPPAWEAAPWPSLPCGPCIPIMLVLATLAALFILTTAVLAERLFRRALRPDPSHRAPTLVWRPGGELWIEPMGTARERSEDWYGSAVPLLTDRAPEPPTQVGTLEARATAPPAPSAPNSAPSNLGPQTVLEVPARSTFWGPQPWEGRPPATGLVSWAEPEQRPEASVQFGSPQARRQRPGSPDPEWGLQPRVTLEQISAFWEREGRTSVGF

SEQ ID NO: 3344 - protein, 428 aa, Homo sapiens
MNRQGNRKTTKEGSNDLKFQNFSLPKNRSWPRINSATGQYQRMNKPLLDWERNFAAVLDGAKGHSDDDYDDPELRMEETWQSIKILPARPIKESEYADTHYFKVAMDTPLPLDTRTSISIGQPTWNTQTRLERVDKPISKDVRSQNIKGDASVRKNKIPLPPPRPLITLPKKYQPLPPEPESSRPPLSQRHTFPEVQRMPSQISLRDLSEVLEAEKVPHNQRKPESTHLLENQNTQEIPLAISSSSFTTSNHSVQNRDHRGGMQPCSPQRCQPPASCSPHENILPYKYTSWRPPFPKRSDRKDVQHNEWYIGEYSRQAVEEAFMKENKDGSFLVRDCSTKSKEEPYVLAVFYENKVYNVKIRFLERNQQFALGTGLRGDEKFDSVEDIIEHYKNFPIILIDGKDKTGVHRKQCHLTQPLPLTRHLLPL

SEQ ID NO: 3345 - protein, 109 aa, Homo sapiens [sequence omitted]

SEQ ID NO: 3346 - protein, 111 aa, Homo sapiens
MPKHSVILGVHWKASSYPHTSSQSPDVNVEAEDHLLLVLLLFLLFLFRTATIEDLASHFPDVFSEILCWPAKPYGFILPLRSPSVRSLFLKDRVGSRRGTERTSSLALQCS

SEQ ID NO: 3347 - protein, 177 aa, Homo sapiens
MCTCSSRYALPAGHLCTRLTTASLAHCCSVSPAGPRPRLPYPSELGAACPLLLCLGLSPLRQCRTPPRLWPRLLPGLPRLPHPSCIPEPSPPTGTSALRDRTSRAQGPASPCRECAASGTHLLSPVSFLELPFIFSKVKFLSTGSSLGGGEHWATLGRGWAALRAQPGASLPVLPTL

SEQ ID NO: 3348 - protein, 153 aa, Homo sapiens [sequence omitted]

SEQ ID NO: 3349 - protein, 662 aa, Homo sapiens [sequence omitted]

SEQ ID NO: 3350 - protein, 150 aa, Homo sapiens
MRERVLGPDHPDCAQSLNNLAALCNEKKQYDKAEELYERALDIRRRALAPDHPSLAYTVKHLAILYKKMGKLDKAVPLYELAVEIRQKSFGPKHPSVATALVNLAVLYSQMKKHVEALPLYERALKIYEDSLGRMHPRVGETLKNLAVLR

SEQ ID NO: 3351 - protein, 179 aa, Homo sapiens
MELQGAQEDLGISLSSPRRNHETRPGSKAKGRSSICLQASVWMAGGKLRLRASEHLTQGHQQELRDWNLGEDASLLFSKSPFGAGKLIQAPAHVFRQCWVQGNAWISCITKFDSKRSPEVASSPSYLTVPRRSPLPVFLRPSDRCVCGGCYLGKSTRRRACQSLLSDPLGVTFPTQTRP

SEQ ID NO: 3352 - protein, 165 aa, Homo sapiens
MPPYHRRVGMVQELLRMVRQGRREEAGTLLQHLRQDLGMESTSLDDVLYRYASFRNLVDPITHDLIISLARYIHCPKPPQGCPGRKPPRQHSGPVGNPTDLPRPGAGDQLPTALWGAGRQRGAGLHRPHGRHGPAAAASTQHPAPPHHTGTQWQPVDPGRAARPH

SEQ ID NO: 3353 - protein, 274 aa, Homo sapiens
MAEFTSYKETASSRHLRFKLQSLSRRLDELEEATKNLQKAEDELLDLQDKVIQAEGSNSSMLAEIEVLRQRVLRIEGKDEEIKRAEDLCRLMKEKLEEEENLTRELKSEIERLQKRMAELEKLEEAFSRSKNDCTQLCLSLNEERNLTKKISSELEMLRVKVKELESSEDRLDKTEQSLASELEKLKSLTLSFVSERKYLNEKEKENEKLIKELTQKLEQNKKMNRDYTRNASNLERNDLRIEDGISSTLPSKESRRKGGLDYLKQVENETRNQ

SEQ ID NO: 3354 - protein, 619 aa, Homo sapiens [sequence omitted]

SEQ ID NO: 3355 - protein, 144 aa, Homo sapiens
MRRRAGSGLRPHTAGNPGASGAQLACQHPFLALHPSLQMLALPLETRWLPAAFFRVRRASFRRLEEHAFDLWVWAGCAGPPSFQFTERLTTSKDYLRAPLRAERGERVGKGGESIPLECPRVTRTDFSKNSVRRSFVPSTQCSA

SEQ ID NO: 3356 - protein, 100 aa, Homo sapiens [sequence omitted]

SEQ ID NO: 3357 - protein, 255 aa, Homo sapiens
MQVLSRPAFHPMHSVSHVSSLSPLSSTPIPQDRKRRGNLDMEKLYSENEGMASNQGKMENEEQPQDERKPEVTCTLEDKKLENEGKTENKGKTGDEEMLKDKGKPESEGEAKEGKSEREGESEMEGGSEREGKPEIEGKPESEGEPGSETRAAGKRPAEDDVPRKAKRKTNKGLAHYLKEYKEAIHDMNFSNEDMIREFDNMAKVQDEKRKSKQKLGAFLWMQRNLQDPFYPRGPREFRGGCRAPRRDIEDIPYV

SEQ ID NO: 3358 - protein, 344 aa, Homo sapiens
MWPLWRLVSLLALSQALPFEQRGFWDFTLDDGPFMMNDEEASGADTSGVLDPDSVTPTYSAKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYRLGLGHNQIRMIENGSLSFLPTLRELHLDNNKLARVPSGLPDLKLLQVVYLHSNNITKVGVNDFCPMGFGVKRAYYNGISLFNNPVPYWEVQPATFRCVTDRLAIQFGNYKK

SEQ ID NO: 3359 - protein, 103 aa, Homo sapiens
MESCVEILCPDSDSPLPSAMSCCPLASPLTEQGPASQNTPPLPRSPGMARAVFLKWREKSKQPDGFSLSPPPGLVYLFPRVFKLSTTARGLGVLFPTGRIPCK

SEQ ID NO: 3360 - protein, 101 aa, Homo sapiens
MNYLLIQKVSEESAFFLTVFLSLFLLFSFSFFVTASLTLISQAGVQWHDHSSLQPGPLGLKRFPHLSLSSCWDHSPVPPGLANFLFFICRDRVSLCCPGWL

SEQ ID NO: 3361 - protein, 286 aa, Homo sapiens
MVVPPDKVNPEHYIFSPFGILHVHPVEGSETMTLGTWHHHCVLWQQLQFIPFFKYCLLRKSFTCWKKNVRLQGLHRLQKFLENHLLLAVPHFGAGLLHISRLLQELHSVSWLPQELDRCYELLDLQTALAEEKHKALRLLHRCLNLCTSILRLVHEDTYHMQQCLQERVQNCDRIRTGQGSIYLQRVQHKQLEQKLKQAEAWWLQLGKFARLVDYMICQSLISVLEEQITSFVANILQAPRQKPFLSSQLVFDDHGQLSHVPCVENMIQTLTGGLQSVKTSALQVF

SEQ ID NO: 3362 - protein, 151 aa, Homo sapiens [sequence omitted]

SEQ ID NO: 3363 - protein, 356 aa, Homo sapiens
MTSVTRSEIIDEKGPVMSKTHDHQLESSLSPVEVFAKTSASLEMNQGVSEERIHLGSSPKKGGNCDLSHQERLQSKSLHLSPQEQSASYQDRRQSWRRASMKETNRRKSLHPIHQGITELSRSISVDLAESKRLGCLLLSSSQFSIQKLEPFLRDTKGFSLESFRAKASSLSEELKHFADGLETDGTLQKCFEDSNGKASDFSLEASVAEMKEYITKFSLERQTWDQLLLHYQQEAKEILSRGSTEAKITEVKVEPMTYLGSSQNEVLNTKPDYQKILQNQSKVFDCMELVMDELQGSVKQLQAFMDESTQCFQKVSVQLGKRSMQQLDPSPARKLLKLQLQNPPAIHGSGSGSCQ

SEQ ID NO: 3364 - protein, 652 aa, Homo sapiens
MGNLQSEPSAGGGSRKVQPSDRAPDSRRTSLVEPEMTSQAMRLTRGLGVWFPGSATPPGLMVPREPQASPSTLPLTLERPSPVMPPPEEAAAVSAPPPAPAGTLLPGPSKWQKPAGTPVPRIRRLLEASHRGQGDPPSLRPLKPPPPPRQLSVKDTVPRAPSQFPPPLETWKPPPPLPSERQPADRRITPALATPASPPTESQAGPRNQGQTAGRARGGAPPHAGEGEMAQPADSESGLSLLCKITFKSRPSLAPPAASSSLAAKASLGGGGGGGLFAASGAISYAEVLKQGPLPPGAARPLGEVSRGAQEAEGGDGDGEGCSGPPSAPASQARALPPPPYTTFPGSKPKFDWVSAPDGPERHFRFNGAGGGIGAPRRRAAALSGPWGSPPPPPEQIHSAPGPRRPAPALLAPPTFIFPAPTNGEPMRPGPPGLQELPPLPPPTPPPTLQPPALQPTPLPVAPPLTPGLGHKESALAPTAAPALPPALAADQAPAPSPAPAPTVAEPSPPVSAPAPAAAPIKTRTRRNKGSRAARGATRKDGLHGDGPRERATATVPDSSGGGGGGSGASQTGAANTRAARHWLPFQVLNSCPCKCYCHHQPRHRRLPRNVSAWLSTSTNHLGEPPWVATIKLSGSLVAKLEHYDLQATHSN

SEQ ID NO: 3365 - protein, 128 aa, Homo sapiens
MQSLPTAPESNRCVKCIAGLQVARHVCRNEHTLPTAAGHPVGRQAPKAGCALWGAKAAKSAARKANTGPAPSTGKRASWPSGSPRSRPSKNRHPNRGHQTPKNMSNCEWESAETTNRWTLQMEELSDT

SEQ ID NO: 3366 - protein, 592 aa, Homo sapiens
MDVMLENYCHLISVGCHMTKPDVILKLERGEEPWTSFAGHTCLEENWRAEDFLVKFKEHQEKYSRSVVSINHKKLVKEKSKIYEKTFTLGKNPVNSKNLPPEYDTHGRILKNVSELIISNLNPARKRLSEYNGYGKSLLSTKQETTHPEVKSHNQSARAFSHNEVLMQYQKTETPAQSFGYNDCEKSFLQRGGLITHSRPYKGENPSVYNKKRRATNIEKKHTCNECGKSFCRKSVLILHQGIHSEEKPYQCHQCGNAFRRKSYLIDHQRTHTGEKPFVCNECGKSFRLKTALTDHQRTHTGEKSYECLQCRNAFRLKSHLIRHQRTHTGEKPYECNDCGKSFRQKTTLSLHQRIHTGEKPYICKECGKSFHQKANLTVHQRTHTGEKPYICNECGKSFSQKTTLALHEKTHNEEKPYICSECGKSFRQKTTLVAHQRTHTGEKSYECPHCGKAFRMKSYLIDHHRTHTGEKPYECNECGKSFSQKTNLNLHQRIHTGEKPYVCNECGKSFRQKATLTVYQKIHTGQKSYECPQCGKAFSRKSYLIHHQRTHTGEKPYKCSECGKCFRQKTNLIVHQRTHTGGEDGLTGCLS

SEQ ID NO: 3367 - protein, 809 aa, Homo sapiens
MEVLREKVEEEEEAEREEAAEWAEWARMEKMMRPVEVRKEEITLKQETLRDLEKKLSEIQITVSAELPAFTKDTIDISKLPISYKTNTPKEEHLLQVADNFSRQYSHLCPDRVPLFLHPLNECEVPKFVSTTLRPTLMPYPELYNWDSCAQFVSDFLTMVPLPDPLKPTIKKEEKVLPKKYTIKPPRDLCSRFEQEQEVKKQQEIRAQEKKRLREEEERLMEAEKAKPDALHGLRVHSWVLVLSGKREVPENFFIDPFTGHSYSTQDEHFLGIESLWNHKNYWINMQDCWNCCKDLIFDLGDPVRWEYMLLGTDKSQLSLTEEDDSGINDEDDVENLGKEDEDKSFDMPHSWVEQIEISPEAFETRCPNGKKVIRYKRAKLEKWAPYLNSNGLVSRLTTYEDLQCTNILEIKEWYQNREDMLELKHINKTTDLKTDYFKPGHPQALRVHSYKSMQPEMDRVIEFYETARVDGLMKREETPRTMTEYYQGRPDFLSYRHASFGPRVKKLTLSSAESNPRPIVKITERFFRNPAKPAEEDVAERVFLVAEERIQLRYHCREDHITASKREFLRRTEVDSKGNKIIMTPDMCISFEVEPMEHTKKLLYQYEAMMHLKREEKLSRHQVWESELEVLEILKLREEEEAAHTLTISIYDTKRNEKSKEYREAMERMMHEEHLRQVETQLDYLAPFLAQLPPGEKLTCWQAVRLKDECLSDFKQRLINKANLIQARFEKETQELQKKQQWYQENQVTLTPEDEDLYLSYCSQAMFRIRILEQRLNRHKELAPLKYLALEEKLYKDPRLGELQKIFA

SEQ ID NO: 3368 - protein, 172 aa, Homo sapiens
MKNATIVMSVRREQGSSSGGGVIVIRRCGCGLHQGGVAVFGPVSEGLVQGSNVGELHQPSINRVSRHQARFALQVGARRTPRDSRRSSPQSNLSRVFIQEKDPTDGGNAGKLRRITPHCRSALPLENSSLRTTVAMKTISLQPPPLYQRRQISLEILKKPHPQSNVIIYLVL

SEQ ID NO: 3369 - protein, 555 aa, Homo sapiens
MSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEGKASALQPPASGPGSGSPLPQPWGDAQVILGSPARPPFSFQPPAEQTPRRAFCSLPISSLLSGNLLSALLPFKHLRHRHMACDYRFISLAPL

SEQ ID NO: 3370 - protein, 468 aa, Homo sapiens [sequence omitted]

SEQ ID NO: 3371 - protein, 592 aa, Homo sapiens
MRGRDLCSSTQSQALGSLRTTTPAFTLNIPSEANHTEQPPAGLGARLQEAGVSIPPRRGRPTPTLEKKKKPHLMAEDEPSGALLKPLVFRVDETTPAVVQSVLLERGWNKFDKQEQNAEDWNLYWRTSSFRMTEHNSVKPWQQLNHHPGTTKLTRKDCLAKHLKHMRRMYGTSLYQFIPLTFVMPNDYTKFVAEYFQERQMLGTKHSYWICKPAELSRGRGILIFSDFKDFIFDDMYIVQKYISNPLLIGRYKCDLRIYVCVTGFKPLTIYVYQEGLVRFATEKFDLSNLQNNYAHLTNSSINKSGASYEKIKEVIGHGCKWTLSRFFSYLRSWDVDDLLLWKKIHRMVILTILAIAPSVPFAANCFELFGFDILIDDNLKPWLLEVNYSPALTLDCSTDVLVKRKLVHDIIDLIYLNGLRNEGGEASNATHGNSNIDAAKSDRGGLDAPDCLPYDSLSFTSRMYNEDDSVVEKAVSVRPEAAPASQLEGEMSGQDFHLSTREMPQSKPKLRSRHTPHKTLMPYASLFQSHSCKTKTSPCVLSDRGKAPDPQAGNFVLVFPFNEATLGASRNGLNVKRIIQELQKLMNKQHS

SEQ ID NO: 3372 - protein, 138 aa, Homo sapiens
MDILPYLHMSHGKCPLLVRGKGEMEGEALLSCLAMNSLGEQEACLDLGSKTPSLEISSNNQERPTNREETGIICPERLFIYSSKDSSKRLPGGLCIKNKTTCVPVQLHPSSFPKCQEAIVSPQARVKLLNKIKMDTAL

SEQ ID NO: 3373 - protein, 569 aa, Homo sapiens [sequence omitted]

SEQ ID NO: 3374 - protein, 180 aa, Homo sapiens
MPSSVPKTSIESLGSPSSLSSSQASEPLCPLKHPSHRPPASTLSPNLTSSTESLGYLSSLSSSQPPEPLRPLECPSHKPCGRSLPRRRNPGWVSWSDSMQADSETDAIICPMCKTPEHSCPHTWWVPSSPQVIRGVGRCSDPNLGLSWRQEAARAWCHCTSSQYPFKHPNLPTHLPKASF

SEQ ID NO: 3375 - protein, 365 aa, Homo sapiens
MYGPQTQLEEDAITPNDKTLFPDVDWLIGNHSDELTPWIPVIAARSSYNCRFFVLPCCFFDFIGRYSRRQSKKTQYREYLDFIKEVGFTCGFHVDEDCLRIPSTKRVCLVGKSRTYPSSREASVDEKRTQYIKSRRGCPVSPPGWELSPSPRWVAAGSAGHCDGQQALDARVGCVTRAWAAEHGAGPQAEGPWLPGFHPREKAERVRNCAALPRDFIDQVVLQVANLLLGGKQLNTRSSRNGSLKTWNGGESLSLAEVANELDTETLRRLKRECGGLQTLLRNSHQVFQVVNGRVHIRDWREETLWKTKQPEAKQRLLSEACKTRLCWFFMHHPDGCALSTDCCPFAHGPAELRPPRTTPRKKIS

SEQ ID NO: 3376 - protein, 134 aa, Homo sapiens
MEPGNRSLNPHKTKHHMECRVTGRAEVTASREGRGACAWECGSSRGPWGLLRYTFAPVRASRPWACLPKGSLSQRPKCPLPFTYHPSPHALRGLGEEGLKEGGFHVHIYHPFHIAPRPFVHFYRGAPPNSSLPG

SEQ ID NO: 3377 - protein, 665 aa, Homo sapiens
MASASQGADDDGSRRKPRLAASLQISPQPRPWRPLPAQAQSAWEPAPAPATYRAEGGWPQVSVLRDSGPGAGAGVGELGAARAWENLGEQMGKAPRVPVPPAGLSLPLKDPPASQAVSLLTEYAASLGIFLLFREDQPPGKVFKYRAPGGEELKAMCLWQVEVLRAFLLRTGWRGLWRGDLDLGPDSSWANRLPFLLICEMESRIPAVEELGPCFPFSVSAELDGVVCPAGTANSKTEAKQQAALSALCYIRSQLENPESPQTSSRPPLAPLSVENILTHEQRCAALVSAGFDLLLDERSPYWACKGTVAGVILERGWAVSAPSCTEIPRARGHVKEIYKLVALGTGSSCCAGWLEFSGQQLHDCHGLVIARRALLRFLFRQLLLATQGGPKGKEQSVLAPQPGPGPPFTLKPRVFLHLYISNTPKGAARDIYLPPTSEGGLPHSPPMRLQAHVLGQLKPVCYVAPSLCDTHVGCLSASDKLARWAVLGLGGALLAHLVSPLYSTSLILADSCHDPPTLSRAIHTRPCLDSVLGPCLPPPYVRTALHLFAGPPVAPSEPTPDTCRGLSLNWSLGDPGIEVVDVATGRVKANAALGPPSRLCKASFLRAFHQAARAVGKPYLLALKTYEAAKAGPYQEARRQLSLLLDQQGLGAWPSKPLVGKFRN

SEQ ID NO: 3378 - protein, 623 aa, Homo sapiens
MAGFSHFSQPPYRDLWEPPRPGGERESTQRLGGQRSGADSTACSRAGTPGAESEAGACWLHPHCSFTPRPRRRGCSDSLRGSRSLSDVARRPLERSRKHRPRSRRLEDAWGETGTKPRPAWQPQTQLPPQRPQPCPHYPLAQGDSPPPCPGGAGTPLSGTFRVEKAQGGDQWAVPLGRHLGRWSPSSVPSERSSVPSQKFKRHSACVCAQKRDSSDQVESLASRDSQPLASSKEMRSPHTQVLKSKLEEVVVSSQDQQIVALVLTRLKKAQRIRELQQQAAKAWEELKRSDQKVQMTLERERRLLLRQSQEQWQEKEQRKTLQSPEQRGLRRDSQRKNVPPGESRWKEQPEDQESPRQEKLEKARAQAEHRKQCQVRRLREQEKMLRNLREQHSLQLQRRLVEACRKRHLHAVEGQKKVQDTNLSSLINYQARKVLMDCQAKAEELLRQLSLEQSFQRSQEIHQGLRKERQRELREKAQKEEEQLQQARWRAGESEEQRKMRKRILVELADEKIRQARSHVHKTTRDKVQHLRELNHLREKNHHILKLKAEKEEKCHIEGIKEAIKKKEQRVQHISQGKDPNFQEFQKLPQASRREERAPPNSSLDQMVLEAQLRACQQNRGY

SEQ ID NO: 3379 - protein, 274 aa, Homo sapiens
MPKYCRAPNCSNTAGRLGADNRPVSFYKFPLKDGPRLQAWLQHMGCEHWVPSCHQHLCSEHFTPSCFQWRWGVRYLRPDAVPSIFSRGPPAKSQRRTRSTQKPVSPPPPLQKNTPLPQSPAIPVSGPVRLVVLGPTSGSPKTVATMLLTPLAPAPTPERSQPEVPAQQAQTGLGPVLGALQRRVRRLQRCQERHQAQLQALERLAQQLHGESLLARARRGLQRLTTAQTLGPEESQTFTIICGGPDIAMVLAQDPAPATVDAKPELLDTRIPSA

SEQ ID NO: 3380 - protein, 448 aa, Homo sapiens [sequence omitted]

SEQ ID NO: 3381 - protein, 484 aa, Homo sapiens [sequence omitted]

SEQ ID NO: 3382 - protein, 279 aa, Homo sapiens
MQASCTRRVGGTRPTTGAGSCCAGTCSSTSRTLPAVSPWASSSWRAALWSWWRPPRSSPSLCALRGPGRAPTCWPLRVRMPWRAGSRPCRVPASTTCGWWCASWSSSWRLYVAWPCPSPSPSPCPCPRPCPLPWPQSHPCLLPQPRSQPCPCPAGPVPSRPRRMAALSGALRPPSGLDPSPLHHRLAAGPRHPTGPWTWPPSPGCTSAMARRSGPCVASGSAAGSSPEATRAPVLGGHKLYALWDRPGPGETGGADPEGNHGQGWPPGPEWPGFGGCRL

SEQ ID NO: 3383 - protein, 110 aa, Homo sapiens [sequence omitted]

SEQ ID NO: 3384 - protein, 181 aa, Homo sapiens
MATRRLGVGETLGALNAALGPGGPVWIKETRTRHLRSRDFLAPHRALQARFDDGQVGVSRAGPCGREMGPVPWLFYTPVLPQVPEHLLHALACLQGPGVAPVLRCAPTPAGLSLQLQRSAVFERVLSAVAAYATPASPASLGQRVLLHCPALRSSPCALRLSQLRTVLVADHLARALRAHG

SEQ ID NO: 3385 - protein, 715 aa, Homo sapiens
MSSPKRSSKPSMSLAPSGSSMPTADPKPPASLKSTKSATPNRSLVPTKPATSRNSVMSPSSSKSTKSTSTKRAPSNRPSSRSRVRSKARTPSRVSTDTRTSKASKASDVRCHQRRGTHSRGRTPGRRGSRSSKRSPSRASTPGRIRTHGARPGMASRVRTPTSQQKGSRGKSYGRPRTSNRERSDSQPRNLSKKSYRPPGGSGIGRSSELAVTPSTAKCQTPTGIPSKEKSDNPSPSSSRKVKSYGQMIIPSREKSYSPTEMSSRVKSYNQASTRSRPQSHSQSRSPRRSRSGSQKRTHSRVRSHSWKRNHSRARSRTRKGILSQMGRHSQSRSHSKGKSQNQSRTPRRGRSHNWSRNPSKERSHSHSRSSSKERDHRGSSSPRKESGRSQSGSPNKQRDHSRSRSPNKARDRSRSRSPYKARDRSRSRSPNKARDCSRSRSPYKARDRSRSRSPNKARDHSRSRSPNKARDRSRSRSPSKERDHSQLGSPSKERDHRRSRSPSKERQCRQSRSSSKERDHRRSRSPSKERQRRQSRSPNKERDRSQSRSPSEEREHRQSRSPSKERDRRRWRSPSKERERRQSRSSSEERDHSRSRSPNKQSGYSRPRASSKEKAHSRSRTPSKEGNHSQSRTSSKESDPSQSTVPRSPDWKRSPTRTSSLSQNRTPSKTSSHSPSTFPSGGQTLSQDDSQADATTSKATLPGERSSSSSPKLA

SEQ ID NO: 3386 - protein, 779 aa, Homo sapiens [sequence omitted]

SEQ ID NO: 3387 - protein, 205 aa, Homo sapiens
MKTAYEEVTTELEEFKEAFAGAVKANNSMSKKLMKSDKKIAVISTKLFTEKQRMKYFLSTLPTRPEPELPCVENLNSIELNRKYIPKTAIRIPTSNPQTSNNCKNFLTEMELDRVEQIITGTKKSFAMLSTCSRLLSFVESTAPRKHRRALPIMRSLVPNRRTTVASTESRTNRPGGVRSPGLQLEGTSTLQWEQGPIAHPRHRC

SEQ ID NO: 3388 - protein, 398 aa, Homo sapiens
MDPEIQRVRAQEREQIKALNNKFASFIDKVRFLEQQNQVLETKWNLLQQLDLNNCRKDLEPIYEGYISNLQKQLEMLSGDGVRLDSELRNMQDLVEDYKKRYEVEINRRTAAENEFVVLKKDVDAAYMNKVELQAKVDSLTDEIKFFKCLCEGEITQIQSHISDTSIVLSMDNNRDLDLDSIIAEVRAQYEEIALKSKAEAETLYQTKIQELQVTAGQHGDDLKLTKAEISELNRLIQRIRSEIGNVKKQCADLETAIADAEQRGDCALKDARAKLDELEGALHQAKEELARMLREYQELVSLKLALDMEIATYRKLLESEECRMSGEYPNSVSISVISSTNAGAGGAGFSMGFGASSSYSYKTAAADVKTKGSCGSELKDPLAKTSGSSCATKKASR

SEQ ID NO: 3389 - protein, 101 aa, Homo sapiens
MPAQLHVCLSWPCSSSGQQFPAREPMLCPEPFSIQDWVWHLRNRREAQAGSAAPAPQLPVVGPYRGQGYHCILKSQAGLTPFPEGMGKRPETWLWFFSFLV

SEQ ID NO: 3390 - protein, 815 aa, Homo sapiens
MFRLGLLVCFYNDLELLDATVAQVLLYQMIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVSDLSPAQQQGILSKMVQAEDTAPGIVEIQGAFFKEVSLFDLRRQPGFNSTVLKDKELGRSQALFLYELLLKTTRRPEELLSAGQLVKGVTCSHIDAMSTDFFLAHFQDFQNNFALLSPYQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 3391 - protein, 153 aa, Homo sapiens
MNVGTAHSEVNPNTRVMNSRGIWLSYVLAIGLLHIVLLSIPFVSVPVVWTLTNLIHNMGMYIFLHTVKGTPFETPDQGKARLLTHWEQMDYGVQFTASRKFLTITPIVLYFLTSFYTKYDQIHFVLNTVSLMSVLIPKLPQLHGVRIFGINKY

SEQ ID NO: 3392 - protein, 563 aa, Homo sapiens
MAFKTSVAVEMAGAPSWTKVAEEGDKPPHVYVPVDMAVTLPRGQLAAPLTNASSQRHPPCLSQRPLAAPLTKASSQGHLPTELTKTPSLAHLDTCLSKMHSQTHLATGAVKVQSQAPLATCLTKTQSRGQPITDITTCLIPAHQAADLSSNTHSQVLLTGSKVSNHACQRLGGLSAPPWAKPEDRQTQPQPHGHVPGKTTQGGPCPAACEVQGMLVPPMAPTGHSTCNVESWGDNGATRAQPSMPGQAVPCQEDTGPADAGVVGGQSWNRAWEPARGAASWDTWRNKAVVPPRRSGEPMVSMQAAEEIRILAVITIQAGVRGYLARRRIRLWHRGAMVIQATWRGYRVRRNLAHLCGATTTIQSAWRGYSTRRDQARHWQMLHPVTWVELGSRAGVMSDRSWFQDGRARTVSDHRCFQSCQAHACSVCHSLSSRIGSPPSVVMLVGSSPRTCHTCGRTQPTRVVQGMGQGTEGPGAVSWASAYQLAALSPRQPHRQDKAATAIQSAWRGFKIRQQMRQQQMAAKIVQATWRGHHTRSCLKNTEALLGPADPSASSRHMHWPGI

SEQ ID NO: 3393 - protein, 280 aa, Homo sapiens
MTTALGSQLSSSQTVIPGSSGTISHTTVAPGSSVTGTTTGASDDQVTGSKTGTTGVALSTTVAPGSSSTEATTSTGVHRTTVVGQKTGATTRGSAKQGTRSTIEATTSFRGTGTTGSGMNTGTTGVVSGNTISPSSFNTEATSGTSERPNPGSEIGTTGIVSGTTVAPGSSNTEATTSLGNGGTTEAGSKIVTTGITTGTTIVPGSFNTKATTSTDVGVATGVGMATGITNIISGRSQPTGSKTGYTVTGSGTTALPGGFRTDSPSFPLFLICSYRGHNF

SEQ ID NO: 3394 - protein, 453 aa, Homo sapiens
MQPTYKMAEKQKALFTRSGGGTEGEQEMEEEVGETPVPNIMETAFYFEQAGVGLSSDESFRIFLAMKQLVEQQPIHTCRFWGKILGIKRSYLVAEVEFREGEEEAEEEEVEEMTEGGEVMEAHGEEEGEEDEEKAVDIVPKSVWKPPPVIPKEESRSGANKYLYFVCNEPGLPWTRLPHVTPAQIVNARKIKKFFTGYLDTPVVSYPPFPGNEANYLRAQIARISAATQVSPLGFYQFSEEEGDEEEEGGAGRDSYEENPDFEGIPVLELVDSMANWVHHTQHILPQGRCTWVNPLQKTEEEEDLGEEEEKADEGPEEVEQEVGPPLLTPLSEDAEIMHLAPWTTRLSCSLCPQYSVAVVRSNLWPGAYAYASGKKFENIYIGWGHKYSPESFNPALPAPIQQEYPSGPEIMEMSDPTVEEEQALKAAQEQALGATEEEEEGEEEEEGEETDD

SEQ ID NO: 3395 - protein, 650 aa, Homo sapiens
MVESVRLENQPCDLRVGSWIHVYPNGSLFIGSVTEKDSGVYLCVARNKMGDDLILMHVSLRLKPAKIDHKQYFRKQVLHGKDFQVDCKASGSPVPEISWSLPDGTMINNAMQADDSGHRTRRYTLFNNGTLYFNKVGVAEEGDYTCYAQNTLGKDEMKVHLTVITAAPRIRQSNKTNKRIKAGDTAVLDCEVTGDPKPKIFWLLPSNDMISFSIDRYTFHANGSLTINKVKLLDSGEYVCVARNPSGDDTKMYKLDVVSKPPLINGLYTNRTVIKATAVRHSKKHFDCRAEGTPSPEVMWIMPDNIFLTAPYYGSRITVHKNGTLEIRNVRLSDSADFICVARNEGGESVLVVQLEVLEMLRRPTFRNPFNEKIVAQLGKSTALNCSVDGNPPPEIIWILPNGTRFSNGPQSYQYLIASNGSFIISKTTREDAGKYRCAARNKVGYIEKLVILEIGQKPVILTYAPGTVKGISGESLSLHCVSDGIPKPNIKWTMPSGYVVDRPQINGKYILHDNGTLVIKEATAYDRGNYICKAQNSVGHTLITVPVMIVAYPPRITNRPPRSIVTRTGAAFQLHCVALGVPKPEITWEMPDHSLLSTASKERTHGSEQLHLQGTLVIQNPQTSDSGIYKCTAKNPLGSDYAATYIQVI

SEQ ID NO: 3396 - protein, 116 aa, Homo sapiens [sequence omitted]

SEQ ID NO: 3397 - protein, 600 aa, Homo sapiens
MAPSSKSERNSGAGSGGGGPGGAGGKRAAGRRREHVLKQLERVKISGQLSPRLFRKLPPRVCVSLKNIVDEDFLYAGHIFLGFSKCGRYVLSYTSSSGDDDFSFYIYHLYWWEFNVHSKLKLVRQVRLFQDEEIYSDLYLTVCEWPSDASKVIVFGFNTRSANGMLMNMMMMSDENHRDIYVSTVAVPPPGRCAACQDASRAHPGDPNAQCLRHGFMLHTKYQVVYPFPTFQPAFQLKKDQVVLLNTSYSLVACAVSVHSAGDRSFCQILYDHSTCPLAPASPPEPQSPELPPALPSFCPEAAPARSSGSPEPSPAIAKAKEFVADIFRRAKEAKGGVPEEARPALCPGPSGSRCRAHSEPLALCGETAPRDSPPASEAPASEPGYVNYTKLYYVLESGEGTEPEDELEDDKISLPFVVTDLRGRNLRPMRERTAVQGQYLTVEQLTLDFEYVINEVIRHDATWGHQFCSFSDYDIVILEVCPETNQVLINIGLLLLAFPSPTEEGQLRPKTYHTSLKVAWDLNTGIFETVSVGDLTEVKGQTSGSVWSSYRKSCVDMVMKWLVPESSGRYVNRMTNEALHKGCSLKVLADSERYTWIVL

SEQ ID NO: 3398 - protein, 662 aa, Homo sapiens [sequence omitted]

SEQ ID NO: 3399 - protein, 728 aa, Homo sapiens
MGAEVNQMTATSHHEEWLKVWLDYRQSWPWQGVGPASRNSGLYNITFKYDNCTTYLNPVGKHVIADAQNITISQYACHDQVAVTILWSPGALGIEFLKGFRVILEELKSEGRQCQQLILKDPKQLNSSFKRTGMESQPFLNMKFETDYFVKVVPFPSIKNESNYHPFFFRTRACDLLLQPDNLACKPFWKPRNLNISQHGSDMQVSFDHAPHNFGFRFFYLHYKLKHEGPFKRKTCKQEQTTEMTSCLLQNVSPGDYIIELVDDTNTTRKVMHYALKPVHSPWAGPIRAVAITVPLVVISAFATLFTVMCRKKQQENIYSHLDEESSESSTYTAALPRERLRPRPKVFLCYSSKDGQNHMNVVQCFAYFLQDFCGCEVALDLWEDFSLCREGQREWVIQKIHESQFIIVVCSKGMKYFVDKKNYKHKGGGRGSGKGELFLVAVSAIAEKLRQAKQSSSAALSKFIAVYFDYSCEGDVPGILDLSTKYRLMDNLPQLCSHLHSRDHGLQEPGQHTRQGSRRNYFRSKSGRSLYVAICNMHQFIDEEPDWFEKQFVPFHPPPLRYREPVLEKFDSGLVLNDVMCKPGPESDFCLKVEAAVLGATGPADSQHESQHGGLDQDGEARPALDGSAALQPLLHTVKAGSPSDMPRDSGIYDSSVPSSELSLPLMEGLSTDQTETSSLTESVSSSSGLGEEEPPALPSKLLSSGSCKADLGCRSYTDELHAVAPL

SEQ ID NO: 3400 - protein, 455 aa, Homo sapiens
MLDESFQWRKEISVNDLNESSIPRWLLEIGVIYLHGYDKEGNKLFWIRVKYHVKDQKTILDKKKLIAFWLERYAKRENGKPVTVMFDLSETGINSIDMDFVRFIINCFKVYYPKYLSKIVIFDMPWLMNAAFKIVKTWLGPEAVSLLKFTSKNEVQDYVSVEYLPPHMGGTDPFKYSYPPLVDDDFQTPLCENGPITSEDETSSKEDIESDGKETLETISNEEQTPLLKKINPTESTSKAEENEKVDSKVKAFKKPLSVFKGPLLHISPAEELYFGSTESGEKKTLIVLTNVTKNIVAFKVRTTAPEKYRVKPSNSSCDPGASVDIVVSPHGGLTVSAQDRFLIMAAEMEQSSGTGPAELTQFWKEVPRNKVMEHRLRCHTVESSKPNTLTLKDNAFNMSDKTSEDICLQLSRLLESNRKLEDQVQRCIWFQQLLLSLTMLLLAFVTSFFYLLYS

SEQ ID NO: 3401 - protein, 808 aa, Homo sapiens
MLHDARDRQKFFSDVQYLRDMQHKVDSEYQACLRRQEYRRDPNEKKRDQFWGQETSFERSRFSSRSSSKQSSSEEDALTEPRSSIKISAFKCDSKLPAIDQTSVKQKHKSTMTVRKAEKVDPSEPSPADQAPMVLLRKRKPNLRRFTVSPESHSPRASGDRSRQKQQWPAKVPVPRGADQVVQQEGLMCNTKLKRPNQERRNLVPSSQPMTENAPDRAKKGDPSAPSQSELHPALSQAFQGKNSPQVLSEFSGPPLTPTTVGGPRKASFRFRDEDFYSILSLNSRRESDDTEEETQSEECLWVGVRSPCSPSHHKRSRSGGTSTPQAKNKNFEENAENCRGHSSRRSEPSHGSLRISNAMEPATERPSAGQRLSQDPGLPDRESATEKDRGGSENAKKSPLSWDTKSEPRQEVGVNAENVWSDCISVEHRPGTHDSEGYWKDYLNSSQNSLDYFISGRPISPRSSVNSSYNPPASFMHSALRDDIPVDLSMSSTSVHSSDSEGNSGFHVCQPLSPIRNRTPFASAENHNYFPVNSAHEFAVREAEDTTLTSQPQGAPLYTDLLLNPQGNLSLVDSSSSSPSRMNSEGHLHVSGSLQENTPFTFFAVSHFPNQNDNGSRMAASGFTDEKETSKIKADPEKLKKLQESLLEEDSEEEGDLCRICQIAGGSPSNPLLEPCGCVGSLQFVHQECLKKWLKVKITSGADLGAVKTCEMCKQGLLVDLGDFNMIEFYQKHQQSQAQNELMNSGLYLVLLLHLYEQRFAELMRLNHNQVERERLSRNYPQPRTEENENSELGDGNEGSISQSQVV

SEQ ID NO: 3402 - protein, 710 aa, Homo sapiens
MHLPLVLGPLGGAPTVEGPGAPPFLASSLLSAAAKAQHPPLPPPSTLQGRRPRAQAPSASHSSSLRPSQRRPRRPPTVFRLLEGRGPQTPRRSRPRAPAPVPQPFSLPEPSQPILPSVLSLLGLPTPGPSHSDGSFNLLGSDAHLPPPPTLSSGSPPQPRHPIQPSLPGTTSGSLSSVPGAPAPPAASKAPVVPSPVLQSPSEGLGMGAGPACPLPPLAGGEAFPFPSPEQGLALSGAGFPGMLGALPLPLSLGQPPPSPLLNHSLFGVLTGGGGQPPPEPLLPPPGGPGPPLAPGEPEGPSLLVASLLPPPPSDLLPPPSAPPSNLLASFLPLLALGPTAGDGEGSAEGAGGPSGEPFSGLGDLSPLLFPPLSAPPTLIALNSALLAATLDPPSGTPPQPCVLSAPQPGPPTSSVTTATTDPGASSLGKAPSNSGRPPQLLSPLLGASLLGDLSSLTSSPGALPSLLQPPGPLLSGQLGLQLLPGGGAPPPLSEASSPLACLLQSLQQIPPEQPEAPCLPPESPASALEPEPARPPLSALAPPHGSPDPPVPELLTGRGSGKRGRRGGGGLRGINGEARPARGRKPGSRREPGRLALKWGTRGGFNGQMERSPRRTHHWQHNGELAEGGAEPKDPPPPGPHSEDLKVPPGVVRKSRRGRRRKYNPTRNSNSSRQDITLEPSPTARAAVPLPPRARPGRPAKNKRRKLAP

SEQ ID NO: 3403 - protein, 534 aa, Homo sapiens [sequence omitted]

SEQ ID NO: 3404 - protein, 197 aa, Homo sapiens
MPIPASPLHPPLPSLLLYLLLELAGVTHVFHVQQTEMSQTVSTGESIILSCSVPDTLPNGPVLWFKGTGPNRKLIYNFKQGNFPRVKEIGDTTKPGNTDFSTRIREISLADAGTYYCVKFIKGRAIKEYQSGRGTQVFVTEQNPRPPKNRPAGRAGSRAHHDAHTCLSALPERNSTNYFVQPCCCLRLLGLTGLLSK

SEQ ID NO: 3405 - protein, 629 aa, Homo sapiens
MEQGHSDLEKMQDLYSESLIMDWWYNAEKDGDSKHQKEICSMISTPEKCAKPQSDVDSTQTSSLNMLKGPWGLSDQKVQKKKVLHAESTKTSLLRSQMSSLRSSACSERKDGLSNASSRRTALSDKEMSILLAEEWLDDKSSEKVTREGSQVYDHDSSDVSSENWLKTYGLVAKKLTLMDALSVAAVPHSSTYVPVLDKHVMSKVFDEVFPLAHVCNDTNKMTLINPQGAKLNIYKRKVEQAIQSYEKRLNKIVWRALSQEEKEKLDANKPIQYLENKTVLNQALERLNWPISLKELSMLESEILAGKMYIQQAMELQEAAKKNYANKAPGEQQKLQGNPTKKTKSKRPDPLKGQKVIARCDENGFYFPGVVKKCVSRTQALVGFSYGDTKVVSTSFITPVGGAMPCPLLQVGDYVFAKIVIPKGFDFYVPAIVIALPNKHVATEKFYTVLKCNNRREFCPRSALIKISQNKYALSCSHIKSPPIPEDPEVEDVEARNSAFLFWPLKEADTQDSREPRREKPRRKKRPAKQPLQQAAPSDSDGSSHGISSHGSCQGTHPEPKVWVMGGEHNIAYLRNTLKSLSRIVHLTSSFRFWACLGSSAAKTLTSLSNAELCFPRQPTSTSPRPGV

SEQ ID NO: 3406 - protein, 186 aa, Homo sapiens
MNLNPPTSALQIEGKGSHIMARNVSCFLVRHTPHPRRVCHIKGLNNIPICTVNDDENAFGTLWGVGQSNYLEKNRIPFANCSYPSSTAVQESPVRGMSPAPNGAKVPPRPHSEPSRKIKECFKTSSENPLVIKKEEIKAKRPPSPPKACSTPGSCSSGMTSTKNDVKANTICIPNYLDQEIKATLL

SEQ ID NO: 3407 - protein, 164 aa, Homo sapiens
MCPPVSMRYEEEGMSYLYASWMYQLQHGDQLSICFTCFKAAFLDFKDLLESEDWEEDNWDPELMEHTEAESEQEGSSGMELSWGQSPGQPVQGGSEAWGPGTLAAAPEGLEDAGLDPHFVPTELWPQEAVPLGLGLEDADWTQGLPWRFEELLTCSHWPSFFPS

SEQ ID NO: 3408 - protein, 109 aa, Homo sapiens [sequence omitted]

SEQ ID NO: 3409 - protein, 517 aa, Homo sapiens [sequence omitted]

SEQ ID NO: 3410 - protein, 194 aa, Homo sapiens
MVVCPLIDVIDDRTLEYKPSPLVRGTFDWNLQFKWDNVFSYEMDGPEGSTKPIRSPAMSGGIFAMRRHYFNEIGQYDKDMDFWGRENLELSLRIWMCGGQLFIIPCSRVGHISKKQTGKPSTIISAMTHNYLRLVHVWLDEYKEQFFLRKPGLKYVTYGNIRERVELRKRLGCKSFQWYLDNVFPELEASVNSL

SEQ ID NO: 3411 - protein, 586 aa, Homo sapiens
MSANPRWDISRALGVAKLFHLVCGVREACVTPFLTLYLRQLGLAAPWVGTLMGTKHLIAAFWAPVCAFLAKSYRKRRALLIGSLLGSVGASLLMVLVPPVDKNRVHFPCNGSSGLTSTDALPGVTLPVNITSAQESASSHPAKRTAEVEMPGFRNPPGESDRETFRDLHVYLAPSVEGARTTSQALLHPVTSGLKDHPWEVTFEVVKTALPLLPGGKGPGNPANLSGTKGKAWAFDLSLEALRRTFILSLGSVAFWELLTAPLEQVADDSLYEFLDSVDATDRYRSLWVWRLLGMSAGVCGITALVGQLDCFLMTSGPRGVVHFYGYSVVSTLALLVSIAFPIPICQQWEPSYKRVKALSIVGGDPHLILLASTTVLVGAIVSTVQNFLFWHMKDHGSGELVMGFSVALSLLGEILLHPFKATLLRKLSRTGLVGLGLSCLAGQLLYYSFLWSWWSVLPIQILSAISNRALWWAVGASVEDLATPRMERALSALFRGHFYGSGCSLGSFVGGFVVMRFSLAVLYQACCVALLLWLALLLSIQRRLPRERKIKYSKLLSMEVSDTSDSEQGTEQDWLVKAMREEHSD
